US009322031B2

(12) United States Patent
Andersen et al.

(10) Patent No.: US 9,322,031 B2
(45) Date of Patent: Apr. 26, 2016

(54) TRANSGENIC PLANTS WITH ENHANCED AGRONOMIC TRAITS

(75) Inventors: Scott E. Andersen, St. Louis, MO (US); Yongwei Cao, Chesterfield, MO (US); Stanton B. Dotson, Chesterfield, MO (US); Michael D. Edgerton, St. Louis, MO (US); David K. Kovalic, Clayton, MO (US); Linda L. Lutfiyya, St. Louis, MO (US); Zhidong Xie, Maryland Heights, MO (US); Gregory R. Heck, Crystal Lake Park, MO (US); Thomas J. La Rosa, Fenton, MO (US); Jingdong Liu, Chesterfield, MO (US); Jingrui Wu, Chesterfield, MO (US); Garrett J. Lee, Wayne, NJ (US); Thomas R. Adams, North Stonington, CT (US); Donald E. Nelson, Stonington, CT (US); Timothy Conner, Chesterfield, MO (US)

(73) Assignee: Monsanto Technology LLC, St. Louis, MO (US)

( * ) Notice: Subject to any disclaimer, the term of this patent is extended or adjusted under 35 U.S.C. 154(b) by 129 days.

(21) Appl. No.: 13/444,802

(22) Filed: Apr. 11, 2012

(65) Prior Publication Data

US 2012/0317677 A1 Dec. 13, 2012

Related U.S. Application Data

(63) Continuation of application No. 11/982,010, filed on Oct. 31, 2007, now abandoned, which is a continuation-in-part of application No. 10/678,588, filed on Oct. 2, 2003, now abandoned.

(60) Provisional application No. 60/415,758, filed on Oct. 2, 2002, provisional application No. 60/425,157, filed on Nov. 8, 2002, provisional application No. 60/463,787, filed on Apr. 18, 2003.

(51) Int. Cl.
*C12N 15/82* (2006.01)
*A01H 1/06* (2006.01)

(52) U.S. Cl.
CPC .............. *C12N 15/8271* (2013.01); *A01H 1/06* (2013.01); *C12N 15/8273* (2013.01)

(58) Field of Classification Search
None
See application file for complete search history.

(56) References Cited

U.S. PATENT DOCUMENTS

| 5,322,938 A | 6/1994 | McPherson et al. |
|---|---|---|
| 5,641,876 A | 6/1997 | McElroy et al. |
| 6,084,089 A | 7/2000 | Mine et al. |
| 6,140,078 A | 10/2000 | Sanders et al. |
| 6,162,965 A * | 12/2000 | Hansen ........................ 800/278 |
| 6,194,636 B1 | 2/2001 | McElroy et al. |
| 6,232,526 B1 | 5/2001 | McElroy et al. |
| 6,235,975 B1 * | 5/2001 | Harada et al. ................. 800/306 |
| 6,677,504 B2 | 1/2004 | Silva et al. |
| 6,717,034 B2 | 4/2004 | Jiang |
| 7,151,204 B2 | 12/2006 | Houmard et al. |
| 7,253,000 B2 | 8/2007 | Sivasankar et al. |
| 7,294,759 B2 | 11/2007 | Allen et al. |
| 7,317,141 B2 | 1/2008 | Sivasankar et al. |
| 7,345,217 B2 | 3/2008 | Zhang et al. |
| 7,482,511 B2 | 1/2009 | da Costa e Silva et al. |
| 7,511,130 B2 | 3/2009 | Heck et al. |
| 7,511,190 B2 | 3/2009 | Creelman et al. |
| 7,786,353 B2 | 8/2010 | Fernandes |
| 7,868,149 B2 | 1/2011 | Boukharov et al. |
| 7,868,229 B2 | 1/2011 | Ratcliffe et al. |
| 7,956,242 B2 | 6/2011 | Zhang et al. |
| 7,960,612 B2 | 6/2011 | Zhang et al. |
| 8,030,546 B2 | 10/2011 | Reuber et al. |
| 8,558,059 B2 | 10/2013 | Heard |
| 8,633,353 B2 | 1/2014 | Ratcliffe et al. |
| 2002/0102695 A1 | 8/2002 | Silva et al. |
| 2003/0093837 A1 | 5/2003 | Keddie et al. |
| 2003/0126638 A1 | 7/2003 | Allen et al. |
| 2003/0204870 A1 | 10/2003 | Allen et al. |
| 2003/0233670 A1 | 12/2003 | Edgerton et al. |
| 2004/0019927 A1 * | 1/2004 | Sherman et al. ............... 800/278 |
| 2004/0031072 A1 | 2/2004 | La Rosa et al. |
| 2004/0034888 A1 | 2/2004 | Liu et al. |

(Continued)

FOREIGN PATENT DOCUMENTS

| EP | 1230345 B1 | 6/2008 |
|---|---|---|
| WO | WO 02/057439 * | 7/2002 |

(Continued)

OTHER PUBLICATIONS

Nelson et al. (PNAS, 104:16450-16455, Published Oct. 16, 2007.*
Lotan et al. (Cell, 93:1195-1205, 1998).*
Li et al. (NCBI, GenBank Sequence Accession No. X59714, pp. 1-2, Published Nov. 15, 1992.*
Allen et al. (Crop evapotranspiration—Guidelines for computing crop water requirements—FAO Irrigation and drainage paper 56, FAO, 1998).*

(Continued)

*Primary Examiner* — Vinod Kumar
(74) *Attorney, Agent, or Firm* — Thompson Coburn LLP; Charles P. Romano

(57) ABSTRACT

This invention provides transgenic plant cells with recombinant DNA for expression of proteins that are useful for imparting enhanced agronomic trait(s) to transgenic crop plants. This invention also provides transgenic plants and progeny seed comprising the transgenic plant cells where the plants are selected for having an enhanced trait selected from the group of traits consisting of enhanced water use efficiency, enhanced cold tolerance, increased yield, enhanced nitrogen use efficiency, enhanced seed protein and enhanced seed oil. Also disclosed are methods for manufacturing transgenic seed and plants with enhanced traits.

9 Claims, 3 Drawing Sheets

(56) References Cited

U.S. PATENT DOCUMENTS

| | | | |
|---|---|---|---|
| 2004/0123347 A1 | 6/2004 | Hinchey et al. | |
| 2005/0022266 A1 | 1/2005 | Wu et al. | |
| 2005/0048556 A1 | 3/2005 | Heck et al. | |
| 2005/0086718 A1 | 4/2005 | Heard et al. | |
| 2005/0097640 A1 | 5/2005 | Fernandes | |
| 2005/0172364 A1 | 8/2005 | Heard | |
| 2006/0021087 A1 | 1/2006 | Baum et al. | |
| 2006/0242738 A1 | 10/2006 | Sherman et al. | |
| 2007/0039076 A1 | 2/2007 | Boukharov et al. | |
| 2007/0192889 A1 | 8/2007 | La Rosa et al. | |
| 2007/0199107 A1* | 8/2007 | Ratcliffe et al. | 800/287 |
| 2008/0040973 A1 | 2/2008 | Nelson et al. | |
| 2008/0104730 A1 | 5/2008 | Wu et al. | |
| 2008/0163397 A1* | 7/2008 | Ratcliffe et al. | 800/298 |
| 2008/0313756 A1* | 12/2008 | Zhang et al. | 800/260 |
| 2009/0044297 A1 | 2/2009 | Andersen et al. | |
| 2009/0049566 A1* | 2/2009 | Zhang et al. | 800/266 |
| 2009/0049573 A1 | 2/2009 | Dotson et al. | |
| 2009/0093620 A1 | 4/2009 | Kovalic et al. | |
| 2009/0100544 A1 | 4/2009 | Anstrom et al. | |
| 2009/0138981 A1* | 5/2009 | Repetti et al. | 800/263 |
| 2009/0183270 A1 | 7/2009 | Adams et al. | |
| 2009/0217414 A1* | 8/2009 | La Rosa et al. | 800/278 |
| 2009/0241217 A9* | 9/2009 | Wu et al. | 800/278 |
| 2010/0293663 A2 | 11/2010 | LaRosa et al. | |
| 2012/0022713 A1 | 1/2012 | Deaver, Sr. et al. | |
| 2012/0317677 A1 | 12/2012 | Andersen et al. | |

FOREIGN PATENT DOCUMENTS

| | | |
|---|---|---|
| WO | WO 02/057439 A2 | 7/2002 |
| WO | WO 03/008540 A2 | 1/2003 |
| WO | WO 2004/076638 A2 | 9/2004 |
| WO | 2005033318 A2 | 4/2005 |
| WO | WO 2005/033319 A2 | 4/2005 |
| WO | 2007028165 A2 | 3/2007 |
| WO | 2008002480 A2 | 1/2008 |
| WO | 2009049110 | 4/2009 |

OTHER PUBLICATIONS

U.S. Appl. No. 60/415,758, filed Oct. 2, 2002, Abad et al.
U.S. Appl. No. 60/425,157, filed Nov. 8, 2002, Wu et al.
Bork et al. "Go hunting in sequence databases but watch out for the traps," *TIG*, 12:425-427, 1996.
Doerks et al. "Protein annotation: detective work for function prediction," *TIG*, 14:248-250, 1998.
Edwards et al., "Multiple genes encoding the conserved CCAAT-box transcription factor complex are expressed in Arabidopsis," *Plant Physiology*, 117:1015-1022, 1998.
GenBank Sequence Accession No. X59714, dated Nov. 15, 1992.
Gordon et al., "RNAi for insect-proof plants," *Nature Biotechnology*, 25(11):1231-1232, 2007.
Guo et al., "Protein tolerance to random amino acid change," *PNAS*, 101:9205-9210, 2004.
Keskin et al., "A new, structurally nonredundant, diverse data set of protein—protein interfaces and its implications," *Protein Science*, 13:1043-1055, 2004.
Lee et al., "Arabidopsis Leafy COTYLEDON1 represents a functionally specialized subunit of the CCAAT binding transcription factor," *PNAS*, 100(4):2152-2156, 2003.
Li, et al., "Evolutionary variation of the CCAAT-binding transcription factor NF-Y," *Nucleic Acids Research*, 20(5):1087-1091, 1992.
Lotan et al., "Arabidopsis Leafy COTYLEDON1 is Sufficient to Induce Embryo Development in Vegetative Cells," *Cell*, 93(7):1195-1205, 1998.
Mantovani R., "The molecular biology of the CCAAT-binding factor NF-Y," *Gene*, 18;239(1):15-27, 1999.
Miyoshi et al., "OsHAP3 genes regulate chloroplast biogenesis in rice," *The Plant Journal*, 36(4):532-540, 2003.
Nelson et al., "Plant nuclear factor Y (NF-Y) B subunits confer drought tolerance and lead to improved corn yields on water-limited acres," *PNAS*, 104(42):16450-16455, 2007.
Ngo et al., "Computational complexity, protein structure prediction, and the levinthal paradox" in "The protein folding problem and tertiary structure prediction," K. Merz., and S. Le Grand (eds.), pp. 1-80, 1994.
Smith et al. "The challenges of genome sequence annotation or The devil is in the details," *Nature Biotechnology*, 15:1222-1223, 1997.
Stephenson et al., "Genome-wide identification and expression analysis of the NF-Y family of transcription factors in Triticum aestivum," *Plant Molecular Biology*, 65:77-92, 2007.
Thornton et al. "From structure to function: approaches and limitations," *Nature Structural Biology*, structural genomic supplement, 2000.
Vilardell et al., "Regulation of the maize rab17 gene promoter in transgenic heterologous systems," *Plant Molecular Biology*, 17:985-993, 1991.
Wells, "Additivity of mutational effects in proteins," *Biochemistry*, 29:8509-8517, 1990.
Xiao-Yan Li, *Nucleic Acids Research*, vol. 20, pp. 1087-1091, 1992.
Information Disclosure Statement for U.S. Appl. No. 10/678,588, filed Jun. 1, 2004.
Sequence alignment between the sequence encoded by SEQ ID No:29 in U.S. Appl. No. 11/821,176 vs. SEQ ID No:1764 in U.S. Appl. No. 11/982,010, dated May 17, 2010.
Sequence alignment between the sequence encoded by SEQ ID No. 30 in U.S. Appl. No. 11/821,176 vs. SEQ ID No. 1764 in U.S. Appl. No. 11/982,010, dated May 17, 2010.
Sequence alignment between the sequence encoded by SEQ ID No. 31 in U.S. Appl. No. 11/821,176 vs. SEQ ID No. 1764 in U.S. Appl. No. 11/982,010, dated May 17, 2010.
Sequence alignment between the sequence encoded by SEQ ID No. 32 in U.S. Appl. No. 11/821,176 vs. SEQ ID No. 1764 in U.S. Appl. No. 11/982,010, dated May 17, 2010.
Sequence alignment between the sequence encoded by SEQ ID No. 29 in U.S. Appl. No. 11/821,176 vs. SEQ ID No. 1765 in U.S. Appl. No. 11/982,274, dated May 12, 2010.
Sequence alignment between the sequence encoded by SEQ ID No. 30 in U.S. Appl. No. 11/821,176 vs. SEQ ID No. 1765 in U.S. Appl. No. 11/982,274, dated May 12, 2010.
Sequence alignment between the sequence encoded by SEQ ID No. 31 in U.S. Appl. No. 11/821,176 vs. SEQ ID No. 1765 in U.S. Appl. No. 11/982,274, dated May 12, 2010.
Sequence alignment between the sequence encoded by SEQ ID No. 32 in U.S. Appl. No. 11/821,176 vs. SEQ ID No. 1765 in U.S. Appl. No. 11/982,274, dated May 12, 2010.
Sequence alignment between the sequence encoded by SEQ ID No. 29 in U.S. Appl. No. 11/821,176 vs. SEQ ID No. 617 in U.S. Appl. No. 11/982,680, dated May 17, 2010.
Sequence alignment between the sequence encoded by SEQ ID No. 30 in U.S. Appl. No. 11/821,176 vs. SEQ ID No. 617 in U.S. Appl. No. 11/982,680, dated May 17, 2010.
Sequence alignment between the sequence encoded by SEQ ID No. 31 in U.S. Appl. No. 11/821,176 vs. SEQ ID No. 617 in U.S. Appl. No. 11/982,680, dated May 17, 2010.
Sequence alignment between the sequence encoded by SEQ ID No. 32 in U.S. Appl. No. 11/821,176 vs. SEQ ID No. 617 in U.S. Appl. No. 11/982,680, dated May 17, 2010.
Office Action regarding U.S. Appl. No. 11/982,274, dated Oct. 27, 2010.
Office Action Regarding U.S. Appl. No. 11/982,010, dated Jan. 6, 2011.
Office Action regarding U.S. Appl. No. 11/982,274, dated Jan. 6, 2011.
Office Action Regarding U.S. Appl. No. 11/982,680, dated Mar. 11, 2011.
Response to Office Action regarding U.S. Appl. No. 11/982,274, dated Apr. 27, 2011.
Information Disclosure Statement regarding U.S. Appl. No. 11/982,274, dated Apr. 27, 2011.
Supplemental Information Disclosure Statement for U.S. Appl. No. 11/982,010, filed Jun. 3, 2011.
Supplemental Information Disclosure Statement for U.S. Appl. No. 11/982,680, filed Jun. 3, 2011.

(56) References Cited

OTHER PUBLICATIONS

Amendment and Response to Office Action regarding U.S. Appl. No. 11/982,010, dated Jul. 6, 2011.
Final Office Action regarding U.S. Appl. No. 11/982,274, dated Aug. 1, 2011.
Notice of Abandonment regarding U.S. Appl. No. 11/982,680, dated Sep. 19, 2011.
Final Office Action regarding U.S. Appl. No. 11/982,010, dated Oct. 11, 2011.
Response to Final Office Action regarding U.S. Appl. No. 11/982,274, dated Feb. 1, 2012.
Notice of Abandonment regarding U.S. Appl. No. 11/982,010, dated Apr. 17, 2012.
Summary of drought tolerance data for NF-YB variants, undated (referenced in IDS for U.S. Appl. Nos. 11/982,274 and 11/982,680).
Summary of SEQ ID No. 29 data for yield under stress (SEQ ID No. 29 is NFYB2-S83A modified NF-YB2 protein of U.S. Appl. No. 11/821,176), undated.
Information Disclosure Statement filed for U.S. Appl. No. 13/444,802 on Sep. 12, 2012.
Anderson, John R., et al., "Managing Drought—Drought Advisory for Corn Production", Crop Strategies, North Carolina Cooperative Extension Service, AG 519-13, 1995, 6 pages.
Cai et al., "A Putative CCAAT-Binding Transcription Factor is a Regulator of Flowering Timing in Arabidopsis", Plant Physiology, Sep. 2007, pp. 98-105, vol. 145.
Cassel, E. Kim, et al., Aflatoxins: Hazards in Grain/Aflatoxicosis and Livestock, South Dakota State University Cooperative Extension Service, Oct. 2001, 4 pages, FS907.
Chen et al, "AtHAP3b Plays a Crucial Role in the Regulation of Flowering Time in Arabidopsis During Osmotic Stress", Journal of Biochemistry and Molecular Biology, Nov. 2007, pp. 1083-1089, vol. 40, No. 6.
Combier et al., "MtHAP2-1 is a Key Transcriptional Regulator of Symbiotic Nodule Development Regulated by microRNA169 in Medicago Truncatula", Genes and Development, 2006, pp. 3084-3088, vol. 20, Cold Spring Harbor Laboratory Press.
Diener, Urban L., et al., Epidemiology of Aflatoxin Formation by Aspergillus Flavus, Annual Review of Phytopathology, 1987, pp. 249-270, vol. 25.
Kumimoto et al., "The Nuclear Factor Y Subunits NF-YB2 and NF-YB3 Play Additive Roles in the Promotion of Flowering by Inductive Long-Day Photoperiods in Arabidopsis", Planta, 2008, pp. 709-723, vol. 228, Springer-Verlag.
Meinke et al., "Leafy Cotyledon Mutants of Arabidopsis", The Plant Cell, Aug. 1994, pp. 1049-1064, vol. 6.
Mette et. al., (EMBO J. 19:5194-51201, 2000).
Monsanto Modified NFYB Performance Summary, Apr. 12, 2010, 1 page.
Monsanto SEQ ID No. 29 Drought Tolerance Data, Apr. 12, 2010, 6 pages.
Mu et al., "Leafy Cotyledon1 is a Key Regulator of Fatty Acid Biosynthesis in Arabidopsis", Plant Physiology, Oct. 2008, pp. 1042-1054, vol. 148.
Xu, Wenwei, et al., Progress Toward Developing Stress-Tolerant and Low-Aflatoxin Corn Hybrids for the Southern States [abstract], 16th Annual Aflatoxin Elimination Workshop Proceedings, Oct. 3, 2003, p. 63. Obtained from United States Department of Agriculture Agricultural Research Service, http://www.ars.usda.gov, 2 pages.
Yamamoto et al., "Arabidopsis NF-YB Subunits LEC1 and LEC1-Like Activate Transcription by Interacting with Seed-Specific Abre-Binding Factors", The Plant Journal, 2009, pp. 843-856, vol. 58, Blackwell Publishing Ltd.
Zanetti et al., "A C Subunit of the Plant Nuclear Factor NF-Y Required for Rhizobial Infection and Nodule Development Affects Partner Selection in the Common Bean-Rhizobium etli Symbiosis", The Plant Cell, Dec. 2010, pp. 4142-4157, vol. 22.
Ingram et al., "The Molecular Basis of Dehydration Tolerance in Plants", Annual Review of Plant Physiology and Plant Molecular Biology, Jun. 1996, pp. 377-403, vol. 47.
Urao et al., "A Transcriptional Activation Domain of ATMYb2, a Drought-Inducible Arabidopsis Myb-Related Protein", The Plant Journal, Dec. 1996, pp. 1145-1148, vol. 10 Issue 6.
Shinozaki et al., "Gene Expression and Signal Transduction in Water-Stress Response", Plant Physiology, Oct. 1997, pp. 327-334, vol. 115 Issue 2.
Liu et al., "Two Transcription Factors, DREB1 and DREB2, with an EREBP/AP2 DNA Binding Domain Separate Two Cellular Signal Transduction Pathways in Drought- and Low-Temperature-Responsive Gene Expression, Respectively, in Arabidopsis", The Plant Cell, Aug. 1998, pp. 1391-1406, vol. 10 Issue 8.
Jaglo-Ottosen et al., "Arabidopsis CBF1 Overexpression Induces COR Genes and Enhances Freezing Tolerance", Science, Apr. 3, 1998, pp. 104-106, vol. 280 No. 5360.
Gilmour et al., "Low Temperature Regulation of the Arabidopsis CBF Family of AP2 Transcriptional Activators as an Early Step in Cold-Induced COR Gene Expression", The Plant Journal, Nov. 1998, pp. 433-442, vol. 16 Issue 4.

* cited by examiner

Fig 1. Plasmid map of pMON93039
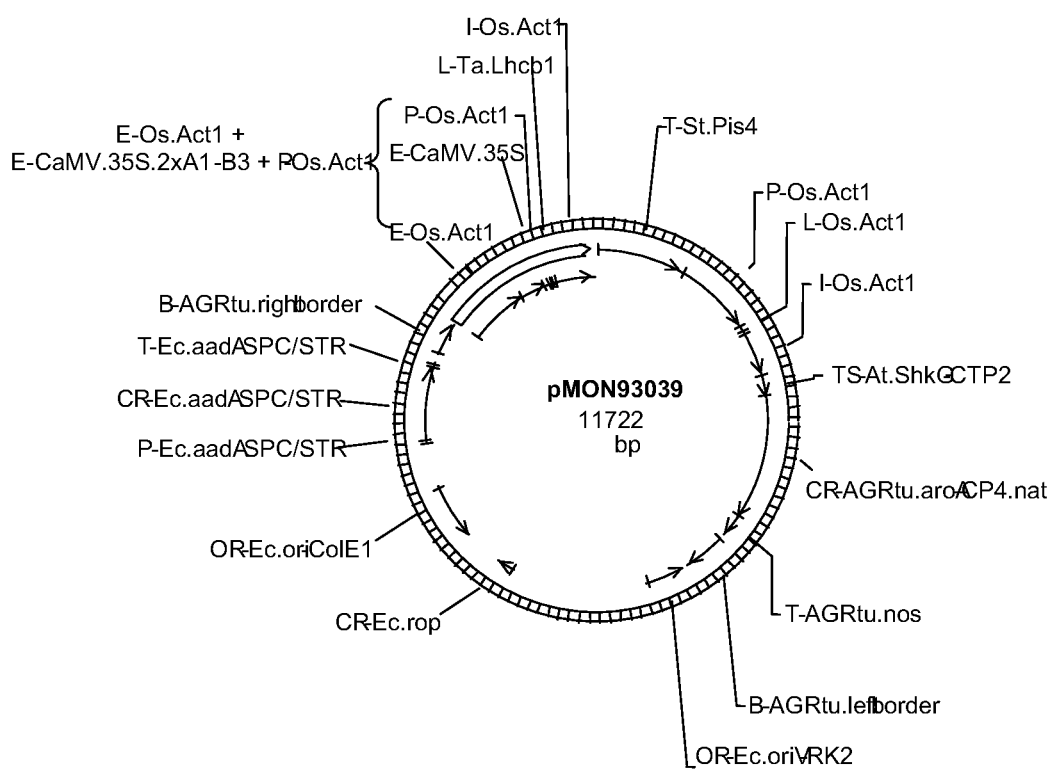

FIG. 2 Plasmid map of pMON82053
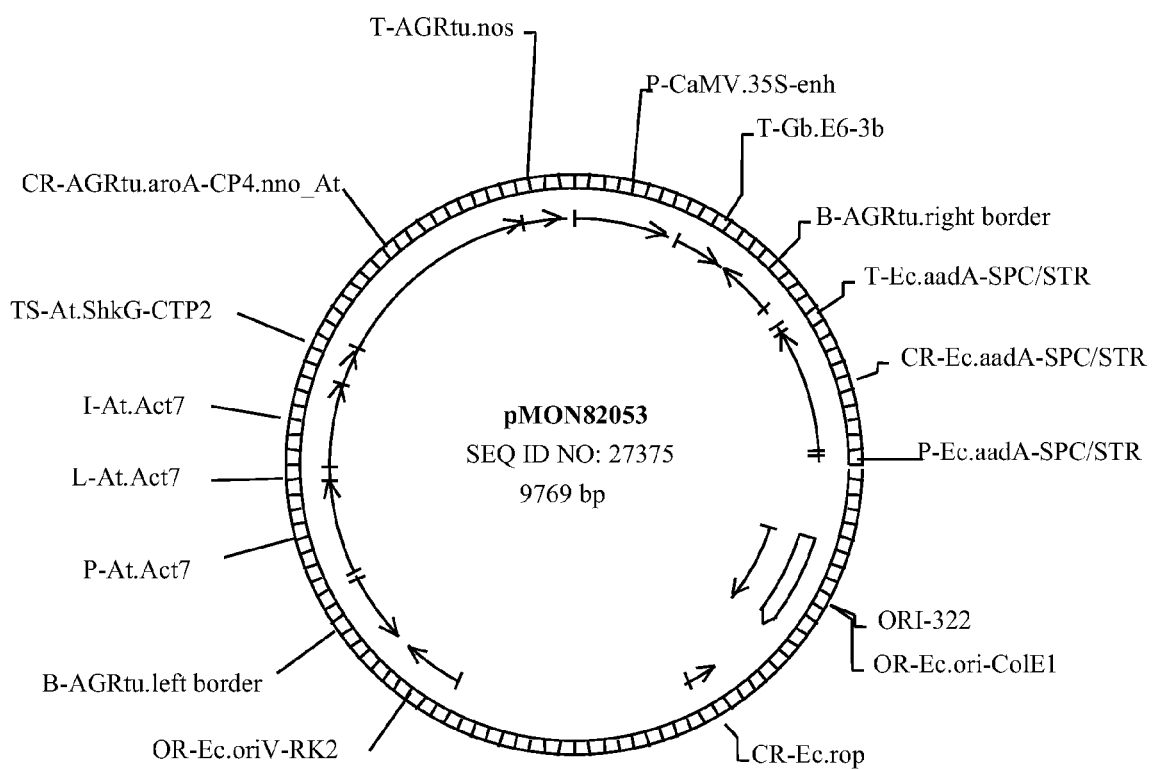

FIG. 3 Plasmid map of pMON99053
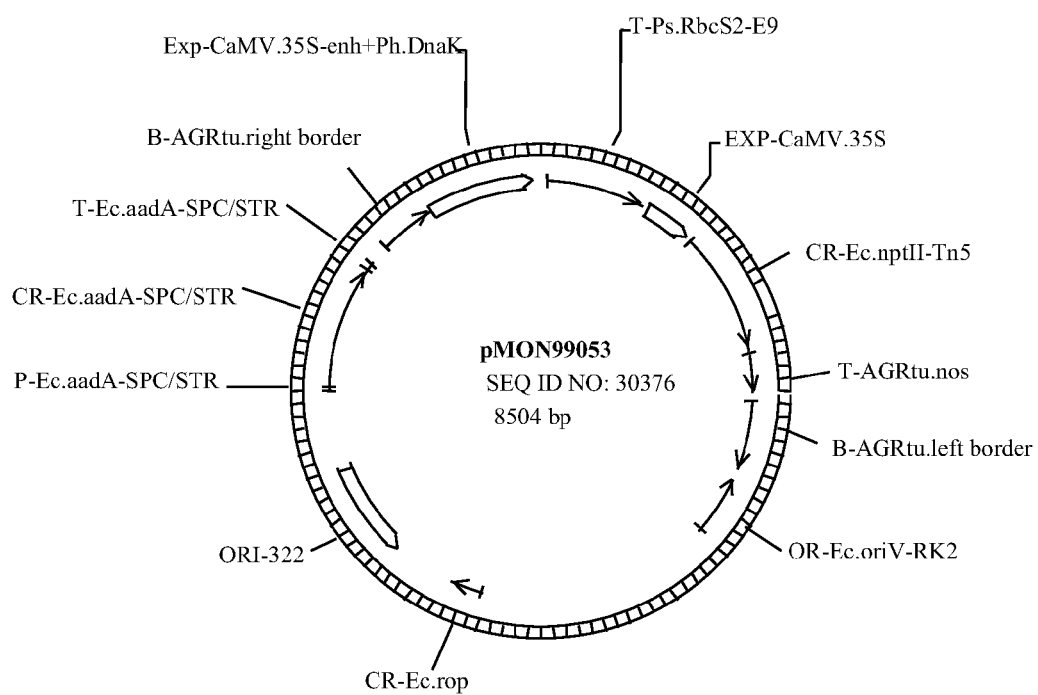

TRANSGENIC PLANTS WITH ENHANCED AGRONOMIC TRAITS

CROSS-REFERENCE TO RELATED APPLICATIONS

This application is continuation of U.S. application Ser. No. 11/982,010, filed Oct. 31, 2007, now abandoned which is a continuation-in-part of prior U.S. application Ser. No. 10/678,588 filed Oct. 2, 2003 (now abandoned), which application claims priority under 35 U.S.C. §119(e) of U.S. Provisional US Application Nos. 60/415,758, filed Oct. 2, 2002, 60/425,157, filed Nov. 8, 2002, and 60/463,787, filed Apr. 18, 2003, the disclosures of all of which are incorporated herein by reference.

This application is a continuation-in-part of prior U.S. application Ser. No. 10/310,154 filed Dec. 4, 2002 (pending), which application claims priority under 35 U.S.C. §119(e) of U.S. Provisional Application No. 60/337,358 filed Dec. 4, 2001, which applications are incorporated herein by reference in their entirety.

This application is a continuation-in-part of prior U.S. application Ser. No. 10/438,246 (pending) filed May 14, 2003, which application claims priority under 35 U.S.C. §120 as a continuation-in-part of U.S. application Ser. No. 10/155,881 filed May 22, 2002 (now abandoned); and claims priority under 35 U.S.C. §120 as a continuation-in-part of U.S. application Ser. No. 09/816,660 filed Mar. 26, 2001 (now abandoned), which is a continuation-in-part of U.S. application Ser. No. 09/733,089 filed Dec. 11, 2000 (now abandoned); and claims priority under 35 U.S.C. §120 as a continuation-in-part of U.S. application Ser. No. 09/565,306 filed May 4, 2000 (now abandoned), which claims priority under 35 U.S.C. §119(e) of U.S. Application No. 60/132,860 filed May 7, 1999; and;

claims priority under 35 U.S.C. §120 as a continuation-in-part of U.S. application Ser. No. 10/424,599 filed Apr. 28, 2003 (pending), which claims priority under 35 U.S.C. §120 as a continuation-in-part of U.S. application Ser. No. 09/985,678 filed Nov. 5, 2001 (now abandoned), which claims priority under 35 U.S.C. §120 as a continuation of Ser. No. 09/304,517 filed May 6, 1999 (now abandoned); Ser. No. 10/424,599 also claims priority under 35 U.S.C. §120 as a continuation-in-part of U.S. application Ser. No. 09/874,708, filed Jun. 5, 2001 (now abandoned), which claims priority under 35 U.S.C. §119(e) of U.S. Application No. 60/211,750, filed Jun. 15, 2000;

all of which applications are incorporated herein by reference in their entirety.

This application is a continuation-in-part of prior U.S. application Ser. No. 09/684,016 filed Oct. 10, 2000 (pending).

This application is a continuation-in-part of prior U.S. application Ser. No. 10/425,114 filed Apr. 28, 2003 (pending), which application claims priority under 35 U.S.C. §120 as a continuation-in-part of U.S. application Ser. No. 10/219,999 filed Aug. 15, 2002 (now abandoned), which application claims priority under 35 U.S.C. §119(e) of U.S. Provisional US Application Nos. 60/312,544 filed Aug. 15, 2001, and 60/324,109, filed Sep. 21, 2001, the disclosures of all of which are incorporated herein by reference.

This application is a continuation-in-part of prior U.S. application Ser. No. 11/491,125 filed Aug. 24, 2006 (pending); which application claims priority under 35 U.S.C. §119 (e) of U.S. Provisional US Application Nos. 60/144,351, filed Jul. 20, 1999; 60/163,469, filed Nov. 1, 1999; 60/177,203, filed Jan. 21, 2000; 60/184,162, filed Feb. 23, 2000; and which application is a continuation-in-part of prior U.S. application Ser. No. 09/620,392 filed Jul. 19, 2000, (now abandoned), the disclosures of all of which are incorporated herein by reference.

This application also incorporates by reference related U.S. application Ser. No. 11/982,010 filed on Oct. 31, 2007.

INCORPORATION OF SEQUENCE LISTING

Two copies of the sequence listing (Copy 1 and Copy 2) and a computer readable form (CRF) of the sequence listing, all on CD-ROMs, each containing the text file named "pa_01352.txt", which is 8.45 MB (measured in MS-WINDOWS), were created on Oct. 30, 2007 and are herein incorporated by reference.

FIELD OF THE INVENTION

Disclosed herein are inventions in the field of plant genetics and developmental biology. More specifically, the present inventions provide plant cells with recombinant DNA for providing an enhanced trait in a transgenic plant, plants comprising such cells, seed and pollen derived from such plants, methods of making and using such cells, plants, seeds and pollen.

BACKGROUND OF THE INVENTION

Transgenic plants with improved agronomic traits such as yield, environmental stress tolerance, pest resistance, herbicide tolerance, improved seed compositions, and the like are desired by both farmers and consumers. Although considerable efforts in plant breeding have provided significant gains in desired traits, the ability to introduce specific DNA into plant genomes provides further opportunities for generation of plants with improved and/or unique traits. The ability to develop transgenic plants with enhanced traits depends in part on the identification of useful recombinant DNA for production of transformed plants with enhanced properties, e.g. by actually selecting a transgenic plant from a screen for such enhanced property.

SUMMARY OF THE INVENTION

This invention provides plant cell nuclei with recombinant DNA for expression of plant HAP3 transcription factor proteins and/or 14-3-3 proteins, which proteins impart enhanced agronomic traits in transgenic plants having the nuclei in their cells, e.g. enhanced water use efficiency, enhanced cold tolerance, increased yield, enhanced nitrogen use efficiency, enhanced seed protein or enhanced seed oil. Such recombinant DNA in a plant cell nucleus of this invention is provided as a construct comprising a promoter that is functional in plant cells and that is operably linked to DNA that encodes a protein or to DNA that results in gene suppression.

Other aspects of the invention are specifically directed to transgenic plant cells comprising the recombinant DNA of the invention, transgenic plants comprising a plurality of such plant cells, progeny transgenic seed, embryo and transgenic pollen from such plants. Such transgenic plants are selected from a population of transgenic plants regenerated from plant cells transformed with recombinant DNA by screening transgenic plants in the population for an enhanced trait as compared to control plants that do not have said recombinant DNA, where the enhanced trait is selected from group of enhanced traits consisting of enhanced water use efficiency, enhanced cold tolerance, increased yield, enhanced nitrogen use efficiency, enhanced seed protein and enhanced seed oil.

In yet another aspect of the invention the plant cells, plants, seeds, embryo and pollen further comprise DNA expressing a protein that provides tolerance from exposure to an herbicide applied at levels that are lethal to a wild type plant cell. Such tolerance is especially useful not only as an advantageous trait in such plants, but is also useful in a selection step in the methods of the invention. In aspects of the invention the agent of such herbicide is a glyphosate, dicamba, or glufosinate compound.

Yet other aspects of the invention provide transgenic plants which are homozygous for the recombinant DNA and transgenic seed of the invention from corn, soybean, cotton, canola, alfalfa, sugarcane, sugar beet, wheat or rice plants.

This invention also provides methods for manufacturing non-natural, transgenic seed that can be used to produce a crop of transgenic plants with an enhanced trait resulting from expression of stably-integrated, recombinant DNA encoding plant HAP3 transcription factor proteins and/or 14-3-3 proteins in the nucleus of the plant cells. More specifically the method comprises (a) screening a population of plants for an enhanced trait and recombinant DNA, where individual plants in the population can exhibit the trait at a level less than, essentially the same as or greater than the level that the trait is exhibited in control plants which do not express the recombinant DNA; (b) selecting from the population one or more plants that exhibit the trait at a level greater than the level that said trait is exhibited in control plants and (c) collecting seed from a selected plant. Such method further comprises steps (a) verifying that the recombinant DNA is stably integrated in said selected plants; and (b) analyzing tissue of a selected plant to determine the production of HAP3 transcription factor protein or a 14-3-3 protein as provided herein. In one aspect of the invention the plants in the population further comprise DNA expressing a protein that provides tolerance to exposure to an herbicide applied at levels that are lethal to wild type plant cells and where the selecting is effected by treating the population with the herbicide, e.g. a glyphosate, dicamba, or glufosinate compound. In another aspect of the invention the plants are selected by identifying plants with the enhanced trait. The methods are especially useful for manufacturing corn, soybean, cotton, alfalfa, sugarcane, sugar beet, wheat or rice seed selected as having one of the enhanced traits described above.

Another aspect of the invention provides a method of producing hybrid corn seed comprising acquiring hybrid corn seed from a herbicide tolerant corn plant which also has stably-integrated, recombinant DNA comprising a promoter that is (a) functional in plant cells and (b) is operably linked to DNA that encodes a HAP3 transcription factor protein or a 14-3-3 protein as provided herein. The methods further comprise producing corn plants from said hybrid corn seed, wherein a fraction of the plants produced from said hybrid corn seed is homozygous for said recombinant DNA, a fraction of the plants produced from said hybrid corn seed is hemizygous for said recombinant DNA, and a fraction of the plants produced from said hybrid corn seed has none of said recombinant DNA; selecting corn plants which are homozygous and hemizygous for said recombinant DNA by treating with an herbicide; collecting seed from herbicide-treated-surviving corn plants and planting said seed to produce further progeny corn plants; repeating the selecting and collecting steps at least once to produce an inbred corn line; and crossing the inbred corn line with a second corn line to produce hybrid seed.

Another aspect of the invention provides a method of selecting a plant comprising plant cells of the invention by using an immunoreactive antibody to detect the presence of protein expressed by recombinant DNA in seed or plant tissue. Yet another aspect of the invention provides anti-counterfeit milled seed having, as an indication of origin, a plant cell of this invention.

Still other aspects of this invention relate to transgenic plants with enhanced water use efficiency or enhanced nitrogen use efficiency. For instance, this invention provides methods of growing a corn, cotton or soybean crop without irrigation water comprising planting seed having plant cells of the invention which are selected for enhanced water use efficiency. Alternatively methods comprise applying reduced irrigation water, e.g. providing up to 300 millimeters of ground water during the production of a corn crop. This invention also provides methods of growing a corn, cotton or soybean crop without added nitrogen fertilizer comprising planting seed having plant cells of the invention which are selected for enhanced nitrogen use efficiency.

BRIEF DESCRIPTION OF THE DRAWINGS

FIGS. 1-3 are plasmid maps.

DETAILED DESCRIPTION OF THE INVENTION

In the attached sequence listing:

SEQ ID NO: 281, SEQ ID NO: 282, SEQ ID NO: 283, SEQ ID NO: 287, SEQ ID NO: 288, SEQ ID NO: 289, SEQ ID NO: 616, SEQ ID NO: 619, SEQ ID NO: 621, SEQ ID NO: 623, SEQ ID NO: 626, SEQ ID NO: 628, SEQ ID NO: 630, and SEQ ID NO: 632 are nucleotide sequences of the coding strand of DNA that encode plant 14-3-3 proteins.

SEQ ID NO: 1263, SEQ ID NO: 1264, SEQ ID NO: 1265, SEQ ID NO: 1269, SEQ ID NO: 1270, SEQ ID NO: 1271, SEQ ID NO: 1596, SEQ ID NO: 1599, SEQ ID NO: 1601, SEQ ID NO: 1603, SEQ ID NO: 1606, SEQ ID NO: 1608, SEQ ID NO: 1610, and SEQ ID NO: 1612 are the amino acid sequences of the plant 14-3-3 proteins.

SEQ ID NO: 783-786 are nucleotide sequences of the coding strand of DNA that encodes plant HAP3 transcription factor proteins of the present invention.

SEQ ID NO: 1763-1766 are the amino acid sequences of the plant HAP3 transcription factor proteins of the present invention.

Over expression of certain genes encoding Hap3 transcription factors having a CCAAT-box DNA binding protein impart to plants a significant resistance and/or tolerance to water deficit. See, for example, priority U.S. application Ser. No. 10/678,588 filed Oct. 2, 2003 and co-pending application U.S. Ser. No. 11/821,176, filed Jun. 23, 2007, the disclosures of which are incorporated herein by reference. The Hap3 transcription factors of this invention, which confer water deficit tolerance and/or resistance when constitutively expressed in a transgenic plant, are in a class known as CCAAT box binding DNA binding proteins. An *Arabidopsis thaliana* Hap3 transcription factor has a nucleic acid sequence of SEQ ID NO:783, and *Zea mays* Hap3 transcription factors have amino acid sequences of SEQ ID NO: 784-786. The amino acid sequence of the transcription factors of this invention, are provided as SEQ ID NOS: 1763-1766.

14-3-3 proteins have been shown to play a role in a large number of different responses in plants including regulation of plasma membrane and tonoplast ion channels, regulation of plasma membrane H(+)-ATPase activity, regulation of nitrogen metabolism including nitrate reductase activity and cytosolic glutamine synthase, regulation of carbon metabolism via modulation of sucrose phosphate synthase activities, response to nutrient starvation, import of proteins to the chloroplast and/or mitochondria and transcriptional regulation.

The structures of two 14-3-3 proteins have been determined. The proteins are dimers of C-shaped subunits that interact via a set of α-helices located in N-terminus. Dominant negative alleles of 14-3-3 proteins have been made by over expression of either C-terminal or N-terminal truncations of the protein. Over expression of N-terminal domains is thought to produce a domain that can dimerize with a wild type protein and prevent cooperative or heterologous interactions normally provided by the second subunit. This may inactivate specific 14-3-3 proteins are larger groups of the proteins as they have been shown to from heterodimers. Over expression of N-terminal truncations act by binding to phosphorylated partners and also preventing required interactions from the second subunit. However, N-terminal truncations may not be expected to inactivate other 14-3-3 family members.

14-3-3 proteins function by binding to other proteins, usually at a site centered on a phosphorylated serine residues and interaction of 14-3-3 proteins with their partner proteins is usually regulated by phosphorylation of the partner protein. Both the dependence on phosphorylation for activity and the relatively broad, constitutive expression patterns observed for most 14-3-3 genes suggest that the activity of 14-3-3 proteins may require the action of proteins other than the 14-3-3 proteins themselves.

As demonstrated herein, expression of 14-3-3 proteins in transgenic plants imparts improved agronomic traits to the transgenic plants, including tolerance to abiotic stress conditions, such as nitrogen deficiency, water stress and cold stress. Improved plant traits are obtained in transgenic plants where the expressed 14-3-3 protein is from a gene native to the transformed plant and in transgenic plants where the 14-3-3 protein is expressed from a non-native gene.

The present invention is directed to expression of 14-3-3 proteins with no truncation of either the C-terminal or N-terminal conserved domains. Such proteins will generally have an entire 14-3-3 Pfam domain (Pfam database accession ID PF00244) as defined for a 236-residue amino acid segment of conserved 14-3-3 protein sequence. A full length 14-3-3 protein generally comprises protein sequence corresponding to the entire native 14-3-3 protein, for example having from about 245 to 265 amino acids.

Transgenic plants which express both a Hap3 transcription factor and a 14-3-3 protein are of particular interest for identification of plants having improved agronomic traits.

As used herein a "plant cell" means a plant cell that is transformed with stably-integrated, non-natural, recombinant DNA, e.g. by *Agrobacterium*-mediated transformation or by baombardment using microparticles coated with recombinant DNA or other means. A plant cell of this invention can be an originally-transformed plant cell that exists as a microorganism or as a progeny plant cell that is regenerated into differentiated tissue, e.g. into a transgenic plant with stably-integrated, non-natural recombinant DNA, or seed or pollen derived from a progeny transgenic plant.

As used herein a "transgenic plant" means a plant whose genome has been altered by the stable integration of recombinant DNA. A transgenic plant includes a plant regenerated from an originally-transformed plant cell and progeny transgenic plants from later generations or crosses of a transformed plant.

As used herein "recombinant DNA" means DNA which has been a genetically engineered and constructed outside of a cell including DNA containing naturally occurring DNA or cDNA or synthetic DNA.

As used herein "consensus sequence" means an artificial sequence of amino acids in a conserved region of an alignment of amino acid sequences of homologous proteins, e.g. as determined by a CLUSTALW alignment of amino acid sequence of homolog proteins.

As used herein a "homolog" means a protein in a group of proteins that perform the same biological function, e.g. proteins that belong to the same Pfam protein family and that provide a common enhanced trait in transgenic plants of this invention. Homologs are expressed by homologous genes. Homologous genes include naturally occurring alleles and artificially-created variants. 14-3-3 proteins belong to a highly conserved protein family, and homolog proteins useful for production of enhanced transgenic plants as described here may be identified by one skilled in the art, for example by alignment with the 14-3-3 protein sequences provided herein or by other sequence comparison methods known in the art, including by Pfam analysis. The "Pfam" database is a large collection of multiple sequence alignments and hidden Markov models covering many common protein families. The Pfam database is currently maintained and updated by the Pfam Consortium. The alignments represent some evolutionarily conserved structure that has implications for the protein's function. Profile hidden Markov models (profile HMMs) built from the protein family alignments are useful for automatically recognizing that a new protein belongs to an existing protein family even if the homology by alignment appears to be low. Thus, homologs of Hap3 transcription factors or 14-3-3 proteins may be identified from other crop plants, for example, or from other organisms, including yeast, fungi, and moss.

Degeneracy of the genetic code provides the possibility to substitute at least one base of the protein encoding sequence of a gene with a different base without causing the amino acid sequence of the polypeptide produced from the gene to be changed. Hence, a polynucleotide useful in the present invention may have any base sequence that has been changed from a HAP3 transcription factor or 14-3-3 protein coding sequence provided herein by substitution in accordance with degeneracy of the genetic code. Homologs are proteins that, when optimally aligned, have at least 60% identity, more preferably about 70% or higher, more preferably at least 80% and even more preferably at least 90% identity over the full length of a protein or domain identified herein as imparting an enhanced trait when expressed in plant cells. Homologs include proteins with an amino acid sequence that has at least 90% identity to a conserved amino acid sequence of proteins and domains disclosed herein.

Homologs are identified by comparison of amino acid sequence, e.g. manually or by use of a computer-based tool using known homology-based search algorithms such as those commonly known and referred to as BLAST, FASTA, and Smith-Waterman. A local sequence alignment program, e.g. BLAST, can be used to search a database of sequences to find similar sequences, and the summary Expectation value (E-value) used to measure the sequence base similarity. As a protein hit with the best E-value for a particular organism may not necessarily be an ortholog or the only ortholog, a reciprocal query is used in the present invention to filter hit sequences with significant E-values for ortholog identification. The reciprocal query entails search of the significant hits against a database of amino acid sequences from the base organism that are similar to the sequence of the query protein.

A hit is a likely ortholog, when the reciprocal query's best hit is the query protein itself or a protein encoded by a duplicated gene after speciation. A further aspect of the invention comprises functional homolog proteins that differ in one or more amino acids from those of disclosed protein as the result of conservative amino acid substitutions, for example substitutions are among: acidic (negatively charged) amino acids such as aspartic acid and glutamic acid; basic (positively charged) amino acids such as arginine, histidine, and lysine; neutral polar amino acids such as glycine, serine, threonine, cysteine, tyrosine, asparagine, and glutamine; neutral nonpolar (hydrophobic) amino acids such as alanine, leucine, isoleucine, valine, proline, phenylalanine, tryptophan, and methionine; amino acids having aliphatic side chains such as glycine, alanine, valine, leucine, and isoleucine; amino acids having aliphatic-hydroxyl side chains such as serine and threonine; amino acids having amide-containing side chains such as asparagine and glutamine; amino acids having aromatic side chains such as phenylalanine, tyrosine, and tryptophan; amino acids having basic side chains such as lysine, arginine, and histidine; amino acids having sulfur-containing side chains such as cysteine and methionine; naturally conservative amino acids such as valine-leucine, valine-isoleucine, phenylalanine-tyrosine, lysine-arginine, alanine-valine, aspartic acid-glutamic acid, and asparagine-glutamine. A further aspect of the homologs encoded by DNA useful in the transgenic plants of the invention are those proteins that differ from a disclosed protein as the result of deletion or insertion of one or more amino acids in a native sequence.

As used herein, "percent identity" means the extent to which two optimally aligned DNA or protein segments are invariant throughout a window of alignment of components, for example nucleotide sequence or amino acid sequence. An "identity fraction" for aligned segments of a test sequence and a reference sequence is the number of identical components that are shared by sequences of the two aligned segments divided by the total number of sequence components in the reference segment over a window of alignment which is the smaller of the full test sequence or the full reference sequence. "Percent identity" ("% identity") is the identity fraction times 100.

As used herein "promoter" means regulatory DNA for initializing transcription. A "plant promoter" is a promoter capable of initiating transcription in plant cells whether or not its origin is a plant cell, e.g. is it well known that *Agrobacterium* promoters are functional in plant cells. Thus, plant promoters include promoter DNA obtained from plants, plant viruses and bacteria such as *Agrobacterium* and *Bradyrhizobium* bacteria. Examples of promoters under developmental control include promoters that preferentially initiate transcription in certain tissues, such as leaves, roots, or seeds. Such promoters are referred to as "tissue preferred". Promoters that initiate transcription only in certain tissues are referred to as "tissue specific". A "cell type" specific promoter primarily drives expression in certain cell types in one or more organs, for example, vascular cells in roots or leaves. An "inducible" or "repressible" promoter is a promoter which is under environmental control. Examples of environmental conditions that may effect transcription by inducible promoters include anaerobic conditions, or certain chemicals, or the presence of light. Tissue specific, tissue preferred, cell type specific, and inducible promoters constitute the class of "non-constitutive" promoters. A "constitutive" promoter is a promoter which is active under most conditions.

As used herein "operably linked" means the association of two or more DNA fragments in a DNA construct so that the function of one, e.g. protein-encoding DNA, is controlled by the other, e.g. a promoter.

As used herein "expressed" means produced, e.g. a protein is expressed in a plant cell when its cognate DNA is transcribed to mRNA that is translated to the protein.

As used herein a "control plant" means a plant that does not contain the recombinant DNA that expressed a protein that impart an enhanced trait. A control plant is to identify and select a transgenic plant that has an enhance trait. A suitable control plant can be a non-transgenic plant of the parental line used to generate a transgenic plant, i.e. devoid of recombinant DNA. A suitable control plant may in some cases be a progeny of a hemizygous transgenic plant line that is does not contain the recombinant DNA, known as a negative segregant.

As used herein an "enhanced trait" means a characteristic of a transgenic plant that includes, but is not limited to, an enhance agronomic trait characterized by enhanced plant morphology, physiology, growth and development, yield, nutritional enhancement, disease or pest resistance, or environmental or chemical tolerance. In more specific aspects of this invention enhanced trait is selected from group of enhanced traits consisting of enhanced water use efficiency, enhanced cold tolerance, increased yield, enhanced nitrogen use efficiency, enhanced seed protein and enhanced seed oil. In an important aspect of the invention the enhanced trait is enhanced yield including increased yield under non-stress conditions and increased yield under environmental stress conditions. Stress conditions may include, for example, drought, shade, fungal disease, viral disease, bacterial disease, insect infestation, nematode infestation, cold temperature exposure, heat exposure, osmotic stress, reduced nitrogen nutrient availability, reduced phosphorus nutrient availability and high plant density. "Yield" can be affected by many properties including without limitation, plant height, pod number, pod position on the plant, number of internodes, incidence of pod shatter, grain size, efficiency of nodulation and nitrogen fixation, efficiency of nutrient assimilation, resistance to biotic and abiotic stress, carbon assimilation, plant architecture, resistance to lodging, percent seed germination, seedling vigor, and juvenile traits. Yield can also be affected by efficiency of germination (including germination in stressed conditions), growth rate (including growth rate in stressed conditions), ear number, seed number per ear, seed size, composition of seed (starch, oil, protein) and characteristics of seed fill.

Increased yield of a transgenic plant of the present invention can be measured in a number of ways, including test weight, seed number per plant, seed weight, seed number per unit area (i.e. seeds, or weight of seeds, per acre), bushels per acre, tonnes per acre, tons per acre, kilo per hectare. For example, maize yield may be measured as production of shelled corn kernels per unit of production area, for example in bushels per acre or metric tons per hectare, often reported on a moisture adjusted basis, for example at 15.5 percent moisture. Increased yield may result from improved utilization of key biochemical compounds, such as nitrogen, phosphorous and carbohydrate, or from improved responses to environmental stresses, such as cold, heat, drought, salt, and attack by pests or pathogens. Recombinant DNA used in this invention can also be used to provide plants having improved growth and development, and ultimately increased yield, as the result of modified expression of plant growth regulators or modification of cell cycle or photosynthesis pathways. Also of interest is the generation of transgenic plants that demonstrate enhanced yield with respect to a seed component that may or may not correspond to an increase in overall plant yield. Such properties include enhancements in seed oil, seed molecules such as tocopherol, protein and starch, or oil particular oil components as may be manifest by an alterations in the ratios of seed components.

A subset of the nucleic molecules of this invention includes fragments of the disclosed recombinant DNA consisting of oligonucleotides of at least 15, preferably at least 16 or 17, more preferably at least 18 or 19, and even more preferably at least 20 or more, consecutive nucleotides. Such oligonucleotides are fragments of the larger molecules having a sequence as provided herein, and find use, for example as probes and primers for detection of the polynucleotides of the present invention.

DNA constructs are assembled using methods well known to persons of ordinary skill in the art and typically comprise a promoter operably linked to DNA, the expression of which provides the enhanced agronomic trait. Other construct components may include additional regulatory elements, such as 5' leasders and introns for enhancing transcription, 3' untranslated regions (such as polyadenylation signals and sites), DNA for transit or signal peptides.

Numerous promoters that are active in plant cells have been described in the literature. These include promoters present in plant genomes as well as promoters from other sources, including nopaline synthase (NOS) promoter and octopine synthase (OCS) promoters carried on tumor-inducing plasmids of *Agrobacterium tumefaciens*, caulimovirus promoters such as the cauliflower mosaic virus. For instance, see U.S. Pat. Nos. 5,858,742 and 5,322,938, which disclose versions of the constitutive promoter derived from cauliflower mosaic virus (CaMV35S), U.S. Pat. No. 5,641,876, which discloses a rice actin promoter, U.S. Patent Application Publication 2002/0192813A1, which discloses 5', 3' and intron elements useful in the design of effective plant expression vectors, U.S. patent application Ser. No. 09/757,089, which discloses a maize chloroplast aldolase promoter, U.S. patent application Ser. No. 08/706,946, which discloses a rice glutelin promoter, U.S. patent application Ser. No. 09/757,089, which discloses a maize aldolase (FDA) promoter, and U.S. Patent Application Publication No. 20030131377A1, which discloses a maize nicotianamine synthase promoter, all of which are incorporated herein by reference. These and numerous other promoters that function in plant cells are known to those skilled in the art and available for use in recombinant polynucleotides of the present invention to provide for expression of desired genes in transgenic plant cells.

In other aspects of the invention, preferential expression in plant green tissues is desired. Promoters of interest for such uses include those from genes such as *Arabidopsis thaliana* ribulose-1,5-bisphosphate carboxylase (Rubisco) small subunit (Fischhoff et al. (1992) *Plant Mol. Biol.* 20:81-93), aldolase and pyruvate orthophosphate dikinase (PPDK) (Taniguchi et al. (2000) *Plant Cell Physiol.* 41(1):42-48).

Furthermore, the promoters may be altered to contain multiple "enhancer sequences" to assist in elevating gene expression. Such enhancers are known in the art. By including an enhancer sequence with such constructs, the expression of the selected protein may be enhanced. These enhancers often are found 5' to the start of transcription in a promoter that functions in eukaryotic cells, but can often be inserted upstream (5') or downstream (3') to the coding sequence. In some instances, these 5' enhancing elements are introns. Particularly useful as enhancers are the 5' introns of the rice actin 1 (see U.S. Pat. No. 5,641,876) and rice actin 2 genes, the maize alcohol dehydrogenase gene intron, the maize heat shock protein 70 gene intron (U.S. Pat. No. 5,593,874) and the maize shrunken 1 gene.

In other aspects of the invention, sufficient expression in plant seed tissues is desired to affect improvements in seed composition. Exemplary promoters for use for seed composition modification include promoters from seed genes such as napin (U.S. Pat. No. 5,420,034), maize L3 oleosin (U.S. Pat. No. 6,433,252), zein Z27 (Russell et al. (1997) *Transgenic Res.* 6(2):157-166), globulin 1 (Belanger et al (1991) *Genetics* 129:863-872), glutelin 1 (Russell (1997) supra), and peroxiredoxin antioxidant (Per1) (Stacy et al. (1996) *Plant Mol. Biol.* 31(6):1205-1216).

Recombinant DNA constructs prepared in accordance with the invention will also generally include a 3' element that typically contains a polyadenylation signal and site. Well-known 3' elements include those from *Agrobacterium tumefaciens* genes such as nos 3', tml 3', tmr 3', tms 3', ocs 3', tr7 3', for example disclosed in U.S. Pat. No. 6,090,627, incorporated herein by reference; 3' elements from plant genes such as wheat (*Triticum aesevitum*) heat shock protein 17 (Hsp17 3'), a wheat ubiquitin gene, a wheat fructose-1,6-biphosphatase gene, a rice glutelin gene, a rice lactate dehydrogenase gene and a rice beta-tubulin gene, are disclosed in U.S. published patent application 2002/0192813 A1, incorporated herein by reference; the 3' element from pea (*Pisum sativum*) ribulose biphosphate carboxylase gene (rbs 3'), and 3' elements from the genes within the host plant.

Constructs and vectors may also include a transit peptide for targeting of a gene to a plant organelle, particularly to a chloroplast, leucoplast or other plastid organelle. For descriptions of the use of chloroplast transit peptides see U.S. Pat. No. 5,188,642 and U.S. Pat. No. 5,728,925, incorporated herein by reference. For description of the transit peptide region of an *Arabidopsis* EPSPS gene useful in the present invention, see Klee, H. J. et al (MGG (1987) 210:437-442).

Transgenic plants comprising or derived from plant cells of this invention transformed with recombinant DNA can be further enhanced with stacked traits, e.g. a crop plant having an enhanced trait resulting from expression of DNA disclosed herein in combination with herbicide and/or pest resistance traits. For example, genes of the current invention can be stacked with other traits of agronomic interest, such as a trait providing herbicide resistance, or insect resistance, such as using a gene from *Bacillus thuringensis* to provide resistance against lepidopteran, coliopteran, homopteran, hemiopteran, and other insects. Herbicides for which transgenic plant tolerance has been demonstrated and the method of the present invention can be applied include, but are not limited to, glyphosate, dicamba, glufosinate, sulfonylurea, bromoxynil and norflurazon herbicides. Polynucleotide molecules encoding proteins involved in herbicide tolerance are well-known in the art and include, but are not limited to, a polynucleotide molecule encoding 5-enolpyruvylshikimate-3-phosphate synthase (EPSPS) disclosed in U.S. Pat. Nos. 5,094,945; 5,627,061; 5,633,435 and 6,040,497 for imparting glyphosate tolerance; polynucleotide molecules encoding a glyphosate oxidoreductase (GOX) disclosed in U.S. Pat. No. 5,463,175 and a glyphosate-N-acetyl transferase (GAT) disclosed in U.S. Patent Application publication 2003/0083480 A1 also for imparting glyphosate tolerance; dicamba monooxygenase disclosed in U.S. Patent Application publication 2003/0135879 A1 for imparting dicamba tolerance; a polynucleotide molecule encoding bromoxynil nitrilase (Bxn) disclosed in U.S. Pat. No. 4,810,648 for imparting bromoxynil tolerance; a polynucleotide molecule encoding phytoene desaturase (crtI) described in Misawa et al, (1993) *Plant J.*

4:833-840 and in Misawa et al, (1994) *Plant J.* 6:481-489 for norflurazon tolerance; a polynucleotide molecule encoding acetohydroxyacid synthase (AHAS, aka ALS) described in Sathasiivan et al. (1990) *Nucl. Acids Res.* 18:2188-2193 for imparting tolerance to sulfonylurea herbicides; polynucleotide molecules known as bar genes disclosed in DeBlock, et al. (1987) *EMBO J.* 6:2513-2519 for imparting glufosinate and bialaphos tolerance; polynucleotide molecules disclosed in U.S. Patent Application Publication 2003/010609 A1 for imparting N-amino methyl phosphonic acid tolerance; polynucleotide molecules disclosed in U.S. Pat. No. 6,107,549 for impartinig pyridine herbicide resistance; molecules and methods for imparting tolerance to multiple herbicides such as glyphosate, atrazine, ALS inhibitors, isoxoflutole and glufosinate herbicides are disclosed in U.S. Pat. No. 6,376,754 and U.S. Patent Application Publication 2002/0112260, all of said U.S. Patents and Patent Application Publications are incorporated herein by reference. Molecules and methods for imparting insect/nematode/virus resistance are disclosed in U.S. Pat. Nos. 5,250,515; 5,880,275; 6,506,599; 5,986,175 and U.S. Patent Application Publication 2003/0150017 A1, all of which are incorporated herein by reference.

Plant Cell Transformation Methods

Numerous methods for transforming plant cells with recombinant DNA are known in the art and may be used in the present invention. Two commonly used methods for plant transformation are *Agrobacterium*-mediated transformation and microprojectile bombardment. Microprojectile bombardment methods are illustrated in U.S. Pat. No. 5,015,580 (soybean); U.S. Pat. No. 5,550,318 (corn); U.S. Pat. No. 5,538,880 (corn); U.S. Pat. No. 5,914,451 (soybean); U.S. Pat. No. 6,160,208 (corn); U.S. Pat. No. 6,399,861 (corn); U.S. Pat. No. 6,153,812 (wheat) and U.S. Pat. No. 6,365,807 (rice) and *Agrobacterium*-mediated transformation is described in U.S. Pat. No. 5,159,135 (cotton); U.S. Pat. No. 5,824,877 (soybean); U.S. Pat. No. 5,463,174 (canola); U.S. Pat. No. 5,591,616 (corn); U.S. Pat. No. 6,384,301 (soybean), U.S. Pat. No. 7,026,528 (wheat) and U.S. Pat. No. 6,329,571 (rice), all of which are incorporated herein by reference. For *Agrobacterium tumefaciens* based plant transformation systems, additional elements present on transformation constructs will include T-DNA left and right border sequences to facilitate incorporation of the recombinant polynucleotide into the plant genome.

In general it is useful to introduce recombinant DNA randomly, i.e. at a non-specific location, in the genome of a target plant line. In special cases it may be useful to target recombinant DNA insertion in order to achieve site-specific integration, for example, to replace an existing gene in the genome, to use an existing promoter in the plant genome, or to insert a recombinant polynucleotide at a predetermined site known to be active for gene expression. Several site specific recombination systems exist which are known to function in plants including cre-lox as disclosed in U.S. Pat. No. 4,959,317 and FLP-FRT as disclosed in U.S. Pat. No. 5,527,695, both incorporated herein by reference.

Transformation methods of this invention are preferably practiced in tissue culture on media and in a controlled environment. "Media" refers to the numerous nutrient mixtures that are used to grow cells in vitro, that is, outside of the intact living organism. Recipient cell targets include, but are not limited to, meristem cells, hypocotyls, calli, immature embryos and gametic cells such as microspores, pollen, sperm and egg cells. It is contemplated that any cell from which a fertile plant may be regenerated is useful as a recipient cell. Callus may be initiated from tissue sources including, but not limited to, immature embryos, hypocotyls, seedling apical meristems, microspores and the like. Cells capable of proliferating as callus are also recipient cells for genetic transformation. Practical transformation methods and materials for making transgenic plants of this invention, for example various media and recipient target cells, transformation of immature embryo cells and subsequent regeneration of fertile transgenic plants are disclosed in U.S. Pat. Nos. 6,194,636 and 6,232,526, which are incorporated herein by reference.

The seeds of transgenic plants can be harvested from fertile transgenic plants and be used to grow progeny generations of transformed plants of this invention including hybrid plants line for selection of plants having an enhanced trait. In addition to direct transformation of a plant with a recombinant DNA, transgenic plants can be prepared by crossing a first plant having a recombinant DNA with a second plant lacking the DNA. For example, recombinant DNA can be introduced into a first plant line that is amenable to transformation to produce a transgenic plant which can be crossed with a second plant line to introgress the recombinant DNA into the second plant line. A transgenic plant with recombinant DNA providing an enhanced trait, e.g. enhanced yield, can be crossed with transgenic plant line having other recombinant DNA that confers another trait, for example herbicide resistance or pest resistance, to produce progeny plants having recombinant DNA that confers both traits. Typically, in such breeding for combining traits the transgenic plant donating the additional trait is a male line and the transgenic plant carrying the base traits is the female line. The progeny of this cross will segregate such that some of the plants will carry the DNA for both parental traits and some will carry DNA for one parental trait; such plants can be identified by markers associated with parental recombinant DNA, e.g. marker identification by analysis for recombinant DNA or, in the case where a selectable marker is linked to the recombinant, by application of the selecting agent such as a herbicide for use with a herbicide tolerance marker, or by selection for the enhanced trait. Progeny plants carrying DNA for both parental traits can be crossed back into the female parent line multiple times, for example usually 6 to 8 generations, to produce a progeny plant with substantially the same genotype as one original transgenic parental line but for the recombinant DNA of the other transgenic parental line.

In the practice of transformation DNA is typically introduced into only a small percentage of target plant cells in any one transformation experiment. Marker genes are used to provide an efficient system for identification of those cells that are stably transformed by receiving and integrating a recombinant DNA molecule into their genomes. Preferred marker genes provide selective markers which confer resistance to a selective agent, such as an antibiotic or a herbicide. Any of the herbicides to which plants of this invention may be resistant are useful agents for selective markers. Potentially transformed cells are exposed to the selective agent. In the population of surviving cells will be those cells where, generally, the resistance-conferring gene is integrated and expressed at sufficient levels to permit cell survival. Cells may be tested further to confirm stable integration of the exogenous DNA. Commonly used selective marker genes include those conferring resistance to antibiotics such as kanamycin and paromomycin (nptII), hygromycin B (aph IV), spectinomycin (aadA) and gentamycin (aac3 and aacC4) or resistance to herbicides such as glufosinate (bar or pat), dicamba (DMO) and glyphosate (aroA or EPSPS). Examples of such selectable markers are illustrated in U.S. Pat. Nos. 5,550,318; 5,633,435; 5,780,708 and 6,118,047, all of which are incorporated herein by reference. Selectable markers which provide an ability to visually identify transformants can also be employed, for example, a gene expressing a colored or fluorescent protein such as a luciferase or green fluorescent protein (GFP) or a gene expressing a beta-glucuronidase or uidA gene (GUS) for which various chromogenic substrates are known.

Plant cells that survive exposure to the selective agent, or plant cells that have been scored positive in a screening assay, may be cultured in regeneration media and allowed to mature into plants. Developing plantlets regenerated from transformed plant cells can be transferred to plant growth mix, and hardened off, for example, in an environmentally controlled chamber at about 85% relative humidity, 600 ppm $CO_2$, and 25-250 microeinsteins $m^{-2} s^{-1}$ of light, prior to transfer to a greenhouse or growth chamber for maturation. Plants are regenerated from about 6 weeks to 10 months after a transformant is identified, depending on the initial tissue, and the plant species. Plants may be pollinated using conventional plant breeding methods known to those of skill in the art and seed produced, for example self-pollination is commonly used with transgenic corn. The regenerated transformed plant or its progeny seed or plants can be tested for expression of the recombinant DNA and selected for the presence of enhanced agronomic trait.

water use efficiency, enhanced cold tolerance, increased yield, enhanced nitrogen use efficiency, enhanced seed protein and enhanced seed oil.

Table 1 provides a list of nucleic acid and corresponding protein sequences that are useful for production of transgenic plants with enhanced agronomic traits.

Column headings in Table 1 refer to the following information:

"NUC SEQ ID NO" refers to a particular nucleic acid sequence in the Sequence Listing which defines a polynucleotide used in a recombinant polynucleotide of this invention.

"PHE ID" refers to an arbitrary number used to identify a particular recombinant polynucleotide corresponding to the translated protein encoded by the polynucleotide.

"PEP SEQ ID NO" refers to a particular amino acid sequence in the Sequence Listing "CODING SEQUENCE" refers to peptide coding segments of the polynucleotide.

"GENE NAME" refers to a common name for the recombinant polynucleotide.

"SPECIES" refers to the organism from which the polynucleotide DNA was derived.

TABLE 1

| SEQ ID NO: | PHE ID | PEP ID NO: | Coding Sequence | Gene Name | Species |
|---|---|---|---|---|---|
| 281 | PHE0000152 | 1263 | 85-861 | 14-3-3-like protein 2 | *Glycine max* |
| 282 | PHE0000153 | 1264 | 42-824 | 14-3-3-like protein D | *Glycine max* |
| 283 | PHE0000154 | 1265 | 49-834 | 14-3-3 protein 1 | *Glycine max* |
| 287 | PHE0000158 | 1269 | 79-882 | BMH1 | *Saccharomyces cerevisiae* |
| 288 | PHE0000311 | 1270 | 81-848 | GF14-c protein | *Oryza sativa* |
| 289 | PHE0000312 | 1271 | 6-785 | 14-3-3-like protein | *Oryza sativa* |
| 616 | PHE0000854 | 1596 | 32-802 | soy 14-3-3 22 | *Glycine max* |
| 619 | PHE0000857 | 1599 | 116-874 | *sorghum* 14-3-3 10 | *Sorghum bicolor* |
| 621 | PHE0000859 | 1601 | 70-855 | rice 14-3-3 15 | *Oryza sativa* |
| 623 | PHE0000861 | 1603 | 62-808 | corn 14-3-3 13 | *Zea mays* |
| 626 | PHE0000864 | 1606 | 105-875 | rice 14-3-3 10 | *Oryza sativa* |
| 628 | PHE0000866 | 1608 | 84-860 | soy 14-3-3 21 | *Glycine max* |
| 630 | PHE0000868 | 1610 | 64-840 | wheat 14-3-3 10 | *Triticum aestivum* |
| 632 | PHE0000870 | 1612 | 132-929 | corn 14-3-3 17 | *Zea mays* |
| 783 | PHE0000002 | 1763 | 103-525 | G481 - Mendel | *Arabidopsis thaliana* |
| 784 | PHE0000003 | 1764 | 149-817 | PhenEx 67621 - corn G481-like1 | *Zea mays* |
| 785 | PHE0000004 | 1765 | 196-750 | PhenEx 67622 - corn G481-like2 | *Zea mays* |
| 786 | PHE0000005 | 1766 | 91-588 | PhenEx 67623 - corn G481-like3 | *Zea mays* |

Transgenic Plants and Seeds

Transgenic plants derived from the plant cells of this invention are grown to generate transgenic plants having an enhanced trait as compared to a control plant and produce transgenic seed and haploid pollen of this invention. Such plants with enhanced traits are identified by selection of transformed plants or progeny seed for the enhanced trait. For efficiency a selection method is designed to evaluate multiple transgenic plants (events) comprising the recombinant DNA, for example multiple plants from 2 to 20 or more transgenic events. Transgenic plants grown from transgenic seed provided herein demonstrate improved agronomic traits that contribute to increased yield or other trait that provides increased plant value, including, for example, improved seed quality. Of particular interest are plants having enhanced Selection Methods for Transgenic Plants with Enhanced Agronomic Trait Within a population of transgenic plants regenerated from plant cells transformed with the recombinant DNA many plants that survive to fertile transgenic plants that produce seeds and progeny plants will not exhibit an enhanced agronomic trait. Selection from the population is necessary to identify one or more transgenic plant cells that can provide plants with the enhanced trait. Transgenic plants having enhanced traits are selected from populations of plants regenerated or derived from plant cells transformed as described herein by evaluating the plants in a variety of assays to detect an enhanced trait, e.g. enhanced water use efficiency, enhanced cold tolerance, increased yield, enhanced nitrogen use efficiency, enhanced seed protein and enhanced seed oil.

These assays also may take many forms including, but not limited to, direct screening for the trait in a greenhouse or field trial or by screening for a surrogate trait. Such analyses can be directed to detecting changes in the chemical composition, biomass, physiological properties, morphology of the plant. Changes in chemical compositions such as nutritional composition of grain can be detected by analysis of the seed composition and content of protein, free amino acids, oil, free fatty acids, starch or tocopherols. Changes in biomass characteristics can be made on greenhouse or field grown plants and can include plant height, stem diameter, root and shoot dry weight; and, for corn plants, ear length and diameter. Changes in physiological properties can be identified by evaluating responses to stress conditions, for example assays using imposed stress conditions such as water deficit, nitrogen deficiency, cold growing conditions, pathogen or insect attack or light deficiency, or increased plant density. Changes in morphology can be measured by visual observation of tendency of a transformed plant with an enhanced agronomic trait to also appear to be a normal plant as compared to changes toward bushy, taller, thicker, narrower leaves, striped leaves, knotted trait, chlorosis, albino, anthocyanin production, or altered tassels, ears or roots. Other selection properties include days to pollen shed, days to silking, leaf extension rate, chlorophyll content, leaf temperature, stand, seedling vigor, internode length, plant height, leaf number, leaf area, tillering, brace roots, stay green, stalk lodging, root lodging, plant health, barreness/prolificacy, green snap, and pest resistance. In addition, phenotypic characteristics of harvested grain may be evaluated, including number of kernels per row on the ear, number of rows of kernels on the ear, kernel abortion, kernel weight, kernel size, kernel density and physical grain quality. Although the plant cells and methods of this invention can be applied to any plant cell, plant, seed or pollen, e.g. any fruit, vegetable, grass, tree or ornamental plant, the various aspects of the invention are preferably applied to corn, soybean, cotton, canola, alfalfa, sugarcane, sugar beet, wheat and rice plants.

The following examples are included to demonstrate aspects of the invention, those of skill in the art should, in light of the present disclosure, appreciate that many changes can be made in the specific aspects which are disclosed and still obtain a like or similar results without departing from the spirit and scope of the invention.

Example 1

Plant Expression Constructs

This example illustrates the construction of plasmid vectors for transferring recombinant DNA into plant cells which can be regenerated into transgenic plants of this invention A GATEWAY™ Destination (Invitrogen Life Technologies, Carlsbad, Calif.) plant expression vector, pMON65154, is constructed for use in preparation of constructs comprising recombinant polynucleotides for corn transformation. The elements of the expression vector are summarized in Table 2 below. Generally, pMON65154 comprises a selectable marker expression cassette comprising a Cauliflower Mosaic Virus 35S promoter operably linked to a gene encoding neomycin phosphotransferase II (nptII). The 3' region of the selectable marker expression cassette comprises the 3' region of the *Agrobacterium tumefaciens* nopaline synthase gene (nos) followed 3' by the 3' region of the potato proteinase inhibitor II (pinII) gene. The plasmid pMON 65154 further comprises a plant expression cassette into which a gene of interest may be inserted using GATEWAY™ cloning methods. The GATEWAY™ cloning cassette is flanked 5' by a rice actin 1 promoter, exon and intron and flanked 3' by the 3' region of the potato pinII gene. Using GATEWAY™ methods, the cloning cassette may be replaced with a gene of interest. The vector pMON65154, and derivatives thereof comprising a gene of interest, are particularly useful in methods of plant transformation via direct DNA delivery, such as microprojectile bombardment.

TABLE 2

Elements of Plasmid pMON65154

| FUNCTION | ELEMENT | REFERENCE |
|---|---|---|
| Plant gene of interest expression cassette | Rice actin 1 promoter | U.S. Pat. No. 5,641,876 |
| | Rice actin 1 exon 1, intron 1 enhancer | U.S. Pat. No. 5,641,876 |
| Gene of interest insertion site | AttR1 | GATEWAY ™ Cloning Technology Instruction Manual |
| | CmR gene | GATEWAY ™ Cloning Technology Instruction Manual |
| | ccdA, ccdB genes | GATEWAY ™ Cloning Technology Instruction Manual |
| | attR2 | GATEWAY ™ Cloning Technology Instruction Manual |
| Plant gene of interest expression cassette | Potato pinII 3' region | An et al. (1989) Plant Cell 1: 115-122 |
| Plant selectable marker expression cassette | CaMV 35S promoter | U.S. Pat. No. 5,858,742 |
| | nptII selectable marker | U.S. Pat. No. 5,858,742 |
| | nos 3' region | U.S. Pat. No. 5,858,742 |
| | PinII 3' region | An et al. (1989) Plant Cell 1: 115-122 |
| Maintenance in *E. coli* | ColE1 origin of replication | |
| | F1 origin of replication Bla ampicillin resistance | |

A similar plasmid vector, pMON72472, is constructed for use in *Agrobacterium* mediated methods of plant transformation. pMON72472 comprises the gene of interest plant expression cassette, GATEWAY™ cloning, and plant selectable marker expression cassettes present in pMON65154. In addition, left and right T-DNA border sequences from *Agrobacterium* are added to the plasmid (Zambryski et al. (1982) Mol Appl Genet, 1(4):361-70). The right border sequence is located 5' to the rice actin 1 promoter and the left border sequence is located 3' to the pinII 3' sequence situated 3' to the nptII gene. Furthermore, pMON72472 comprises a plasmid backbone to facilitate replication of the plasmid in both *E. coli* and *Agrobacterium tumefaciens*. The backbone has an oriV wide host range origin of DNA replication functional in *Agrobacterium*, a pBR322 origin of replication functional in *E. coli*, and a spectinomycin/streptomycin resistance gene for selection in both *E. coli* and *Agrobacterium*.

Vectors similar to those described above may be constructed for use in *Agrobacterium* or microprojectile bombardment maize transformation systems where the rice actin 1 promoter in the plant expression cassette portion is replaced with other desirable promoters including, but not limited to a corn globulin 1 promoter, a maize oleosin promoter, a glutelin 1 promoter, an RTBV promoter (U.S. Pat. No. 5,824,857), an aldolase promoter, a zein Z27 promoter, a pyruvate orthophosphate dikinase (PPDK) promoter, a a soybean 7S alpha promoter, a peroxiredoxin antioxidant (Per1) promoter and a CaMV 35S promoter. Protein coding segments are amplified by PCR prior to insertion into vectors such as described above. Primers for PCR amplification can be designed at or near the start and stop codons of the coding sequence, in order to eliminate most of the 5' and 3' untranslated regions. For GATEWAY cloning methods, PCR products are tailed with attB1 and attB2 sequences, purified then recombined into a destination vectors to produce an expression vector for use in transformation.

A. Plant Expression Constructs for Corn Transformation

A base corn transformation vector pMON93039, illustrated in Table 3 and FIG. 1, was fabricated for use in preparing recombinant DNA for *Agrobacterium*-mediated transformation into corn tissue.

TABLE 3

Elements of Plasmid pMON93039

| Function | Name | Annotation |
|---|---|---|
| *Agrobacterium* T-DNA transfer | B-AGRtu.right border | Agro right border sequence, essential for transfer of T-DNA. |
| Gene of interest expression cassette | E-Os.Act1 | Upstream promoter region of the rice actin 1 gene |
| | E-CaMV.35S.2xA1-B3 | Duplicated35S A1-B3 domain without TATA box |
| | P-Os.Act1 | Promoter region of the rice actin 1 gene |
| | L-Ta.Lhcb1 | 5' untranslated leader of wheat major chlorophyll a/b binding protein |
| | I-Os.Act1 | First intron and flanking UTR exon sequences from the rice actin 1 gene |
| | T-St.Pis4 | 3' non-translated region of the potato proteinase inhibitor II gene which functions to direct polyadenylation of the mRNA |
| Plant selectable marker expression cassette | P-Os.Act1 | Promoter from the rice actin 1 gene |
| | L-Os.Act1 | First exon of the rice actin 1 gene |
| | I-Os.Act1 | First intron and flanking UTR exon sequences from the rice actin 1 gene |
| | TS-At.ShkG-CTP2 | Transit peptide region of *Arabidopsis* EPSPS |
| | CR-AGRtu.aroA-CP4.nat | Coding region for bacterial strain CP4 native aroA gene. |
| | T-AGRtu.nos | A 3' non-translated region of the nopaline synthase gene of *Agrobacterium tumefaciens* Ti plasmid which functions to direct polyadenylation of the mRNA. |
| *Agrobacterium* T-DNA transfer | B-AGRtu.left border | Agro left border sequence, essential for transfer of T-DNA. |
| Maintenance in *E. coli* | OR-Ec.oriV-RK2 | The vegetative origin of replication from plasmid RK2. |
| | CR-Ec.rop | Coding region for repressor of primer from the ColE1 plasmid. Expression of this gene product interferes with primer binding at the origin of replication, keeping plasmid copy number low. |
| | OR-Ec.ori-ColE1 | The minimal origin of replication from the *E. coli* plasmid ColE1. |
| | P-Ec.aadA-SPC/STR | Promoter for Tn7 adenylyltransferase (AAD(3")) |
| | CR-Ec.aadA-SPC/STR | Coding region for Tn7 adenylyltransferase (AAD(3")) conferring spectinomycin and streptomycin resistance. |
| | T-Ec.aadA-SPC/STR | 3' UTR from the Tn7 adenylyltransferase (AAD(3")) gene of *E. coli*. |

B. Plant Expression Constructs for Soy and Canola Transformation

Vectors for use in transformation of soybean and canola were also prepared. Elements of an exemplary common expression vector pMON82053 are shown in Table 4 below and FIG. 2.

TABLE 4

Elements of Plasmid pMON82053

| Function | Name | Annotation |
|---|---|---|
| *Agrobacterium* T-DNA transfer | B-AGRtu.left border | Agro left border sequence, essential for transfer of T-DNA. |
| Plant selectable marker expression cassette | P-At.Act7 | Promoter from the *Arabidopsis* actin 7 gene |
| | L-At.Act7 | 5'UTR of *Arabidopsis* Act7 gene |
| | I-At.Act7 | Intron from the *Arabidopsis* actin7 gene |
| | TS-At.ShkG-CTP2 | Transit peptide region of *Arabidopsis* EPSPS |
| | CR-AGRtu.aroA- | Synthetic CP4 coding region with dicot preferred codon |

TABLE 4-continued

Elements of Plasmid pMON82053

| Function | Name | Annotation |
|---|---|---|
| | CP4.nno_At | usage. |
| | T-AGRtu.nos | A 3' non-translated region of the nopaline synthase gene of *Agrobacterium tumefaciens* Ti plasmid which functions to direct polyadenylation of the mRNA. |
| Gene of interest expression cassette | P-CaMV.35S-enh | Promoter for 35S RNA from CaMV containing a duplication of the −90 to −350 region. |
| | T-Gb.E6-3b | 3' untranslated region from the fiber protein E6 gene of sea-island cotton. |
| *Agrobacterium* T-DNA transfer | B-AGRtu.right border | Agro right border sequence, essential for transfer of T-DNA. |
| Maintenance in *E. coli* | OR-Ec.oriV-RK2 | The vegetative origin of replication from plasmid RK2. |
| | CR-Ec.rop | Coding region for repressor of primer from the ColE1 plasmid. Expression of this gene product interferes with primer binding at the origin of replication, keeping plasmid copy number low. |
| | OR-Ec.ori-ColE1 | The minimal origin of replication from the *E. coli* plasmid ColE1. |
| | P-Ec.aadA-SPC/STR | Promoter for Tn7 adenylyltransferase (AAD(3")) |
| | CR-Ec.aadA-SPC/STR | Coding region for Tn7 adenylyltransferase (AAD(3")) conferring spectinomycin and streptomycin resistance. |
| | T-Ec.aadA-SPC/STR | 3' UTR from the Tn7 adenylyltransferase (AAD(3")) gene of *E. coli*. |

Primers for PCR amplification of protein coding nucleotides of recombinant DNA are designed at or near the start and stop codons of the coding sequence, in order to eliminate most of the 5' and 3' untranslated regions. Each recombinant DNA coding for a protein identified in Table 1 is amplified by PCR prior to insertion into the insertion site within the gene of interest expression cassette of one of the base vectors.

Vectors similar to that described above may be constructed for use in *Agrobacterium* mediated soybean transformation systems where the enhanced 35S promoter in the plant expression cassette portion is replaced with other desirable promoters including, but not limited to a napin promoter and an *Arabidopsis* SSU promoter. Protein coding segments are amplified by PCR prior to insertion into vectors such as described above. Primers for PCR amplification can be designed at or near the start and stop codons of the coding sequence, in order to eliminate most of the 5' and 3' untranslated regions.

C. Cotton Transformation Vector

Plasmids for use in transformation of cotton were also prepared. Elements of an exemplary common expression vector pMON99053 are shown in Table 5 below and FIG. 3. Primers for PCR amplification of protein coding nucleotides of recombinant DNA are designed at or near the start and stop codons of the coding sequence, in order to eliminate most of the 5' and 3' untranslated regions. Each recombinant DNA coding for a protein identified in Table 1 is amplified by PCR prior to insertion into the insertion site within the gene of interest expression cassette of one of the base vectors.

TABLE 5

Elements of Plasmid pMON99053

| Function | Name | Annotation |
|---|---|---|
| *Agrobacterium* T-DNA transfer | B-AGRtu.right border | Agro right border sequence, essential for transfer of T-DNA. |
| Gene of interest expression cassette | Exp-CaMV.35S-enh + Ph.DnaK | Enhanced version of the 35S RNA promoter from CaMV plus the *petunia* hsp70 5' untranslated region |
| | T-Ps.RbcS2-E9 | The 3' non-translated region of the pea RbcS2 gene which functions to direct polyadenylation of the mRNA. |
| Plant selectable marker expression cassette | Exp-CaMV.35S | Promoter and 5' untranslated region from the 35S RNA of CaMV |
| | CR-Ec.nptII-Tn5 | Coding region for neomycin phosphotransferase gene from transposon Tn5 which confers resistance to neomycin and kanamycin. |
| | T-AGRtu.nos | A 3' non-translated region of the nopaline synthase gene of *Agrobacterium tumefaciens* Ti plasmid which functions to direct polyadenylation of the mRNA. |
| *Agrobacterium* T-DNA transfer | B-AGRtu.left border | Agro left border sequence, essential for transfer of T-DNA. |
| Maintenance in *E. coli* | OR-Ec.oriV-RK2 | The vegetative origin of replication from plasmid RK2. |
| | CR-Ec.rop | Coding region for repressor of primer from the ColE1 plasmid. Expression of this gene product interferes with primer binding at the origin of replication, keeping plasmid copy number low. |
| | OR-Ec.ori-ColE1 | The minimal origin of replication from the *E. coli* plasmid ColE1. |

TABLE 5-continued

Elements of Plasmid pMON99053

| Function | Name | Annotation |
|---|---|---|
| | P-Ec.aadA-SPC/STR | Promoter for Tn7 adenylyltransferase (AAD(3")) |
| | CR-Ec.aadA-SPC/STR | Coding region for Tn7 adenylyltransferase (AAD(3")) conferring spectinomycin and streptomycin resistance. |
| | T-Ec.aadA-SPC/STR | 3' UTR from the Tn7 adenylyltransferase (AAD(3")) gene of E. coli. |

An alternative plant selectable marker expression cassette that finds use in generation and selection of transgenic cotton plants comprises a chimeric FMV-EF1alpha promoter, such as described in WO01/44457, regulating expression of a CP4 gene that confers tolerance to glyphosate herbicide.

Example 2

Corn Transformation

This example illustrates plant cell transformation methods useful in producing transgenic corn plant cells, plants, seeds and pollen of this invention and the production and identification of transgenic corn plants and seed with an enhanced trait, i.e. enhanced water use efficiency, enhanced cold tolerance, increased yield, enhanced nitrogen use efficiency, enhanced seed protein and enhanced seed oil. Plasmid vectors were prepared by cloning DNA identified in Table 1 in the identified base vectors for use in corn transformation of corn plant cells to produce transgenic corn plants and progeny plants, seed and pollen.

For *Agrobacterium*-mediated transformation of corn embryo cells corn plants of a readily transformable line (designated LH59) are grown in the greenhouse and ears are harvested when the embryos are 1.5 to 2.0 mm in length. Ears are surface sterilized by spraying or soaking the ears in 80% ethanol, followed by air drying. Immature embryos are isolated from individual kernels on surface sterilized ears. Prior to inoculation of maize cells, *Agrobacterium* cells are grown overnight at room temperature. Immature maize embryo cells are inoculated with *Agrobacterium* shortly after excision, and incubated at room temperature with *Agrobacterium* for 5-20 minutes. Immature embryo plant cells are then co-cultured with *Agrobacterium* for 1 to 3 days at 23° C. in the dark. Co-cultured embryos are transferred to selection media and cultured for approximately two weeks to allow embryogenic callus to develop. Embryogenic callus is transferred to culture medium containing 100 mg/L paromomycin and subcultured at about two week intervals. Transformed plant cells are recovered 6 to 8 weeks after initiation of selection.

For *Agrobacterium*-mediated transformation of maize callus immature embryos are cultured for approximately 8-21 days after excision to allow callus to develop. Callus is then incubated for about 30 minutes at room temperature with the *Agrobacterium* suspension, followed by removal of the liquid by aspiration. The callus and *Agrobacterium* are co-cultured without selection for 3-6 days followed by selection on paromomycin for approximately 6 weeks, with biweekly transfers to fresh media. Paromomycin resistant calli are identified about 6-8 weeks after initiation of selection.

For transformation by microprojectile bombardment maize immature embryos are isolated and cultured 3-4 days prior to bombardment. Prior to microprojectile bombardment, a suspension of gold particles is prepared onto which the desired recombinant DNA expression cassettes are precipitated. DNA is introduced into maize cells as described in U.S. Pat. Nos. 5,550,318 and 6,399,861 using the electric discharge particle acceleration gene delivery device. Following microprojectile bombardment, tissue is cultured in the dark at 27° C. Additional transformation methods and materials for making transgenic plants of this invention, for example, various media and recipient target cells, transformation of immature embryos and subsequence regeneration of fertile transgenic plants are disclosed in U.S. Pat. Nos. 6,194,636 and 6,232,526 and U.S. patent application Ser. No. 09/757,089, which are incorporated herein by reference.

To regenerate transgenic corn plants a callus of transgenic plant cells resulting from transformation and selection is placed on media to initiate shoot development into plantlets which are transferred to potting soil for initial growth in a growth chamber at 26° C. followed by a mist bench before transplanting to 5 inch pots where plants are grown to maturity. The regenerated plants are self-fertilized and seed is harvested for use in one or more methods to select seeds, seedlings or progeny second generation transgenic plants (R2 plants) or hybrids, e.g. by selecting transgenic plants exhibiting an enhanced trait as compared to a control plant.

Transgenic corn plant cells are transformed with recombinant DNA from each of the genes identified in Table 1. Progeny transgenic plants and seed of the transformed plant cells are screened for enhanced water use efficiency, enhanced cold tolerance, increased yield, enhanced nitrogen use efficiency, enhanced seed protein and enhanced seed oil as reported in Example 6.

Example 3

Soybean Transformation

This example illustrates plant transformation useful in producing the transgenic soybean plants of this invention and the production and identification of transgenic seed for transgenic soybean having enhanced water use efficiency, enhanced cold tolerance, increased yield, enhanced nitrogen use efficiency, enhanced seed protein and enhanced seed oil.

For *Agrobacterium* mediated transformation, soybean seeds are imbided overnight and the meristem explants excised. The explants are placed in a wounding vessel. Soybean explants and induced *Agrobacterium* cells from a strain containing plasmid DNA with the gene of interest cassette and a plant selectable marker cassette are mixed no later than 14 hours from the time of initiation of seed imbibition, and wounded using sonication. Following wounding, explants are placed in co-culture for 2-5 days at which point they are transferred to selection media for 6-8 weeks to allow selection and growth of transgenic shoots. Resistant shoots are harvested approximately 6-8 weeks and placed into selective rooting media for 2-3 weeks. Shoots producing roots are transferred to the greenhouse and potted in soil. Shoots that remain healthy on selection, but do not produce roots are transferred to non-selective rooting media for an additional two weeks. Roots from any shoots that produce roots off selection are tested for expression of the plant selectable marker before they are transferred to the greenhouse and potted in soil. Additionally, a DNA construct can be transferred into the genome of a soybean cell by particle bombardment and the cell regenerated into a fertile soybean plant as described in U.S. Pat. No. 5,015,580, herein incorporated by reference.

Transgenic soybean plant cells are transformed with recombinant DNA from each of the genes identified in Table 1. Transgenic progeny plants and seed of the transformed plant cells are screened for enhanced water use efficiency, enhanced cold tolerance, increased yield, enhanced nitrogen use efficiency, enhanced seed protein and enhanced seed oil as reported in Example 6.

Example 4

Cotton Transgenic Plants with Enhanced Agronomic Traits

Cotton transformation is performed as generally described in WO0036911 and in U.S. Pat. No. 5,846,797. Transgenic cotton plants containing each of the recombinant DNA having a sequence as described herein are obtained by transforming with recombinant DNA from each of the genes identified in Table 1. Progeny transgenic plants are selected from a population of transgenic cotton events under specified growing conditions and are compared with control cotton plants. Control cotton plants are substantially the same cotton genotype but without the recombinant DNA, for example, either a parental cotton plant of the same genotype that was not transformed with the identical recombinant DNA or a negative isoline of the transformed plant. Additionally, a commercial cotton cultivar adapted to the geographical region and cultivation conditions, i.e. cotton variety ST474, cotton variety FM 958, and cotton variety Siokra L-23, are used to compare the relative performance of the transgenic cotton plants containing the recombinant DNA. The specified culture conditions are growing a first set of transgenic and control plants under "wet" conditions, i.e. irrigated in the range of 85 to 100 percent of evapotranspiration to provide leaf water potential of −14 to −18 bars, and growing a second set of transgenic and control plants under "dry" conditions, i.e. irrigated in the range of 40 to 60 percent of evapotranspiration to provide a leaf water potential of −21 to −25 bars. Pest control, such as weed and insect control is applied equally to both wet and dry treatments as needed. Data gathered during the trial includes weather records throughout the growing season including detailed records of rainfall; soil characterization information; any herbicide or insecticide applications; any gross agronomic differences observed such as leaf morphology, branching habit, leaf color, time to flowering, and fruiting pattern; plant height at various points during the trial; stand density; node and fruit number including node above white flower and node above crack boll measurements; and visual wilt scoring. Cotton boll samples are taken and analyzed for lint fraction and fiber quality. The cotton is harvested at the normal harvest timeframe for the trial area. Enhanced water use efficiency is indicated by increased yield, improved relative water content, enhanced leaf water potential, increased biomass, enhanced leaf extension rates, and improved fiber parameters.

The transgenic cotton plants of this invention are identified from among the transgenic cotton plants by agronomic trait screening as having increased yield and enhanced water use efficiency.

Example 5

Canola Transformation

This example illustrates plant transformation useful in producing the transgenic canola plants of this invention and the production and identification of transgenic seed for transgenic canola having enhanced water use efficiency, enhanced cold tolerance, increased yield, enhanced nitrogen use efficiency, enhanced seed protein and enhanced seed oil.

Tissues from in vitro grown canola seedlings are prepared and inoculated with overnight-grown *Agrobacterium* cells containing plasmid DNA with the gene of interest cassette and a plant selectable marker cassette. Following co-cultivation with *Agrobacterium*, the infected tissues are allowed to grow on selection to promote growth of transgenic shoots, followed by growth of roots from the transgenic shoots. The selected plantlets are then transferred to the greenhouse and potted in soil. Molecular characterization are performed to confirm the presence of the gene of interest, and its expression in transgenic plants and progenies. Progeny transgenic plants are selected from a population of transgenic canola events under specified growing conditions and are compared with control canola plants. Control canola plants are substantially the same canola genotype but without the recombinant DNA, for example, either a parental canola plant of the same genotype that is not transformed with the identical recombinant DNA or a negative isoline of the transformed plant Transgenic canola plant cells are transformed with recombinant DNA from each of the genes identified in Table 1. Transgenic progeny plants and seed of the transformed plant cells are screened for enhanced water use efficiency, enhanced cold tolerance, increased yield, enhanced nitrogen use efficiency, enhanced seed protein and enhanced seed oil as reported in Example 6.

Example 6

Selection of Transgenic Plants with Enhanced Agronomic Trait(s)

This example illustrates identification of plant cells of the invention by screening derived plants and seeds for enhanced trait. Transgenic corn seed and plants with recombinant DNA identified in Table 1 are prepared by plant cells transformed with DNA that is stably integrated into the genome of the corn cell. Transgenic corn plant cells are transformed with recombinant DNA from the genes identified in Table 1. The promoter for expression of the genes is a rice actin promoter, as described in Table 2, unless otherwise specified herein. Progeny transgenic plants and seed of the transformed plant cells are screened for enhanced water use efficiency, enhanced cold tolerance, increased yield, enhanced nitrogen use efficiency, enhanced seed protein and enhanced seed oil as compared to control plants.

A. Selection for Enhanced Nitrogen Use Efficiency

The physiological efficacy of transgenic corn plants (tested as hybrids) can be tested for nitrogen use efficiency (NUE) traits in a high-throughput nitrogen (N) selection method. The collected data are compared to the measurements from wildtype controls using a statistical model to determine if the changes are due to the transgene. Raw data were analyzed by SAS software. Results shown herein are the comparison of transgenic plants relative to the wildtype controls.

(1) Media Preparation for Planting a NUE Protocol

Planting materials used: Metro Mix 200 (vendor: Hummert) Cat. #10-0325, Scotts Micro Max Nutrients (vendor:

Hummert) Cat. #07-6330, OS 4⅓"×3⅞" pots (vendor: Hummert) Cat. #16-1415, OS trays (vendor: Hummert) Cat. #16-1515, Hoagland's macronutrients solution, Plastic 5" stakes (vendor: Hummert) yellow Cat. #49-1569, white Cat. #49-1505, Labels with numbers indicating material contained in pots. Fill 500 pots to rim with Metro Mix 200 to a weight of ~140 g/pot. Pots are filled uniformly by using a balancer. Add 0.4 g of Micro Max nutrients to each pot. Stir ingredients with spatula to a depth of 3 inches while preventing material loss.

(2) Planting a NUE Selection in the Greenhouse (a) Seed Germination—Each pot is lightly watered twice using reverse osmosis purified water. The first watering is scheduled to occur just before planting; and the second watering, after the seed has been planted in the pot. Ten Seeds of each entry (1 seed per pot) are planted to select eight healthy uniform seedlings. Additional wild type controls are planted for use as border rows. Alternatively, 15 seeds of each entry (1 seed per pot) are planted to select 12 healthy uniform seedlings (this larger number of plantings is used for the second, or confirmation, planting). Place pots on each of the 12 shelves in the Conviron growth chamber for seven days. This is done to allow more uniform germination and early seedling growth. The following growth chamber settings are 25° C./day and 22° C./night, 14 hours light and ten hours dark, humidity ~80%, and light intensity ~350 μmol/m²/s (at pot level). Watering is done via capillary matting similar to greenhouse benches with duration of ten minutes three times a day.

(b) Seedling transfer—After seven days, the best eight or 12 seedlings for the first or confirmation pass runs, respectively, are chosen and transferred to greenhouse benches. The pots are spaced eight inches apart (center to center) and are positioned on the benches using the spacing patterns printed on the capillary matting. The Vattex matting creates a 384-position grid, randomizing all range, row combinations. Additional pots of controls are placed along the outside of the experimental block to reduce border effects.

Plants are allowed to grow for 28 days under the low N run or for 23 days under the high N run. The macronutrients are dispensed in the form of a macronutrient solution (see composition below) containing precise amounts of N added (2 mM $NH_4NO_3$ for limiting N selection and 20 mM $NH_4NO_3$ for high N selection runs). Each pot is manually dispensed 100 ml of nutrient solution three times a week on alternate days starting at eight and ten days after planting for high N and low N runs, respectively. On the day of nutrient application, two 20 min waterings at 05:00 and 13:00 are skipped. The vattex matting should be changed every third run to avoid N accumulation and buildup of root matter. Table 6 shows the amount of nutrients in the nutrient solution for either the low or high nitrogen selection.

TABLE 6

| Nutrient Stock | 2 mM $NH_4NO_3$ (Low Nitrogen Growth Condition, Low N) mL/L | 20 mM $NH_4NO_3$ (High Nitrogen Growth Condition, High N) mL/L |
|---|---|---|
| 1M $NH_4NO_3$ | 2 | 20 |
| 1M $KH_2PO_4$ | 0.5 | 0.5 |
| 1M $MgSO_4 \cdot 7H_2O$ | 2 | 2 |
| 1M $CaCl_2$ | 2.5 | 2.5 |
| 1M $K_2SO_4$ | 1 | 1 |

Note:
Adjust pH to 5.6 with HCl or KOH (c) Harvest Measurements and Data Collection—After 28 days of plant growth for low N runs and 23 days of plant growth for high N runs, the following measurements are taken (phenocodes in parentheses): total shoot fresh mass (g) (SFM) measured by Sartorius electronic balance, V6 leaf chlorophyll measured by Minolta SPAD meter (relative units) (LC), V6 leaf area (cm²) (LA) measured by a Li-Cor leaf area meter, V6 leaf fresh mass (g) (LFM) measured by Sartorius electronic balance, and V6 leaf dry mass (g) (LDM) measured by Sartorius electronic balance. Raw data were analyzed by SAS software. Results shown are the comparison of transgenic plants relative to the wildtype controls.

To take a leaf reading, samples were excised from the V6 leaf. Since chlorophyll meter readings of corn leaves are affected by the part of the leaf and the position of the leaf on the plant that is sampled, SPAD meter readings were done on leaf six of the plants. Three measurements per leaf were taken, of which the first reading was taken from a point one-half the distance between the leaf tip and the collar and halfway from the leaf margin to the midrib while two were taken toward the leaf tip. The measurements were restricted in the area from ½ to ¾ of the total length of the leaf (from the base) with approximately equal spacing between them. The average of the three measurements was taken from the SPAD machine.

Leaf fresh mass is recorded for an excised V6 leaf, the leaf is placed into a paper bag. The paper bags containing the leaves are then placed into a forced air oven at 80° C. for 3 days. After 3 days, the paper bags are removed from the oven and the leaf dry mass measurements are taken.

From the collected data, two derived measurements are made: (1) Leaf chlorophyll area (LCA), which is a product of V6 relative chlorophyll content and its leaf area (relative units). Leaf chlorophyll area=leaf chlorophyll X leaf area. This parameter gives an indication of the spread of chlorophyll over the entire leaf area; (2) specific leaf area (LSA) is calculated as the ratio of V6 leaf area to its dry mass (cm²/g dry mass), a parameter also recognized as a measure of NUE.

A list of recombinant DNA constructs which improved growth in high nitrogen in transgenic corn plants is illustrated in Table 7.

TABLE 7

| NUC SEQ ID | PEP SEQ ID | PHE ID | Construct | Positive events/ Total events screened | Confirmed events/ Actual events with confirmation attempted |
|---|---|---|---|---|---|
| 785 | 1765 | PHE0000004 | PMON67819 | 2/2 | 2/2 |
| 786 | 1766 | PHE0000005 | PMON67820 | 2/2 | 2/2 |
| 616 | 1596 | PHE0000854 | PMON73795 | 1/1 | 0/0 |

A list of recombinant DNA constructs which improved growth in limited nitrogen in transgenic corn plants is illustrated in Table 8.

TABLE 8

| NUC SEQ ID | PEP SEQ ID | PHE ID | Construct | Positive events/ Total events screened | Confirmed events/ Actual events with confirmation attempted |
|---|---|---|---|---|---|
| 783 | 1763 | PHE0000002 | PMON80861 | 3/4 | 2/4 |
| 785 | 1765 | PHE0000004 | PMON67819 | 2/3 | 0/3 |
| 786 | 1766 | PHE0000005 | PMON67820 | 3/7 | 0/4 |
| 616 | 1596 | PHE0000854 | PMON73795 | 1/3 | 1/1 |
| 619 | 1599 | PHE0000857 | PMON75348 | 2/5 | 2/5 |
| 621 | 1601 | PHE0000859 | PMON73798 | 1/8 | 0/0 |
| 628 | 1608 | PHE0000866 | PMON84970 | 2/10 | 0/0 |

B. Selection for Increased Yield

Many transgenic plants of this invention exhibit improved yield as compared to a control plant. Improved yield can result from enhanced seed sink potential, i.e. the number and size of endosperm cells or kernels and/or enhanced sink strength, i.e. the rate of starch biosynthesis. Sink potential can be established very early during kernel development, as endosperm cell number and size are determined within the first few days after pollination.

Much of the increase in corn yield of the past several decades has resulted from an increase in planting density. During that period, corn yield has been increasing at a rate of 2.1 bushels/acre/year, but the planting density has increased at a rate of 250 plants/acre/year. A characteristic of modern hybrid corn is the ability of these varieties to be planted at high density. Many studies have shown that a higher than current planting density should result in more biomass production, but current germplasm does not perform. well at these higher densities. One approach to increasing yield is to increase harvest index (HI), the proportion of biomass that is allocated to the kernel compared to total biomass, in high density plantings.

It is to plant multiple transgenic plants, positive and negative control plants, and pollinator plants in standard plots, for example 2 row plots, 20 feet long by 5 feet wide with 30 inches distance between rows and a 3 foot alley between ranges. Transgenic events can be grouped by recombinant DNA constructs with groups randomly placed in the field. A pollinator plot of a high quality corn line is planted for every two plots to allow open pollination when using male sterile transgenic events. A useful planting density is about 30,000 plants/acre. High planting density is greater than 30,000 plants/acre, preferably about 40,000 plants/acre, more preferably about 42,000 plants/acre, most preferably about 45,000 plants/acre. Surrogate indicators for yield improvement include source capacity (biomass), source output (sucrose and photosynthesis), sink components (kernel size, ear size, starch in the seed), development (light response, height, density tolerance), maturity, early flowering trait and physiological responses to high density planting, for example at 45,000 plants per acre, for example as illustrated in Tables 9 and 10.

TABLE 9

| Timing | Evaluation | Description | Comments |
|---|---|---|---|
| V2-3 | Early stand | Can be taken any time after germination and prior to removal of any plants. | |
| Pollen shed | GDU to 50% shed | GDU to 50% plants shedding 50% tassel. | |
| Silking | GDU to 50% silk | GDU to 50% plants showing silks. | |
| Maturity | Plant height | Height from soil surface to flag leaf attachment (inches). | 10 plants per plot |
| Maturity | Ear height | Height from soil surface to primary ear attachment node. | 10 plants per plot |
| Maturity | Leaves above ear | visual scores: erect, size, rolling | |
| Maturity | Tassel size | Visual scores +/− vs. WT | |
| Pre-Harvest | Final stand | Final stand count prior to harvest, exclude tillers | |
| Pre-Harvest | Stalk lodging | No. of stalks broken below the primary ear attachment. Exclude leaning tillers | |
| Pre-Harvest | Root lodging | No. of stalks leaning >45° angle from perpendicular. | |
| Pre-Harvest | Stay green | After physiological maturity and when differences among genotypes are evident: Scale 1 (90-100% tissue green)-9 (0-19% tissue green). | |
| Harvest | Grain yield | Grain yield/plot (Shell weight) | |

Effective yield selection of enhanced yielding transgenic corn events uses hybrid progeny of the transgenic event over multiple locations with plants grown under optimal production management practices, and maximum pest control. A useful target for improved yield is a 5% to 10% increase in yield as compared to yield produced by plants grown from seed for a control plant. Selection methods may be applied in multiple and diverse geographic locations, for example up to 16 or more locations, over one or more plating seasons, for example at least two planting seasons to statistically distinguish yield improvement from natural environmental effects.

TABLE 10

| Timing | Evaluation | Description |
|---|---|---|
| V8-V12 | Chlorophyll | |
| V12-VT | Ear leaf area | |
| V15-15 DAP | Chl fluorescence | |
| V15-15 DAP | CER | |

TABLE 10-continued

| Timing | Evaluation | Description |
|---|---|---|
| 15-25 DAP | Carbohydrates | sucrose, starch |
| Pre-Harvest | 1st internode diameter | |
| Pre-Harvest | Base 3 internode diameter | |
| Pre-Harvest | Ear internode diameter | |
| Maturity | Ear traits | diameter, length, kernel number, kernel weight |

Electron transport rates (ETR) and CO2 exchange rates (CER): ETR and CER are measured with Li6400LCF (Licor, Lincoln, Nebr.) around V9-R1 stages. Leaf chlorophyll fluorescence is a quick way to monitor the source activity and is reported to be highly correlated with $CO_2$ assimilation under varies conditions (Photosyn Research, 37: 89-102). The youngest fully expanded leaf or 2 leaves above the ear leaf is measured with actinic light 1500 (with 10% blue light) micromol $M^{-2}$ $s^{-1}$, 28° C., $CO_2$ levels 450 ppm. Ten plants are measured in each event. There are 2 readings for each plant.

A hand-held chlorophyll meter SPAD-502 (Minolta—Japan) is used to measure the total chlorophyll level on live transgenic plants and the wild type counterparts. Three trifoliates from each plant are analyzed, and each trifoliate was analyzed three times. The 9 data points are averaged to obtain the chlorophyll level. The number of analyzed plants of each genotype ranges from 5 to 8.

When selecting for yield improvement a useful statistical measurement approach comprises three components, i.e. modeling spatial autocorrelation of the test field separately for each location, adjusting traits of recombinant DNA events for spatial dependence for each location, and conducting an across location analysis. The first step in modeling spatial autocorrelation is estimating the covariance parameters of the semivariogram. A spherical covariance model is assumed to model the spatial autocorrelation. Because of the size and nature of the trial, it is likely that the spatial autocorrelation may change. Therefore, anisotropy is also assumed along with spherical covariance structure. The following set of equations describes the statistical form of the anisotropic spherical covariance model.

$$C(h; \theta) = vI(h=0) + \sigma^2\left(1 - \frac{3}{2}h + \frac{1}{2}h^3\right)I(h<1),$$

where I(●) is the indicator function, $h=\sqrt{\dot{x}^2+\dot{y}^2}$, and $\dot{x}=[\cos(\rho\pi/180)(x_1-x_2)-\sin(\rho\pi/180)(y_1-y_2)]/\omega_x$ $\dot{y}=[\sin(\rho\pi/180)(x_1-x_2)+\cos(\rho\pi/180)(y_1-y_2)]/\omega_y$ where $s_1=(x_1, y_1)$ are the spatial coordinates of one location and $s_2=(x_2, y_2)$ are the spatial coordinates of the second location. There are 5 covariance parameters, $\theta=(v, \sigma^2, \rho, \omega_n, \omega_j)$, where $v$ is the nugget effect, $\sigma^2$ is the partial sill, $\rho$ is a rotation in degrees clockwise from north, $\omega_n$ is a scaling parameter for the minor axis and $\omega_j$ is a scaling parameter for the major axis of an anisotropical ellipse of equal covariance. The five covariance parameters that defines the spatial trend will then be estimated by using data from heavily replicated pollinator plots via restricted maximum likelihood approach. In a multi-location field trial, spatial trend are modeled separately for each location.

After obtaining the variance parameters of the model, a variance-covariance structure is generated for the data set to be analyzed. This variance-covariance structure contains spatial information required to adjust yield data for spatial dependence. In this case, a nested model that best represents the treatment and experimental design of the study is used along with the variance-covariance structure to adjust the yield data. During this process the nursery or the seed batch effects can also be modeled and estimated to adjust the yields for any yield parity caused by seed batch differences. After spatially adjusted data from different locations are generated, all adjusted data is combined and analyzed assuming locations as replications. In this analysis, intra and inter-location variances are combined to estimate the standard error of yield from transgenic plants and control plants. Relative mean comparisons are used to indicate statistically significant yield improvements.

A list of recombinant DNA constructs which show improved yield in transgenic corn plants is illustrated in Table 11.

TABLE 11

| NUC SEQ ID | PEP SEQ ID | PHE ID | Construct | Positive events/ Total events screened | Confirmed events/ Actual events with confirmation attempted |
|---|---|---|---|---|---|
| 785 | 1765 | PHE0000004 | PMON67819 | 1/7 | 0/3 |
| 786 | 1766 | PHE0000005 | PMON67820 | 1/11 | 0/6 |
| 786 | 1766 | PHE0000005 | PMON73601 | 1/2 | 0/1 |
| 632 | 1612 | PHE0000870 | PMON75340 | 1/1 | 0/1 |

C. Selection for Enhanced Water Use Efficiency (WUE)

(1) Greenhouse and Growth Chamber Screens for Enhanced Water Use Efficiency

Described in this example is a high-throughput method for greenhouse selection of transgenic corn plants to wild type corn plants (tested as inbreds or hybrids) for water use efficiency. This selection process imposes 3 drought/re-water cycles on plants over a total period of 15 days after an initial stress free growth period of 11 days. Each cycle consists of 5 days, with no water being applied for the first four days and a water quenching on the 5th day of the cycle. The primary phenotypes analyzed by the selection method are the changes in plant growth rate as determined by height and biomass during a vegetative drought treatment. The hydration status of the shoot tissues following the drought is also measured. Plant height is measured at three time points. The first is taken just prior to the onset drought when the plant is 11 days old, which is the shoot initial height (SIH). Plant height is also measured halfway throughout the drought/re-water regimen, on day 18 after planting, to give rise to the shoot mid-drought height (SMH). Upon completion of the final drought cycle on day 26 after planting, the shoot portion of the plant is harvested and measured for a final height, which is the shoot wilt height (SWH), and also measured for shoot wilted biomass (SWM). The shoot is placed in water at 40 degree Celsius in the dark. Three days later, the shoot is weighed to give rise to the shoot turgid weight (STM). After drying in an oven for four days, the shoots are weighed for shoot dry biomass (SDM). The shoot average height (SAH) is the mean plant height across the 3 height measurements. The procedure described above may be adjusted for +/−one day for each step given the situation.

To correct for slight differences between plants, a size corrected growth value is derived from SIH and SWH. This is the Relative Growth Rate (RGR). Relative Growth Rate (RGR) is calculated for each shoot using the formula [RGR %=(SWH−SIH)/((SWH+SIH)/2)*100]. Relative water content (RWC) is a measurement of how much (%) of the plant was water at harvest. Water Content (RWC) is calculated for each shoot using the formula [RWC %=(SWM−SDM)/(STM−SDM)*100]. Fully watered corn plants of this age run around 98% RWC.

A list of recombinant DNA constructs which improved water use efficiency in transgenic corn plants is illustrated in Table 12.

green leaves, reduced tassel emergence, little or no silk emergence, little or poor ear development. The duration of this low water regime typically is timed to span the V8 leaf through the R2 reproductive stage.

To identify individual plants that show improved growth under stress conditions, at least two persons walk through the field at various times between the VT and R2 stages of plant development to allow for both identification and verification of drought tolerance. Plants that represent 1-2% of the population that best exhibits improved cumulative vegetative and reproductive characteristics, e.g. greenness, plant height/internode expansion, leaf flatness/wilting, ear development, silk development/vigor and tassel development/emergence are identified. Identified plants are tagged with an ID, photographed, and sampled for further analysis.

Leaf samples are taken from individual plants showing a positive growth response under water stress. Because the quality of the plant material is important for quality of molecular analysis, the youngest/freshest leaf material is col-

TABLE 12

| NUC SEQ ID | PEP SEQ ID | PHE ID | Construct | Positive events/ Total events screened | Confirmed events/ Actual events with confirmation attempted |
|---|---|---|---|---|---|
| 785 | 1765 | PHE0000004 | PMON67819 | 3/7 | 2/4 |
| 785 | 1765 | PHE0000004 | PMON82452 | 6/11 | 0/0 |
| 786 | 1766 | PHE0000005 | PMON67820 | 4/11 | 2/11 |
| 616 | 1596 | PHE0000854 | PMON73795 | 1/4 | 0/2 |
| 619 | 1599 | PHE0000857 | PMON75348 | 2/6 | 0/4 |

Transgenic soy plants expressing Hap3 transcription factor proteins of SEQ ID NO: 1763 and SEQ ID NO: 1765 are tested in a growth chamber seedling wilt assay and demonstrated to have improved tolerance to water deficit conditions.

(2) Screening Large Field Populations for Enhanced Water Use Efficiency

The following description illustrates the selection of transgenic corn hybrid plants having improved water use efficiency from large field populations of, for example, over 13,000 hybrid corn plants representing hundreds to thousands of transgenic events prepared by transformation methods. Hybrid corn seeds for each of the transgenic events are randomized in a tumbler to create a pool of seeds. Multiple sets of an identical pool may be prepared for planting at different locations.

Seeds of identical pools are planted at multiple test locations at a density of approximately 32,000 plants/acre. Plants are evenly spaced in the field to ensure that environmental effects are similar for each plant in the field. The plot structure can be, for example, conventional corn rows on 30″ centers. Each row is planted with drip-tape to facilitate uniform water distribution of water to initiate germination. To generate water stress or drought conditions, the population stand is allowed to attain V8 stage of growth under normal watering conditions. At V8 stage, irrigation water is withheld until about 98% of the population exhibits extreme drought symptoms, e.g. very rolled leaves, poor internode expansion, light lected for analysis. DNA is isolated from the tissue samples and used as template for amplification of the inserted transgenic DNA using commercially available sequencing kits. The resulting sequence information is compared to the known set of transgene coding region sequences used in the field study.

The null hypothesis is that the selection of plants is no better than selecting plants randomly. Chi square analysis is used to test the null hypothesis for each plant construct in the study. Since it is known how many plants for a given construct were planted in the field and how many plants were selected and sampled, the expected frequency of randomly selecting a transgenic plant that contains a given construct can be calculated. Sequence identification of the sampled plants allows for calculation of the observed frequency for a given construct in the sampled population. Chi square analysis indicates if the observed frequency for a construct is significantly different from random. If the frequency of identifying a particular construct is significantly higher than random (at $P \leq 0.05$), it indicates that the null hypothesis (the selection of plants is no better than selecting plants randomly) is not true. This demonstrates that the gene in plants where the null hypothesis is not true has improved plant growth under stress conditions. A list of recombinant DNA constructs which improved water use efficiency in transgenic corn plants as demonstrated by field testing as described above is illustrated in Table 13.

TABLE 13

| PEP SEQ ID | Construct | ID | Gene Name | Events | Exp. Freq. | Obs. Freq. | Chi Test |
|---|---|---|---|---|---|---|---|
| 1596 | pMON73795 | PHE0000854 | Soy 14-3-3 22 | 3 | 0.87 | 3 | 0.023 |
| 1265 | pMON85035 | PHE0000154 | 14-3-3 protein 1 | 10 | 1.86 | 5 | .021 |

TABLE 13-continued

| PEP SEQ ID | Construct | ID | Gene Name | Events | Exp. Freq. | Obs. Freq. | Chi Test |
|---|---|---|---|---|---|---|---|
| 1264 | pMON96114 | PHE0000153 | 14-3-3-like protein D | 8 | 1.4 | 7 | 0.0000 |
| 1608 | pMON84970 | PHE0000866 | soy 14-3-3 21 | 6 | 1.12 | 4 | .006 |
| 1610 | PMON75338 | PHE0000868 | wheat 14-3-3 10 | 4 | 1.22 | 4 | .012 |

(3) Greenhouse and Field Level Analysis of Transgenic Cotton Plants

Transgenic cotton plants transformed with pMON95503 and expressing soy 14-3-3 22 protein (PHE0000854) under the regulatory control of a CaMV 35S promoter are analyzed for enhanced agronomic traits in greenhouse and field tests. In greenhouse tests, transgenic plants are identified which have an increase in plant height, number of nodes and internode length, as well as increased number of squares and bolls. When the events were tested against water use efficiency it was also noted that several of the events had an increase in plant fresh mass and plant dry mass (calculated based on total biomass/amount of water given). Field level analysis of pMON95503 transgenic plants confirms that the plants have enhanced agronomic traits, including increased vigor and increased numbers of bolls and nodes under water stress conditions.

Transgenic cotton plants expressing the plant Hap3 transcription factor protein of SEQ ID NO: 1763 under the regulatory control of a CaMV 35S promoter (pMON83103) demonstrate improved properties when grown under well watered and water stress conditions in the field. Positive events showed a lower rate of soil moisture depletion and greater growth rate under sustained deficit irrigation conditions. Hap3 transcription factor protein expressing plants were taller than control plants under both well watered and sustained deficit irrigation conditions. When plant height was normalized relative to the initial size at the onset of differential irrigation, Hap3 transcription factor protein expressing plants under well-watered conditions were significantly taller than the corresponding negative isoline controls. Differences in plant height are due to differences in internode length (equal node number). Transgenic plants expressing the plant Hap3 transcription factor protein of SEQ ID NO: 1763 under the regulatory control of an rd29a promoter (pMON95538) or a Tsf1 promoter (pMON95539) are similarly analyzed to identify transgenic cotton plants with improved agronomic traits.

D. Selection for Growth Under Cold Stress

Cold germination assay—Three sets of seeds are used for the assay. The first set consists of positive transgenic events (F1 hybrid) where the genes of the present invention are expressed in the seed. The second seed set is nontransgenic, wild-type negative control made from the same genotype as the transgenic events. The third set consisted of two cold tolerant and one cold sensitive commercial check lines of corn. All seeds are treated with a fungicide "Captan" (MAESTRO® 80DF Fungicide, Arvesta Corporation, San Francisco, Calif., USA). 0.43 mL Captan is applied per 45 g of corn seeds by mixing it well and drying the fungicide prior to the experiment.

Corn kernels are placed embryo side down on blotter paper within an individual cell (8.9×8.9 cm) of a germination tray (54×36 cm). Ten seeds from an event are placed into one cell of the germination tray. Each tray can hold 21 transgenic events and 3 replicates of wildtype (LH244SDms+LH59), which is randomized in a complete block design. For every event there are five replications (five trays). The trays are placed at 9.7° C. for 24 days (no light) in a Conviron growth chamber (Conviron Model PGV36, Controlled Environments, Winnipeg, Canada). Two hundred and fifty millilters of deionized water are added to each germination tray. Germination counts are taken 10th, 11th, 12th, 13th, 14th, 17th, 19th, 21st, and 24th day after start date of the experiment. Seeds are considered germinated if the emerged radicle size is 1 cm. From the germination counts germination index is calculated.

The germination index is calculated as per:

$$\text{Germination index} = (\Sigma([T+1-n_i]*[P_i-P_{i-1}]))/T$$

Where T is the total number of days for which the germination assay is performed. The number of days after planting is defined by n. "i" indicates the number of times the germination has been counted, including the current day. P is the percentage of seeds germinated during any given rating. Statistical differences are calculated between transgenic events and wild type control. After statistical analysis, the events that show a statistical significance at a p-level of less than 0.1 relative to wild-type controls will advance to a secondary cold selection. The secondary cold screen is conducted in the same manner of the primary selection only increasing the number of repetitions to ten. Statistical analysis of the data from the secondary selection is conducted to identify the events that show a statistical significance at a p-level of less than 0.05 relative to wild-type controls.

A list of recombinant DNA constructs which improve growth in seed under cold stress in transgenic corn plants is illustrated in Table 14.

TABLE 14

| NUC SEQ ID | PEP SEQ ID | PHE ID | Construct | Positive events/ Total events screened | Confirmed events/ Actual events with confirmation attempted |
|---|---|---|---|---|---|
| 785 | 1765 | PHE0000004 | PMON67819 | 1/5 | 1/1 |
| 786 | 1766 | PHE0000005 | PMON67820 | 7/11 | 3/9 |
| 628 | 1608 | PHE0000866 | PMON84970 | 1/7 | 0/0 |

E. Screens for Transgenic Plant Seeds with Increased Protein and/or Oil Levels

This example sets forth a high-throughput selection for identifying plant seeds with improvement in seed composition using the Infratec 1200 series Grain Analyzer, which is a near-infrared transmittance spectrometer used to determine the composition of a bulk seed sample (Table 10). Near infrared analysis is a non-destructive, high-throughput method that can analyze multiple traits in a single sample scan. An NIR calibration for the analytes of interest is used to predict the values of an unknown sample. The NIR spectrum is obtained for the sample and compared to the calibration using a complex chemometric software package that provides a predicted values as well as information on how well the sample fits in the calibration.

Infratec Model 1221, 1225, or 1227 with transport module by Foss North America is used with cuvette, item #1000-4033, Foss North America or for small samples with small cell cuvette, Foss standard cuvette modified by Leon Girard Co. Corn and soy check samples of varying composition maintained in check cell cuvettes are supplied by Leon Girard Co. NIT collection software is provided by Maximum Consulting Inc. Software. Calculations are performed automatically by the software. Seed samples are received in packets or containers with barcode labels from the customer. The seed is poured into the cuvettes and analyzed as received. The detail information has been provided in Table 15.

TABLE 15

| | |
|---|---|
| Typical sample(s): | Whole grain corn and soybean seeds |
| Analytical time to run method: | Less than 0.75 min per sample |
| Total elapsed time per run: | 1.5 minute per sample |
| Typical and minimum sample size: | Corn typical: 50 cc; minimum 30 cc |
| | Soybean typical: 50 cc; minimum 5 cc |
| Typical analytical range: | Determined in part by the specific calibration. |
| | Corn - moisture 5-15%, oil 5-20%, protein 5-30%, starch 50-75%, and density 1.0-1.3%. |
| | Soybean - moisture 5-15%, oil 15-25%, and protein 35-50%. |

A list of recombinant DNA constructs which improve seed compositions in terms of protein content in transgenic corn plants is illustrated in Table 16.

TABLE 16

| NUC SEQ ID | PEP SEQ ID | PHE ID | Construct | Positive events/ Total events screened | Confirmed events/ Actual events with confirmation attempted |
|---|---|---|---|---|---|
| 785 | 1765 | PHE0000004 | PMON67819 | 1/7 | 0/0 |
| 786 | 1766 | PHE0000005 | PMON67820 | 1/8 | 0/0 |
| 619 | 1599 | PHE0000857 | PMON75348 | 5/6 | 0/2 |
| 621 | 1601 | PHE0000859 | PMON73798 | 5/8 | 5/5 |
| 630 | 1610 | PHE0000868 | PMON75338 | 1/4 | 0/0 |
| 632 | 1612 | PHE0000870 | PMON75340 | 1/1 | 0/2 |

A list of recombinant DNA constructs which improve seed compositions in terms of oil content in transgenic corn plants is illustrated in Table 17.

TABLE 17

| NUC SEQ ID | PEP SEQ ID | PHE ID | Construct | Positive events/ Total events screened | Confirmed events/ Actual events with confirmation attempted |
|---|---|---|---|---|---|
| 785 | 1765 | PHE0000004 | PMON67819 | 1/3 | 0/0 |
| 786 | 1766 | PHE0000005 | PMON67820 | 1/6 | 0/0 |

Example 7

Transgenic Plants with Enhanced Agronomic Traits from Expression of HAP3 Transcription Factor and 14-3-3 Proteins This example illustrates the preparation and identification by selection of transgenic seeds and plants where the plants and seeds are modified for expression of both HAP3 transcription factor and 14-3-3 proteins. Transgenic plants are generated by transformation with recombinant DNA constructs which provide for expression of at least one HAP3 transcription factor protein and at least one 14-3-3 protein, such as disclosed herein. Alternatively, transgenic plants are generated by crossing HAP3 transcription factor expressing plants as provided herein with 14-3-3 protein expressing plants as provided herein.

Transgenic plant cells of corn, soybean, cotton, canola, alfalfa, sugarcane, sugar beet, wheat and rice expressing both HAP3 transcription factor and 14-3-3 proteins and having enhanced agronomic traits are screened as described in Example 6 for enhanced water use efficiency, enhanced cold tolerance, increased yield, enhanced nitrogen use efficiency, enhanced seed protein and enhanced seed oil. Plants are identified exhibiting enhanced traits imparted by expression of the HAP3 transcription factor and 14-3-3 proteins.

SEQUENCE LISTING (1962 sequences)

SEQ ID NO: 1 - DNA, 1652 bp, Zea mays
  CDS (96)..(1547)
ccacgcgtccgcccacgcgtccgcccacgcgtccgcccacgcgtccgcccacgcgtccgctcctctctttccccggcacctgtcacgggaggaggatggacaagagcggcggcgaggcggcggcggcggcagcagcagcagacgacgtcgagcggcgggggggcgactacgagcaagacgagcacgagcggagagggacggtgtggacggcgacggcgcacattgtgacggcggtgatcggctccggcgtgctggcgctggcctggagcgtggcgcagctgggctgggtcgcggggcccctcgcgctcgccggcttcgcgtgcgtcacctactacacctccacgctgctcgccggcgcctaccgcgcgccgcaccccgtcaccggccacaggaaccgcacctacatggacgccgtcagatcgtacctcagtcccagggaggtgttcatgtgcggggtcgcgcagtacgtgaacctgtggggcaccatggtcgggtacaccatcacggcgaccataagcatggccgcgatcaggcaggccgactgcctccgccgggacggcgccggcgccggcgcgcgctgcgacgcgccagggaccgtgctgatgctggcgttcagcgtggtccaggtggtgctgtcccagttcccgggcctggagcacatcacctggctgtccgtcgtcgcggcggccatgtcgttcgcctactccttcgccggcctcggcctctccgtagggcactgggtgtctcgtggcggcggcggcctcgggggcagggttgcaggtgccgccgcggcatcctccaccaggaagctctggaacgtgcttctcgccctggggaacattgccttcgcctacactttcgctgaagtattgatcgagatccaggatacactcaagtcaccaccaccggagaacaggacgatgaagaaggcagcaatgtacgggatcggagccaccaccatcttctacatctccgtcggctgcgctgggtacgccgcgttcggttcgaatgctccgggcaacatcttggcggcaggcgggctgggtcccttgtggctcgtcgacattgccaacatgtgcctcatcctccacctgatcggtgcataccaggtatacgctcagcctgtcttcgcttcggttgagaggtgggccgcctcacggtggccagaagccaagttcatgagcagcgcatacaccgtgtccgtcagcatccccctcttgcagagaggatcggtcaccgtcgcgccgcacaagctcgtcctgaggaccgccatagtcggcgcgacgactgcggtggcgctggcgatacccttcttcaacgccgtgctggggctcctcggcgcgttcagcttctggccgctcacggtctacttccccatcagcatgcacatcgcccagggcaagatcgccagggggaccaagtggtggtgccttctgcaggctctgagcatggtttgcttggtgatctcggtggccgtgggtgtaggctctgtcactgacattgtcgatagcctcaaggcctcttctagccctttcaaaattgtaggctaacaggttactgtagtcatgtacaatgctctgagccgatcgtgcgttgaggtttaaaagaactgtggtgcgcgaaaaaaaaaaaaaaaaaaaaaaaaaaaaaag

SEQ ID NO: 2 - DNA, 1863 bp, Oryza sativa
  CDS (144)..(1562)
gccgcccgcttgccggagctctctatctatctctctatctctatctctatccctccagattccctcctccatcgaatctctgatatttggagggagcgactcgacgcagcatcgcatcgtaaggaaggtcccctccactgtcgatggatcagcaccagctcgacgaggagaaccagagagccgcgctcttccactcctctgccccatcttcctctttgggagctgacggggaggaggagagggagactgtgccgctgctgtcctgcaagatggccgacgataaatctgacactgtccaggtctccgaggatacggcgcaccagattagcattgatccctggtatcaagttggattcattctgacaaccggggtgaatagtgcatatgttctgggatattctgcatcaatcatggtccctttaggctggattggtgggacatgtggcttgattctagctgctgcaatatccatgtatgcaaatgctcttcttgctcaccttcatgaagttggtggcaaacgccatatcagatacagagatcttgctgggcacatatatggtagaaaaatgtattcgcttacatgggctctgcaatatgttaatctattcatgatcaacactggccttatcattttagctggtcaagccctgaaggcaatatatgtattatttagggacgatggagttctaaagctaccctactgcatagcattatctgggtttgtctgtgctctttttgcctttggaatcccttatctgtctgctctcaggatttggttgggattatcaacagttttcagtctcatctatataatgatagcatttgtcatgtcgcttagagatgggattaccacacctgcaaaggattatactattcctggatcacattcagatagaatcttcactacgataggtgctgtagcaaaccttgtgttcgcttacaacactggaatgctcccagaaattcaagcaaccataaggcctcctgtggtcaagaatatggagaaggctctatggttccagttcactgttggttcgttgcctctttatgctgtcacctttatggggtattgggcgtacgggtcctcaacatcaagctatctactgaatagtgtgaagggaccaatttggataaaaactgtggcaaatttatcggcgtttcttcagactgtcatagcattacatatatttgcaagcccaatgtacgaattcttggacacaagattcggcagtggacatggtggtccttttgcaatccacaacataatgttcagagtgggtgtcagaggaggctacctgaccgtcaacaccttggtggccgcgatgctccccttccttggcgacttcatgagcctgacgggtgcactcagcacctttcccctgacattcgttcttgcaaatcacatgtacctcacggtgaagcagaacaagatgtccatcttcaggaaatgctggcactggctgaacgttgttggcttcagctgcttgtccgtcgcagctgcggttgctgcggtgaggctaatcacggtcgactacagtacataccatttgtttgctgatatgtgaggctggaaagtgcaagcatgcagccctggatcagctgtaaattcgtcctcttcttttttatttttttggttaggggatgcatgtaggtcgatagaatgatggagattgcaataaataatttggctaaaatgttgtccagatttggttgtttgaggtgcaagatgtttgcctcaaaacgtaccgctatggttcactttttaagaactgtactgctacctctgtttgcggagatttttgtctgcaggcatgcaggatgaatattattcaagtgctctaaacgaggatccgggtaccatgg

SEQ ID NO: 3 - DNA, 1690 bp, Sorghum bicolor
  CDS (16)..(1341)
agagatagaggagcaatggctggttcgtcttcaatggacactgaagctgcaggccaacagctcaagcatggcagcggctacagcatcccggctactgctcatgcggtggacacagactcgtggcagcaggtgagcctgctgatggtgatcggcttcaactgcgcctacgtgctcagcttctccaacctcatgatggtgcccctgggctgggcatggggcgtcgcctgcctgctgctcgtcggcgccgccgcatggtacgccaactggctcctcgccggcctccatttcgtcgacggacagaggttcatccgctacagggacctcatgggcttcgtattcgggaggaacatgtactacatcacttggttcctgcagttcaccactctacttttgtgcaacatgggcttcattctactaggagcaagagcactcaaggcaatcaacagcgagtttacccacacccctgccaggctgcagtggttcgtcaccgcgacgggattcatctacttcgccttcgcctacttcgtgcccacgatttctgccatgaggaactggctcgccacgtcggccgcgctgacattagcttacgacgtcgctctgctggctatcctcatcagagatgggaaatcgaacaagcagaaggactacaacgtccatgggacccaagccgagaaggtgttcaacgcgttgggcgccgtcgccgccatcctcgtctgcaacacgtccgggctgctcccggagatacagtcgacggtgcgggagccggcggtgcgcggcatgcggcgggcgctgcttctgcagtacaccgccggcgccgcggggtactacggcatcagcgtggcggggtactgggcgtacgggtcggcggtgtcggagtacctccccaacgagctcggcgggccaaggtgggccgccgtgctcatcaacgccaccgccttcctgcagagcatcgtctcccaacacctgttcacggtgccgatccacgaggcgatggacacgcggctgcagcggctggacgagggcatgttctcccggtacaacctcacgcgacgcctctgcgcgcgggggctcgtcttcggcttcaacgtcttcgtcaccgcgctgttcccgttcatgggggacttcgtcaacctcgtcggctccttcgcgctcgtcccgctcaccttcacgttccctagcatggccatcctcaagatcaaagggaagagcggcgggagatgtaacagactttggcattgggggatcatcgttttctcctcggttctctgcgtcgctaccaccgccgccgccgttcgtctgatcttcaacaatgctaggatctaccacttcttcgctgacatgtagtaaggagtccaaaaaaaacacgattaggtgatattgccacttctcaattttttttttttgttttggtgaggaatgaaagggtcacctcatgtttggtaaggacgaccacatgcatgatcaataagcatcatgtagtcatcctatcgaaatttagaaatgagcttattgtggtggaccacctcctcaaaacaaagatctctgttcttaattaatgcgagcttaaagacaactcatgcctatatatatatatatatatatatatgctctcaagctcatgcctatatatatatatatatgtaatcgccctcaagtttattaatcaattattgtgtatttagttcaaaaa

SEQ ID NO: 4 - DNA, 1609 bp, Oryza sativa
  CDS (61)..(1485)
cacacttcctcaaatcctccaacacctcgatccattcgcagtagctgcgaggtgtctgacatggcgtcggggcagaaggtggtgaagccgatggaggtgtcggtggaggccgggaacgccggggaggcggcgtggctggacgacgacgggcgggcgcggcggacgggcacgttctggacggcgagcgcgcacatcatcaccgccgtcatcggctccggcgtgctgtcgctggcgtgggcgatcgcgcagctgggctgggtggccggccccgccgtgatgctcctcttcgccttcgtcatctactacacctccaccctcctcgccgagtgctaccgcaccggcgaccctgccaccggcaagcgcaactacacctacatggacgccgtgcgcgccaacctcggcggcgccaaggtcaccttctgcggcgtcatccagtacgccaacctcgtcggcgtcgccatcggctacaccatcgcgtcgtccatcagcatgcgcgccatcaggagggccggctgcttccaccacaacggccatggtgacccgtgccgcagctccagcaacccttacatgatcctcttcggcgccgtgcagatcgtcttctcgcagatccctgacttcgaccagatttggtggctgtccatcgtcgccgccgtcatgtccttcacctactccggcatcggcctctccctcggcatcgtccagactatctccaatggcgggatccagggcagcctcaccggcatcagcatcggagtcggcgtcagctcgacgcagaaggtgtggcgcagcttgcaggcattcggcgacatcgccttcgcatactccttctccaacatcctcatcgagatccaagacacgatcaaggcgccgccgccgtcggaggcgaaggtgatgaagagcgcaacgaggctgagcgtggcgacgaccacggtgttctacatgctgtgcgggtgcatgggctacgcggcgttcggcgacgcggcgcccgacaacctcctcaccggcttcgggttctacgagcccttctggctgctcgacgtcgccaacgtcgccatcgtcgtgcacctcgtcggcgcctaccaggtgttcgtccagccaatcttcgccttcgtcgagcgctgggcctcccgccggtggccggacagcgcgttcatcgccaaggagctccgcgtggggcccttcgcgctcagcctcttccgcctgacgtggcgctcggcgttcgtctgcctcaccaccgtcgtcgccatgctcctccccttcttcggcaacgtggtgggtctcctcggcgccgtctccttctggccgctcaccgtctacttccccgtcgagatgtacatcgcgcagcgcggcgtgccacgtggcagcgcgaggtgggtctcactcaagacgctcagcgcgtgctgcctcgtcgtctccatcgccgccgccgcgggctccattgctgacgtcatcgacgcgctcaaggtgtacaggccgttcagcggatgattcttctgattctctcttgctgctttgagcagagcatccactggtaaaaagtggacagtaattttctttttttacagtctatggacgtagtacagtaaaaaagtgtgtacaactgtaaaaa

SEQ ID NO: 5 - DNA, 1626 bp, Zea mays
  CDS (63)..(1427)
tgcaccaattcctgaggcaccaaccaagcctctcttgttgactccgacgccgatcgacggccatggggacccaagcgccggagaaggagaactacccccctgaaaaggatgcgaggagcgcacgggagaaggccatcgacgagtggctcccgatcacctcgtcgcggaacgccaagtggtggtactccgccttccacaatgtcaccgccatggtgggcgccggcgtgctcagccttccctacgccttgtccgagctcggctggggccctggcatcgccgtgctggtggtgtcgtgggtgatcacgctgtacacgctgtggcagatggtggagatgcacgagatggtgcccgggaagcggttcgaccggtaccacgagctggggcagcacgcgttcggcgagaagctgggcctgtggatcgtggtgccgcagcagctggtcgtggaggtgggcgtgaacatcgtgtacatggtgaccggcggcaggtcgctgaagaagttccacgacgtgctggtgtgcggcgacggcggggcgtcgtgccaggggaaggacaacatcaagaccacctacttcatcatgatcttcgcctccgtccacttcgtcctctcccagctccccaacttcaactccatctccggcgtgtcgctggccgccgccgtcatgtcgctcagctactccaccatcgcgtggggcgcgtcggtggacaagggcaggatggcgggcgtggactaccacctgcgcgcgaccacgacccccggcaaggtgttcggcttcttcggcgcgctgggcgacgtggcgttcgcgtacgcggggcacaacgtggtgctggagatccaggccaccatcccgtcgactcccgagaagccgtccaagaagcccatgtggaagggcgtcgtcgtcgcctacgtcgtcgtcgcgctctgctacttccccgtcgcgctcatcggctactgggcgttcggcaacagcgtccaggacaacatcctcatcacgctcagcaggcccaggtggctcatcgcgctcgccaacatgatggtcgtcatccacgtcattggcagctaccagatctacgccatgccagtgtttgacatgatagagacggtgctggtgaagaagctgcgcttccctcccggtctgacactgcgtctcatctctcggaccgcctatgttgcgttcacaatgttcatcgccatcaccttccccttcttcggcggactgctcggcttcttcggcggattcgcctttgcaccgacgacctatttccttccctgcgtcatgtggctcgcgatctacaagcccaagaggttcagcctctcgtggttcaccaactggatctgcatcattctcggggtgatcctgatgattctgtcgccaatcggagggcttcggcagatcataatggacgcgaaaacgtaccagttctactcgtaaaatgctaccagacactgagttttttgtcgtgccaacaacagaggggaacttcctggtaccatgtataagctgttacagatgttgggttagctatatacatacatgcatacgtattgtttcttaattaatgttccaaggtgaccgtgggttgtgtatatggtataaaggagaatcgatgatggtggttgtcccaaaa

SEQ ID NO: 6 - DNA, 1656 bp, Oryza sativa
  CDS (89)..(1426)
gcgtcgagctgcctagctatcgagatcttcgtacgtaaatacgtctccctcgtctccggcgagccaccggcttgggcgtacgtgagagatggcgccgccgtcagccatgaacacgtcgagggcggaggagaaggccatcgacgactggctccccatcacctcctcccgcaacgccaagtggtggtactccgctttccacaacgtcaccgccatggtcggcgccggcgtcctcagcctccccttcgccatgtccgagctcggctggggtcctggggtggcggcgatgatcatgtcgtgggtgatcacgctgtacacgctgtggcagatggtggagatgcacgagtgcgtgccggggcggcggttcgaccggtaccacgagctcgggcagcacgcgttcggggacaagctggggctgtggatcgtggtgccgcagcagctcatcgtcgaggtcggcgtctgcatcgtctacatggtcaccggcggcaagtcgctcaagaagttccacgacctcgtcgcgccgccctccgcgccgcccatccggacctcctacttcatcgtcatcttcggctgcctccacctcgtcctctcccagctccccaacttcaactccatcaccggcgtctccctcgccgccgccgtcatgtcgctcagctactccaccatcgcctgggccgcctcgctccaccaccacaaccacaacaatggcgccgccgccggaggcgtggactactcgctgacggcggcgacgccggcggggaggacgttcaacttcctgagcgcgctgggggacgtggcgttcgcgtacgcggggcacaacgtggtgctggagatccaggcaacgatcccgtcgacgccggagcggccgtccaaggggccgatgtggcgcggcgtcgtgctggcctacggcgtggtggccgtctgctacctccccgtggcgttcgcggggtactacgtgttcggcaacgccgtggacgacaacgtgctcatcacgctggagcggccggcgtggctgatcgccgccgccaacatattcgtcgtcgtgcacgtcgtcggcagctaccagatctacgccatgccggtgttcgacatgctcgagaccttcctcgtcaagaagctccgcttcaaacccggcatgcctctccgcctcatcgcccgatcactctacgtcttgttcaccatgttcgttgccatcgccgtccctttctttggtggattgctaggcttctttggtggctttgcgtttgctccaacgacctacttcttgccatgcattatgtggctgtcgatcatgaagccaaagaggtttggcttgtcctggtgcatcaactggttctgcatcatcatcggcgttcttctgtcggtgttcgcaccaatcggaggtctccgctcgatcatcgtgaatgcccagagttacaagttcttctcgtgagtgattaattgagaggtgttttaccattcaattaagtgtgttcttaattaattaggggattgttttagataatgcacagagttctatttaattagatgaaagagaaattcgtgtgtccctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 7 - DNA, 1671 bp, Zea mays
  CDS (116)..(1453)
ctcggcagcaggacccgccgccgcctcctctccatctctttctctctctctcgccatatcgattccattggggacgcaagcaccgccccagacccagagcttctcttctcaaaagatgcaggagcaggacgtggacgatggcggcggcaggacgacccagcagcaggagaagtcgatcgacgactggctccctatcaactcctccaggaaggccaagtggtggtactccgccttccacaatgtcaccgccatggtcggcgccggcgtgctcggcctcccctacgccatgtccgagcttggctggggccctggcatcgcggtgatgatcctgtcgtggataatcaccctatacacgctatggcagatggtggagatgcacgagatggtgcctgggaagcggttcgaccggtaccacgagctcgggcagcacgtcttcggcgacaggctgggcctctggatcgtggtgccgcagcagctggcagtagaggtgagcctgaacatcatctacatggtcaccggcggccagtccctcaagaagttccacgacgtcatctgcgacggcggcaggtgcggcggcgacttgaagctctcctacttcatcatgatcttcgcctccgtccacctggtcctctcccagctccccaacttcaactccatctccgccgtgtcgctcgccgccgccgtcatgtcgctcagttactccaccattgcgtggggcgcgtcgctgcacagagggaggagagaggacgtggactaccacctgcgcgccacgaccaccccagggaaggtgttcggcttcctgggaggcctaggggacgtggcgttcgcctactcggggcacaacgtggtgctggagatccaggccaccatcccgtccacgccggacaagccgtccaagaaggccatgtggaagggcgcctttgtcgcctacgtcgtcgtcgccatctgctacttccccgtcacgttcgtcgggtactgggccttcggcagcggcgtcgacgagaacatcctcatcacgctctccaagcccaagtggctcattgccctcgccaacatgatggtcgtcgtccatgtcattggcagttaccaggtttatgccatgccggtgtttgacatgatagagacggtgctggtcaagaaaatgaggttcgctccgagcctcacgctccgtcttattgcccggagcgtctatgttgcgttcacaatgtttctaggcatcactttccccttcttcggtggattgctcagtttcttcggcggattagccttcgcaccgacaacttattttcttccctgcatcatgtggctcaaggtttacaagcccaaacggttcggcctttcatggttcatcaactggatctgcatcgttattggagtgctgctgttgattctgggtccgataggagggctccggcagatcattttgtcagccaccacatacaaattctaccagtaaaatcgatcaactggagtcgtatggcgtggctgttttgttagcattacatttcttagggtggattggcttttaatgtacacgagcgagtgagattgatgctagtagctcctaggagtatatatatttctatcatccacagagcttaatgtatcttgtagttgggacaaaaaaaaaaaaaaaaaaaaaaaaaaaaaaaaaaaaaaaaaaaaaaaaaa

SEQ ID NO: 8 - DNA, 2071 bp, Oryza sativa
  CDS (313)..(1731)
cactcctctcccctccccacgcaaccgccttcctccgccgccgccgacgccgacgccgacgccgaccccttctcccaatctgcggattccagcgggggtcccccccccctcccaccggcggcgcccggtggtcgtggtcgtgggggaggggagtcaacgaacgagccgagccgcccgcttgccggagctctctatctatctctctatctctatctctatccctccagattccctcctccatcgaatctctgatatttggagggagcgactcgacgcagcatcgcatcgtaaggaaggtcccctccactgtcgatggatcagcaccagctcgacgaggagaaccagagagccgcgctcttccactcctctgccccatcttcctctttgggagctgacggggaggaggagagggagactgtgccgctgctgtcctgcaagatggccgacgataaatctgacactgtccaggtctccgaggatacggcgcaccagattagcattgatccctggtatcaagttggattcattctgacaaccggggtgaatagtgcatatgttctgggatattctgcatcaatcatggtccctttaggctggattggtgggacatgtggcttgattctagctgctgcaatatccatgtatgcaaatgctcttcttgctcaccttcatgaagttggtggcaaacgccatatcagatacagagatcttgctgggcacatatatggtagaaaaatgtattcgcttacatgggctctgcaatatgttaatctattcatgatcaacactggccttatcattttagctggtcaagccctgaaggcaatatatgtattatttagggacgatggagttctaaagctaccctactgcatagcattatctgggtttgtctgtgctctttttgcctttggaatcccttatctgtctgctctcaggatttggttgggattatcaacagttttcagtctcatctatataatgatagcatttgtcatgtcgcttagagatgggattaccacacctgcaaaggattatactattcctggatcacattcagatagaatcttcactacgataggtgctgtagcaaaccttgtgttcgcttacaacactggaatgctcccagaaattcaagcaaccataaggcctcctgtggtcaagaatatggagaaggctctatggttccagttcactgttggttcgttgcctctttatgctgtcacctttatggggtattgggcgtacgggtcctcaacatcaagctatctactgaatagtgtgaagggaccaatttggataaaaactgtggcaaatttatcggcgtttcttcagactgtcatagcattacatatatttgcaagcccaatgtacgaattcttggacacaagattcggcagtggacatggtggtccttttgcaatccacaacataatgttcagagtgggtgtcagaggaggctacctgaccgtcaacaccttggtggccgcgatgctccccttccttggcgacttcatgagcctgacgggtgcactcagcacctttcccctgacattcgttcttgcaaatcacatgtacctcacggtgaagcagaacaagatgtccatcttcaggaaatgctggcactggctgaacgttgttggcttcagctgcttgtccgtcgcagctgcggttgctgcggtgaggctaatcacggtcgactacagtacataccatttgtttgctgatatgtgaggctggaaagtgcaagcatgcagccctggatcagctgtaaattcgtcctcttcttttttatttttttggttaggggatgcatgtaggtcgatagaatgatggagattgcaataaataatttggctaaaatgttgtccagatttggttgtttgaggtgcaagatgtttgcctcaaaacgtaccgctatggttcactttttaagaactgtactgctacctctgtttgcggagatttttgtctgcaggcatgcaggatgaatattattcaaaaaaaaaaaaaaaaaaaaaaaaaaaaaaaaaaaaaaaaaaaaaaaaaaaaaaaaaaaaaaaaaaaaaaa

SEQ ID NO: 9 - DNA, 1813 bp, Oryza sativa
  CDS (110)..(1450)
cccttcttcatcttcttctttttcgtcttcttcttcttcttcttcttcttcctctgatattgctgcaaaagaagaagaggtagacgaaggaggaggagatcaggtgatcatggggactcaggtggcagataactacccaccggccaaggatggccggagcgcgcaggagaaggcgatcgacgactggcttcccatcacgtcgtccaggaacgccaagtggtggtactccgccttccacaatgtcaccgccatggtcggcgccggcgtcctcagcctcccctacgccatgtccgagctcggctggggacctggcatcgcggtgctgatcctgtcatggatcatcacgctctacacgctgtggcagatggtggagatgcacgagatggtgcccgggaagcggttcgacaggtaccacgagctcgggcagcacgcgttcggcgagaagctgggcctctggatcgtggtgccgcagcagctcgtcgtcgaggtcggcgtcaacatcgtgtacatggtcaccggcggcaagtcgctgaagaagttccacgacgtgctctgcgagggccacggctgcaagaacatcaagctcacctacttcatcatgatcttcgcctccgtccacttcgtcctctcgcagctcccaaacttcaactccatctccggcgtgtccctcgccgccgccgtcatgtcgctcagctactccaccatcgcgtggggcgcgtcggtggacaaggggaaggtggccgacgtcgactaccacctgcgcgccacgacgtcgacggggaaggtgttcggcttcttcagcgcgctgggcgacgtcgcgttcgcgtacgcggggcacaacgtggtgctggagatccaggcgaccatcccgtcgacgccggagaagccgtccaagaagccgatgtggaagggcgtcgtcgtcgcctacatcatcgtcgcgctctgctacttccccgtggcgctcgtcggatactgggcgttcggcaaccacgtcgacgacaacatcctcatcacgctctccaggcccaaatggctcatcgcgctcgcaaacatgatggtcgtcatccatgtcatcgggagctaccagatctacgccatgccggtgttcgacatgatcgagaccgtgctcgtcaagaagctcagattccctcccggcctcacgcttcgcctcatcgcaagaacactctacgttgcgttcaccatgttcatcgcgatcaccttcccgttcttcggtggattgcttgggttcttcggtggattcgccttcgcgccgactacttacttccttccctgcatcatgtggctagcaatctacaagccaagaaggttcagtctctcatggttcaccaactggatctgcatcattcttggagtgatgctcatgatcctgtcaccaatcggaggactccggcagatcatcatagatgccaagacatacaagttctactcatagattacatgttcatcatagtaatctcatgtggctgcaagttcaagttctactcataggcacacatgatgaaaccagttactgcaaaagttttttttttagccaacaaaggaagaagaaagttcaacaccaagttcatacattgtcactacgacgatgatcttttgagacgtgtcatgcatgcatcagtcgttaattatgtgacttaattaaaaacaaagaggttgtgtttgtgcattgtcgctgggttaatcatactgtgtttttatatttcaatctactattatactgtaggctggacatggaaactgtgtgcagaaagatgaaagggatggataattactggttgattcttttgctttc

SEQ ID NO: 10 - DNA, 974 bp, Arabidopsis thaliana
  CDS (61)..(801)
ctctctcagcttacgaacaagaaaaaaagaagaatctttagccacctttgagatcaaaagatgaacatcgctcacactatcttcggcgttttcggaaatgcaactgctctgtttcttttcttggctccttcgataacattcaagagaatcatcaagaacaaatccactgaacaattctctggtatcccttatccaatgactctcctcaactgtctcctctctgcttggtatggacttccctttgtgtcaaaagacaacacacttgtgagcacaatcaatggcacaggagcagtgatcgaaacagtctacgtgttaatctttcttttctacgcaccaaagaaggagaaaattaagatctttggtatcttctcttgcgttttggctgtattcgcaacagtagctctcgtctctctctttgctcttcaaggaaacggtagaaaactcttttgtggtctcgcagctactgttttctccatcatcatgtacgcttctccactctccatcatgagattggtggtaaagacgaagagtgtagagtttatgccattctttttgtcactctttgtcttcctctgtggtacttcgtggttcgtctatggtctaatcggtcgtgacccttttgttgcaatcccaaatgggtttggatgtgcattagggacactgcaattgatactatacttcatctactgtggaaacaaaggagagaaatctgcagatgctcagaaagatgagaagtcagtggagatgaaagatgatgagaagaagcagaatgtggttaatggaaagcaagaccttcaagtttaaaagagcttttgaggatgatttggttatgtgatttcgtattaactctgcttaactagagttttccttttcgtttcgttggaatgtaaaaaaaatgatgctgaaaaatgtaacgtttcctagtttcgtactgatacactagtgattgatgaagaatgacgatgccttttgtg

SEQ ID NO: 11 - DNA, 1163 bp, Oryza sativa
  CDS (136)..(1008)
ccgtgttgtagtgttgtgtagcagtagtccaccgctgagaagctagcaaagccagccatccattcagcgcagtactctcgggagagctagaagcgatctattctagccacaaggaggagagataaacgtatcgaaatggagcacatcgcgaggttcttctttggagtttccggcaatgtcatcgctctcttcctgttcctttcgccagttgtcaccttctggaggatcatcaagaagagatcaacggaggacttctccggcgtgccttacaacatgacacttctcaactgcctgctatctgcttggtacgggctgccgttcgtgtcaccgaacaacatcctggtgacgacgatcaacgggacggggtcggtgatcgaggccatctacgtggtgatcttcctcatcttcgcggagaggaaggccaggctgaagatgatgggtctcctgggcctcgtcacctccatcttcaccatggtggtgctcgtctccctcctggccctgcacggccagggccgcaagctcttctgcggcctcgccgccaccatcttctccatctgcatgtacgcctcgcctctctccatcatgaggctggtgatcaagacgaagagcgtggagttcatgccgttcctgctctccctgtccgtgttcctgtgcggcacctcctggttcatctacggcctgctcggccgcgaccctttcatcgcgatccccaatggatgcgggagctttctgggcttgatgcagctgatcctctacgcgatctaccggaaccacaagggggccacgccggcggcggcggccgggaagggggacgccgccgacgacgtggagatggccgaggggaggaacaacaaggtcgccgacggcggcgccgccgacgacgactcgtacggccggcggcaaggcgggcaccgaagtgtagctctggcgtgcgtctcgaatcggctaagatttcccgcgtgtgttctacttctacaagtagtaatattagctagacccttgctgctttgatctttactagaaaggagagcgcggcgccacgccgcgcgcgatggcaaatagttctacataaaatggttagatagtagatacatattttgataaatatagtctacatttgtttaataaacagagtacaatgaagtataaaaaaaaaaaaaaaa

SEQ ID NO: 12 - DNA, 2501 bp, Oryza sativa
  CDS (425)..(464), (546)..(582), (672)..(783), (812)..(898), (988)..(1149), (1556)..(1675), (1776)..(1952)
ttcagaaaaaaacttttagtcttgccctagtatttgtttcatgagttgtgtcttaatcaacaaacggttgggctcatgaaatgacactattggtggttgtgatattctttgctaaattttagagtttagttcccacaatctttacttgttctgattaatgtttcaataaaaaaagaagcgaatgtatgcttttgaaagcaaccggatgccaaacggagcataatctgtttgtgccatcctactgaatttcatggagcatatgcatagcttttggccttctgtgcttcatccacccattctgcatttcagacttttaagtatgctttaggcattataaatagacagacccacacttggagcaaagaagtaactattttgtcaaatactagtccattcgagttgaaacgttcagtgaacagctagaatggtttccaacacaatccgtgtagcagtaggaattctaggtacttctcttctgaatgttcttggaataaattcagattttcattattttcagagcataatttagtgtctcccactttcaggaaatgctgcttccatgctcctgtatgcagcacctatgtatgtacatcacatccacagataccatacatgatcagaatttatttcatttgctatctttgcttatcaatgtgctctgaaaatcacagattaacatttaggagggtgatcaagaagggcagtgtagaagaattctcttgtgttccatacatcttagctctgttcaactgcctcctgtacacatggtatgggcttcctgtagtaagctcaggatgggagaattctacagtgtcttccatcaatgggcttggcatactgcttgagatcgcattcatcagcatatacacatggtttgcacccagagaaagaaaggcaagttctttgcagaggaattcttcagatattcatgatacatgaactcttgaaacaatgttttgacaggcttatctaatgatcttatttcagaagtttgtgttgcgaatggtgctacccgttcttgcattctttgcgctgacagcaattttttcaagctttctgtttcatacgcacggtttacgcaaagtttttgtgggtagtattggcctggtggcttccatatcgatgtacagctctccaatggtagctgcagtgagtatctttcacatatactgccctacttcagagtcataatctgcacagacaaaattaagttccaaatagcattaacttcaagaaaaaaacttgtattgacaaggaataagtacagatcatatccataggagtgatgaaacaattcggcatctcaaaaaaagatatcataaacatggctaaacttgaaagaacataattaatcaacaccagtctaccactaacagataaatgcttgccttttcaactactaagccttttctcaattctctcttcaataagtttccaatctttattagaaagcttcctaaatcaaattcggaagttggaactgtgtacaagaagaattgttttcatttttcttacgcggtaatcttaaattttctaatggagctaacatttgcagaaacaagtcataacaacaaaaagtgtggagttcatgcccttctacctgtcattgttttccttcctctccagtgctctatggatgatatatgggcttctagggaaggatctcttcatcgcggttagtacataccgggtacatatgtttttattcagagatggatcgatcgagctgtaaaatcactctgttttcatttctttcttctgcttgtttcgtgcagtcaccaaacttcattggctgtccaatgggtatccttcagttggtcctgtactgcatttacaggaaaagccacaaggaagctgaaaagcttcatgacatcgaccaggaaaatggtctgaaagtggtaaccacgcatgagaagataactggaagggagccagaggctcagagagattgatgtgttttatgtactcacttggggactttgtttcatttctgttgtcttaagagtaggtacgatagcagactacaaacatattttaaggagataaagaaaagagagaaaagcaacgggctataaatttgtagctagccgcaacacactccaagatgcaatgtatgtataacaggtgggatcaagtattaatagtgtagtaactattgtatgaattagctattaaattaattataaatgattaggagctagtagttgactatactattaaacttgctcttagggcactcgcaatggttatctataggctctctacaagagatccatgtcagcatattttttctcttggaagagattaaatgaagagagagagcaaagctatctattaacctgaagatagtctatagagaaaaacgaggcaatggattagagagctatagatacccatgtagatatactattgaggtggtttaccattaatctagtgtattgctgagatgtacatattttatagagagtacattactttaccattaccattgcgggtgatct

SEQ ID NO: 13 - DNA, 1324 bp, Zea mays
  CDS (144)..(899)
ggcttcatcagctcattcaattctcgttccatccctcgtctcttgtgtcccgcctccgttccataattcaccagcgtcgtcctacccatatctcccatcgtcttctccctcgcgccatcagcttccccaagccagcggcgaccatgatctccccggacaccatccgcacggccatcggcgtcatcggcaatggaactgcactcgtgctcttcctctccccagtgcctacgttcatccgcatctggaagaaagggtcggtggagcagtactcgccgatcccgtacgtggcgacgctgctgaactgcatgatgtgggtgctgtacgggctgccggcggtgcacccgcacagcatgctggtgatcaccatcaacggcaccggcatggcgatccagctgacctacgtggcgctcttcctcctctactcggtgggggctgcgcggcgcaaggtggtcctgctgctggccgccgaggtgggcttcgtcggcgccgtcgccgcgctggtgctcagcctggcgcacacgcacgagcgcaggtccatggtggtcggcatcctctgcgtcctcttcggcaccggcatgtacgccgccccgctctccgtcatgaaaatggtgatccagacaaagagcgtggagtacatgcccctgttcctgtcgctggcttccctcgtgaatggcatctgctggactgcttacgcgctcatccgcttcgacctctacattactatccccaacgggctgggcgtgctgttcgcggtggcgcagctggtgctgtacgccatctactacaagtccacccaggagatcatcgaggcgcgcaagcgcaaggccgaccagatcgccatgaccggggtggtcgtcgacggcggcaagaccaacaaccaagccggcgcgggccaatactgaccgacgatcaagtgacgatcgacaccaatatgctcaagcaagaagccagcggcaaatcaattatgtcgccgctgggttttatgtattttgtgattctatatgcacgctgcttgtccgtcccggccaatggaaaaaaaagggggaagaaaaaatgtctgtcggtatatgtgttctcgccgaataactctcgcgcatagctagctggtggggctgagtcactgccttcgctatatgtatacgtgcaaaaattagaggtggagggttgttttagctaatcccaccttaattccaaggcagagtgacctttttttttctccttctgtttcggctaggattttgctataattgagcaatttagcgcgacttgttattggtgttggtgtgtctcaatcaaatagtaaaatgttcaattttactctttc

SEQ ID NO: 14 - DNA, 1925 bp, Zea mays
  CDS (29)..(1495)
ccacgcgtcctcggacgcgtgggtgtcgatggattacttggctgctgctgtacccgtgaccttggctctgggagtgggagctatcttgttggtcttacgatggacgtactgccgccgccgaacaagcgccgaagaagcaagactgcccccggggtcaaggggcctcctgttcctgggggagacgctccactacctggcagcgtcctccaccccgggggtattgccaccattcttccagcgacggttggagaggtatggccccatcttccggacgaacctggtcggggaggatctcgtcgtgtcgctggacgcggagctgaacgcgcacgtgctgaagcaggaggagcgcggcttccagatctggtacccgccctccttcatgcgcgtcttcggcgccgacaacatcaccgccaagctcggcgtgctccaccgccacatgaggaccctcgtgctccgcctcttcggccaccagaccgtccgctccgtgctgctgcacgacgtgcagcggagcgcgcgcgacgagctgcgctcatggctcggccgcccggacgtcgaggtcaggacggccacctccaggatgatatttggcgtcactgccaacaagctgatcagccatgacgacgcagcatctggaggcacgttgtggagatgcttccacgactggacttcggggctgctctcgtttccggtttccattcccggcacaaccttctacagatgcatgcagggacgtaagaaggttatgacgatgctgaaacagcagctcgtcgagcgtcgacggaacgcagcggagcgcgagacgacagaggatttcttcgatctcgtgatcgatgaactgaacaagccagaccctatgatggacgagagcaccgcgttggacttgctgttcaccatgttgtttgcgagccatgagacgacgtccatggtattaaccgtcatactcaagtatctgactgacaacccaaaagctttgcaagagctgacagaggagcacgaaagaatcctggaaagtagggccgatccaggctctgacctcacgtgggaggagtacaggtctatgaaattcacatctcatgttatacatgagtcgctaaggctcgcaaacatcgcactggccatgttcaggaaagcaaatcaggatgtgcacataaatgggtacacaattccaaaaggatcaaagatcatgatgtgtgcactagcatcgcacttgaatacggaggtctacgaggacccctcagtgttcaatccatggagatggaaggatattcctgaaccagtcggcacctctaaggactttatggccttcgggggtggtttgcgcctatgcgctggtgccgagttttccaagatgcagatggctatgttcctccattacttggtcacaaattacagctggaaacccgtcagcggtgggacaatgttattctatccaggactgcaatttccagaaggcttccacatccagcttcttccaaaaatcccaaacgtggttccataaaccctatgaagaaatatgaatacgaataatttaagcaaatattctaaatgtaccctggggaattgaagttcgataacgatgtggtacgggctgatttggtaaccatggatcacaggaggatgggagaggattgatggagaaattagttcatttctccctcaacctctttcaatcctcttatgatccacttatcaccaaatcaaccctaatgatagcaggtcgaattgtcggaacaaataatagtttcaccaaacagaaggggagtatgcatgtgtgtaactttttatagttataaataatagtagagtaaattcagctcgttgtgtaacaactatgcaggtgagtaaaaattggttcagcatattgtatatattatgcccagttcaatggaaaaaaaaactttgttgtcaaaaaaaaaaaaaaaaag

SEQ ID NO: 15 - DNA, 1915 bp, Zea mays
  CDS (141)..(1637)
ccacgcgtccggaaagatttttcttccctcctccgacgccccagcccaccaacacactctataaagcagccctcagtcacacacagaacgcacaagcgcaagccgggcaagaaaactccgcaggccagtctgcgagttggatggccttcttcttggccctcgtgtgcatcctcatcttgctagccatcgcctcctacgtccagtacactcgctggcaaaaggggaaaggccgcttcggcggccatgggaggtctgctcccttgaagctgcctcctggctccatgggctggccttaccttggcgagaccctccagctttactcccaggaccccagcttcttcttcgcttccaaacagaagaggtacggcgagatcttcaagacgcaccttctgggttgcccgtgcgtgatgctggcgagcccggaggcggcgcggttcgtgctggtgacgcaggcgcacctgttcaagccgacctacccgcggagcaaggagcgcatgatcgggccgtcggctctcttcttccaccagggcgactaccacctccgcctccgcaagctcgtccagggcgcgctcggccccgacgcgctgcgcgcgctcgttcctgaggtggaggccgccgtgcggtccactctcgcttcctgggacgccggccacgtcagaagcacgttccacgccatgaagacgctgtcgtttgatgtgggcatcgtgacgatcttcggcggccggctggacgagcggcgcaaggcggagctgaggaagaattactccgtcgtggagaaggggtacaactccttccccaacagcctgccggggacgctccattacaaggcgatgcaggcgcggcggcggctgcacggcgtgctgtgcgacatcatgcgggagcgtcgtggccaggcccaggcggcgggcaccggcctgctgggctgcctgatgcggtcccggggcgacgacggcgcgccgctcctgagcgacgagcagatcgccgacaacgtcatcggcgtgctgttcgcggcgcaggacacgacggccagcgcgctcacctggatcgtcaagtacctccacgaccaccccaagctgctcgaggccgtccgggcggagcaggcggcggtccgcgaggccaccggcggcgggaggcagccgctggcgtgggcgcacacgaagagcatggcgctaacgcatagggtgattttggagagcttaaggatggcgagcatcatctcgttcacgttcagggaggccgtggccgacgtggagtacaaagggttccttatccccaaggggtggaaggtgatgccgctcttcaggaacatccaccacagcccggactacttccaggatccacacaagttcgacccttctagattccaggtggcgccgcgtccgagcacgttcctgccgtttgggcacggcgtgcacgcgtgccccgggaacgagctggccaagctcgagatgctcgtcctcatccaccacctggtcaccggctacaggtggcaaatcgttggatccagtgacgaggtcgagtacagcccgttccctgtgcccaagcacggcttgcctgtcagattatggagacaaaacaatccggtcgacagaaaggggcgtgagaccgacgacgatcatgtggagaggatatttatttagtttgactcttgagttaggcatgaatttaaccccaagctagctagagaagttttttttcccctttgaaattcttctttgctcgcctcttcctcctggatcaaattgcgttggaggagaagaaacggcagctttctctctttcgttttctttgcctgcttcaccgctacgataatggtgaaaatatgtaagctacgtggacatcaatgatccacagcatcgttgatatatataatatatagagaaaattctctgcaaaaaaaaaaaaaaaaaaaaag

SEQ ID NO: 16 - DNA, 1886 bp, Zea mays
  CDS (104)..(1657)
ggcctcacccttttccctggtgttgcaagttgcaacacacagcgtccggcgagatcggcgatcagaaaccacgagcccacccaccatccggaacgcgcgcgcgatgtgtcccgtcagaggcggtggttgttcttggccagcgtccgtcgtcggctctgtcacggcggcgctgctcctcgccgccgtcatcgtgcggctcttcgtcccccgtgcctgttcttcaggaattatcaaggggcggcggcaggtaggtgctggtgctgccggaggagcacggctccctgccggctcgctcgggtggccgctcctcggcgagacgctggcgttcatccgggccgcgtactcgcctcgcccggagtccttcgtcgagaaacgccgcgtcttgtacgggaaggtgttcaagtcgcacctgtgggggtcgccggcggtggtgagctcggacccggaggtgagccgcgcggtgctgcaggccgacgcgtcggcgttcgttccatggtacccgcgatcgctcatggagctgatggggcaatcgtccatcctagtgctcggcggcggcctccagcgccgggtgcacggcctcgcgggcgccttcttcaagtcgccgcagctcaaggcgcaggtcaccctggacatgcagcgccgcgtcggccgcgccatggacatgtggggcaggcgccatcggagcatgggcgacgacgacagcggtggtatgcccgtgcgtgtgcagaacgaggccaagtcgattgtgttcgaaatcctagtgagggcgctgatagggttagaggaaggggacaagatgcagtacctcaggcaacagtttcaagaattcattgccggtttgatatcacttccggttaagcttccggggactcaactctatagatccctcaaggctaagaagaggatgacaaagttgataaaaacgatcatccaagagaagaggaagaagatgatgtcggaaggcgacgaggatctgcgtggtgggactcatccacgtgacatgatcgacgtcctgctaggcaacggcaacgacgagctctccgacgagctgatatctgacaacatgatcgacttcatgatccctgcagaggactccgtgcccgtgctcatcacgctggccgtcaagtacctcagcgaatgcccactggctctgcagcaactcgaggaggagaacatggagctcaagaggcagaaatcaggcgcgggagaaaccctagaatggacagactacatgtcgctcgccttcacacagcacgtgatcacggagacgctgcggatgggcaacatcatcaacgggatcatgcggaaggcggtgcgagacgtggaggtgagaggccacctggtcccgaagggctggcgcgtcctcgtctacttccgcgccgtccacctcgacgccgccgtccacgacgacccgcacgccttcaacccctggaggtggaaggagaggcccgacgtcgtggccatgagcggcttcaccccgttcggcggcggccagaggctgtgccctgggctcgacctggcaaggctcgaggcctccatctttctgcaccatctcgtcaccaatttcaggtgggtggcggaggaggacaccgtcgtcaacttccccacggtgcggctcaagcgagggatgccaatcgcagtgacgcccagaacctgctgaacgcaacgcaacttgccaggcaaaaccatactatacatttatactccgtaatcaactaaagaggtgtgagaaataatacagtacatgcaagcatgtaatggagggcgaaattaaaagttggcacggcaaaggcgccgatggtatgccaaaagttcagtttgcaaattatatagtttaattgctattacactaggggcacccatgtctgatgcctcgtttatgaaaa

SEQ ID NO: 17 - DNA, 1844 bp, Zea mays
  CDS (81)..(1589)
ccacgcgtccgatctgtcactccccgacacgcgcacgagctccactccccactccgcacccaacccaaggcgccactgccatggacgcgggcggtccgccgccgctgttcctcctgggcgccgtgctggccgcggcgctggggtggctgctcgtggtctggcgggcggcggcggggcggcggcggtccgcgtcggcgcggctgccgccggggagcacggggctgccgctcatcggggagacgctgcggctcatcgcggcgtacaagtcgccgaacccggagccgttcatcgacgagcgcgtggcgcggcacggcagcggggtgttcacgacgcacgtgttcggcgagcgcaccgtgttctccgccgacccggccttcaaccgcctgctgctggccgcggagggccgcgccgtgagctgcagctacccgtcgtccatcgccacgctgctgggcccgcggtcgctgctgctcacctcgggccccgcgcacaagcgcctccactcgctcacgctgacccgcctcggccgcccggcctcgccgccgctgctggcgcacatcgaccgcctcgtcctcgccaccatgaggggctgggaccgccccggcgccggcgccatgcgcctcctcgacgaggccaagaagatcaccttcaacctcaccgtgtggcagctcgtcagcatcgagcctgggccgtggaccgagagcgtccggcgcgagtacgtgaagctcgtcgacggcttcttctccatccccttccccttcgcctccctcctcccgttcaccgtctacggccaggccctcaaggcgaggaagaaggtggccggagctcttcgggaggtggtaaggaagaggatggacgacaaggcggaggacgactgtggcgccagtaagaagaacggggagaagaaggacatggtggaggagctcctagaagcggagggcgggagcttctccgtggaggagatggtggacttctgcctgtccctgctggtggctgggtacgagaccacctccgtgctcatgacgctcgccgtcaagttcctcaccgagacacccaccgcactggcgcagctcaaggaagagcacgacagcatcagaggggtaaaaggcaaaggccaagctctggaatggagcgattacaagtcgatgccgtttacacaatgcgtgataagcgaaacgctgcgcgtggccaacctgatcagcggggtgttcaggcgtgcgaacaccgacatccacttcaaaggccacgtgatcccaaagggctgcaagatcttcgcgtcgttccgagccgtgcaccttagcctggaccactacgagaacgcccggaccttcgacccttggagatggcagcagggcaagagcaagctgcagagcgcggaaggggccagtctgttcacgccgttcggcggcgggccgcgcctgtgcccgggctacgagctcgcccgggtggtggtttccgtcttcctccaccacctcgtcacgcgctttagctgggaggaagccgaggaggacaggattgtcttcttccccaccacccggaccctcaagggataccccatcatcctacggcggcgaccggattgcgatgatctctgacctcatggctaggttccccccttatcttcttcggatcaaggctgaaggctaagcattagatagagtaaggtggatgtcgtcgtggctagtaggtgcatggtggtttctgccactcactcactcactcactctgttgtctgtttgttcctgttcctctctgttttctcttgctctgtaacctggacctggtacgagtcagcactcagcagccagcagcaaactcgcgttttgcttgtaaaaaaaaaaaaaaag

SEQ ID NO: 18 - DNA, 1843 bp, Zea mays
  CDS (92)..(1648)
gcctctcctcctctcccctgccctcgcaaacgcacgcaccacagcatcgtccttcgttccattcccatccataccccctcgatcggccgggatgctgggtgtggggatggccgcggcggtgctgctcggggccgtggcgttggtgctcgcggacgccgctgcgaggagagcgcactggtggtacagggaggcggctgaggcggtgctggtcggcgccgtggctttggtggtggtggacgccgcggcgcggagggcgcacgggtggtacagggaagcggcgctgggctcggcgcggcgggcgcggctgccgccgggggagatggggtggcccttggtcggcggcatgtgggccttcctccgcgccttcaagtccggcaagcccgacgccttcatcgcctccttcgtccggcggttcggtcgcacgggcgtgtaccgaagcttcatgttcagcagcccgactgtgctggtgacgacggcggaggggtgcaagcaggtgctgatggacgacgacgcgttcgtgacggggtggcccaaggcgacggttgcgctggtcgggccgcggtcgttcgtggcgatgccgtacgacgagcaccggcgcatccgcaagctgactgccgcgcccatcaacggcttcgacgcgctgacggggtacctgcccttcatcgaccgcaccgtcacgtcgtcgctgcgcgcgtgggcggaccacggcggcagcgtcgagttcctgacggagctgcggcgcatgacgttcaagatcatcgtgcagatcttcctgggcggcgcggaccaggccaccacgcgcgcgctggagcgcagctacacggagctcaactacggcatgcgcgccatggccatcaacctgcccggcttcgcgtaccgcggggcgctgcgcgcgcgccgccgcctcgtggccgtgctgcagggcgtgctggacgagcgccgcgccgccagggccaagggggtctcgggcggaggagtggacatgatggaccggctgatcgaggcccaggacgagcgcgggcggcgcctggacgacgacgagatcatcgacgtgctcgtcatgtacctcaacgccggccacgagtcgtccggccacatcaccatgtgggccaccgtgttcctgcaggagaatccggacatgttcgcgagagcaaaggcggagcaggaggcgatcatgaggagtatcccgtcgtcgcagcaggggctgacgctcagggacttcaggaagatggagtacctgtcgcaggtgatcgacgagacgctgcggctcgtcaacatctccttcgtctccttccgtcaggccaccagagacgtcttcgtgaacggatacctcatccccaagggctggaaggttcagctctggtaccggagcgtgcacatggacccacaggtgtaccctgaccccaccaagttcgacccgtcgaggtgggagggccactcgccgagagccggcacgttcctggcgttcgggctgggcgccaggctctgccccggcaacgacctcgccaagctggagatttccgtcttcctccaccacttcctcctcggctacaagctggcgaggacgaaccctaggtgccgggtgaggtacctgccgcacccgaggccggtggacaactgcttggccaagatcaccagagtcggtagctagctgctagattgtgatggaagtacgaatgaaaaaaaagcccagcagaaaactctagcggctgggccggctggaaattatgggccgggccattgtggttgcccccccctgtctgtgcaaaaataaaacaagcagaaaggaataaaaaaaaggaaaagtattacttcgaaaaaaaaaaaaaaaaaaaaaaaaaaa

SEQ ID NO: 19 - DNA, 1795 bp, Zea mays
  CDS (134)..(1543)
attcggctcgagcccatctcatctcttgctcctcgtccgtagttgcagttgcagtgtcctcggccgcctctagtcctagccgtttactccttcctttcaccgcatcaagcagagagcaagcgaggcaagagccatgggcgcctttctgctcttcgtctgtctcctggcgccggtcgtcgtgctcgcctgcgccgtccgcggcaggaagcggcgggcgtcctccgcggcggcgggcggcaaggcgctgccgctgccgcccgggtcgatggggtggccgtacgtgggcgagacgttccagctctactcgtccaagaaccccaacgtgttcttcgcccggaagcagaaccggtacgggccaatcttcaagacgcacatcctgggctgcccctgcgtgatggtgtccagcccggaggcggcgcgcttcgtgctcgtcacgcaggcccacctcttcaagcccaccttcccggcgagcaaggagcgcatgctggggccgcaggccatcttcttccagcagggcgactaccacgcccacctccgccgcctcgtctcccgggctttctcccccgaggccatccgcggctccgtgccggccatcgaggccatcgcgctgcgctcgctcgagtcctgggacggccgcctcgtcaacaccttccaagagatgaagctgtacgcgctgaatgtggcattgctgtccatcttcggcgaggaagagatgcggtacatagaggagctgaagcagtgctacctgaccctggagaaggggtacaactcgatgcccgtgaacctgccgggcaccctgttccacaaggccatgaaggcccgcaagcgcctgggcgccgtcgtggcccacatcatcgaggcccggcgcgagggcgagcggcagcgcgggagcgacctcctggcctccttcctggacgaccgcgaggcgctcaccgacgcccagatcgccgacaacgtgatcggcgtcatcttcgccgcccgcgacaccaccgccagcgtgctcacctggatggtcaagttcctcggcgaccaccccgccgtcctcaaggccgtcatcgaggagcagcaggagatcgcgcggtccaaaggctcctccggcgagcccctgacgtgggcggacaccaggcggatgcgcacgacgagccgtgtgatccaggagacgatgcgggtggcgtccatcctgtccttcaccttccgggaggccgtggaggacgtggagtaccaagggtacctgatccccaagggctggaaggtgatgcccctgttccggaacatccaccacagccccgaccacttcccctgcccggagaagttcgacccctcccgattcgaggttgctcccaagcccaacacgttcctgccgttcggcaacgggacccactcgtgcccgggcaacgagctcgccaagctggagatgctcgtgctcttccaccacctcgccaccaagtacaggtggtccacctccaagtccgagagcggcgtgcagttcggccccttcgcgctgccgctcaacggcctgcccatgaccttcgtccgcaaggactgatgagccgccgacagatgtgtggatcgtggacggagccacaccaaaaccacggcaggccgacggaaccaaaccaaagccaacaacaaacaggcggatggatatggtatggcggtatatgctagctagtactactataggagccgcgaaaaccgcttccgggatttggcgttgcggcggtcgccatcggacgggacggggacaggcatcaggcaagcatgggatgatcacagaggaaaaaaaaaaaaaaag

SEQ ID NO: 20 - DNA, 7001 bp, Oryza sativa
  CDS (183)..(476), (706)..(735), (2796)..(6734)
tactacagggcaccgcacagtgcagcggccagcagtgcagtacaccactgcagagtgcagacgaaggcaagcgtggctgcaaccgcaagcagcaaaagcaaaaccccggaagcttcccccaaaatctctctctccctctccccactataaatcctcccctctcgtcgatcgccatggctcccatgctctcgatcgcctcccgctcgccctcgccggcgttgattgcacctcacgcctccgcccgcgccaccggtcttcgtgctccgttcgccggcaaccgcattgtggggtgggggtggggggatcaaaccaaatcaggtacggatcgtaatcgcgcatcgatctgtgtcgtcctgttcctgcgcgtccgctccggcgagcccacgcaggcgccgcgggatccccctgctgcggtaggcggcggcggctgctacgtccggctgccggcgccgccgcgagaccgggacgcggttttggtaagcacgatccatttctttctcccccgaattccgacccgctcgtttggttgattggtttcgattcggtcgtgcggcctcgggtcacgtacatttacttctactacgagcaagcctaataatacagccgacttgttggttataaggttctgtgtagcattctctcagcctacccatataatagttagctccttacaattaatacagggctcacatgtctctctcgtagagtttcttggttcctgtgtctaagccggctgtaagtttatagcccgcttctcctctctctcctctcttttctcctccacctcaatatttaaccggcttatagtctactattatacttgctctactacgaccatagcagtacaagcgtgcagttttggagtttattaaactttaaagttggagtagttgtactactatccgaaacgtaattagtaagcgcaagtcaattctactatcggacaagtaattacgtttcggttagtagttttttaatatatctctcgtttaatgcgagtagcggcttataagacaaagacatgtgtacaagcggcgataaataactatagactatagagtatggaccttatatttctactagctaaataatcatgcttttatacggattaaaacaaattaaggtttttgggacaatttcattctagatgaaataagatagaatcatatgtagaaggattattttataacattaaagcatgtagagtaattggaagaaaacatgatggggtagtcggtaaataaaaaaaaacttggtgaggtggcaacattgctctcttttataaggagtatagattcttagcggcccaaaactaaagttaaaaatggaaaattacgaaaaccttaaattaattatatatctcatgggatttaaatttggttgctgcttataagccaacgagggtctaggaaccgataaaatttgtaaaaccaaagggcgataaataaatctcagggatacgaacacatatgcttcagccagtgcccggtggatagaaaggctatacataggaaagggaaaagagacttgcaaaaatactattgttctagtagaaagtttcatgttggtaattaatttaactttttttttgatcaaagggccttaaccctccatttccattaaaagaaatgtcacagtttacagcagaaaaaaaaaacagacttaatttaacatttgtctcagttcttcagcaattgaaagttgtttcgtctggagttgggataattttactagttttacaaaggattattctgtgggacttgaatatattaacttgcggttttgagtttgtgccgtgtgatgtcgattgaagtgtggattggtcctttctttcttgaatatgttgccatctgcttttgaaatgttggcactcttgacaaattgacaaagaaaatattaggcttgtttgctaatcatttcttattttcttgtagttgtatgtagtcgacggttccagaaaactgagtagctgacaggtgctgcctttttcttgttgcaggatttatttctcaaagactaccatttcagattactgaagttgggcgatctgcataactagcacggtgccacggtttttgagaagaagaacgagcaatggttcgacaggtacctggtttaagttctttctttcagctgtttgcctggacacttcattgcattgggtcgatgttctgggctgtcaagaactctgctgcctgaacaatgatgttttttttgtttatctagttagtttgcatgtgaaaatatcattagtttattcatatttatattgaatttttattagacatatttactgcatttctttagctttgctattacatttacttcatttgttgagcagatatgcataagctagattcttctatctaaaaatatgtataagctggacagcccccaaatacatagccttgagtagaaaacaatactatatctcaaaatataagattcatagtatcagctatgcctataccatacacatcaaattcactgtatcataaaaaacgagatttggagggagaggcgttcctccaacaattaaataagaaattgtgagcgtgttggggattgaacacgggattttggggttaaaaccacacatcccttgcgctgcattatcaagtgcatctcaaattcactgtatcatagtctacctgtaattgctgagcatttgcaaattagaaccttgaacataagtcaagtgttataattctttccttcagctgttggtattgttattgattttgttacctgaataacgatgcctttcattgtaactctccctttcctttttccagtatcacgtttgcttgttcactctacttctctgcttcatccctatcactgctttggcggaatccgatatcaagaatttatttgctctgaggaaagcaatcgctgttggaaaaggcttcctccacaactggtttgagctagaaactcctccatgcaactggtcaggtatatcatgcgtggggcttactgttgtggccatagacctgtcatctacgccactctacgtcgattttccatcacagatcattgcattccagtcactcgttcggctcaatgtaagcgggtgcgggttttccggtgagcttccagaagccatggtgaatctgcagcatctccagcacctagatttgagtgataatcagcttggtggccctctacctgcctcattatttgacttgaagatgctgaaagttatggtgcttgacaacaacatgttctctggacaactaagccctgccattgctcaccttcagcagctcaccgtgctatccatatccacgaattccttctctggaggcctccctccagagctaggcagtctgaagaacctggagtacctcgacattcacacaaatgcatttagtggatcaataccggcatctttcagtaatctatctcggctcttgtaccttgatgcaaacaataacaatctcaccggatcaatattcccgggaataagagcgttagtcaaccttgtcaagctcgatttatcgtcaaatggtttggtgggggcaatccccaaggagctttgtcaactgaaaaatctgcaaagtttaatcctatcagacaatgagttaactggaagcatcccagaagagattggtaatctgaagcagcttgaagtactcaatctcctcaaatgcaatctcatggacaccgtccctttgtcgatcggcaatctcgaaatcttggaagggctttatatatcattcaacagcttcagtggtgagcttccagcatctgttggtgagctacgcaatctgaggcagctgatggcgaagagtgcagggttcactgggagcataccgaaagaactcggcaattgcaagaagcttactactctagttctgtccggcaataacttcactggcactatacctgaagaacttgcagatttagttgccgttgtcttgtttgatgtggaaggaaacagactctcaggccacattcctgattggattcagaactggagtaatgtttcatctatatcgcttgcgcagaacatgttcgacggacctctaccgggtcttccattacatctggttagtttctctgcagaatccaaccggctgtcaggatctatccctgccaagatatgtcaaggcacctttctgcagatacttagattgaatgataacaatctgaccgggagtatcgatgagacatttaagggatgcaagaaccttactgagctaagcttgctagataaccatctccacggagagataccagaatacttagctttgctaccactggtgtcacttgatttgtcacataacaatttcacagggatgatccctgacaggttatgggaatcatcaaccatcttggacatctctctcagtgataaccagctaactggcatgatcacagagagcattggtaagctcttgagcttgcaatcgttgagcatcgacagaaactacttgcaaggacctctccctcgatcgatcggcgctctaaggaatctgacagcactgtctctcagtggcaacatgctatctgaggacattccaatacagctcttcaactgcagaaaccttgtcacattggacttgagctgtaacaatctgacagggcacatccccaaggccatatctcacttgacaaagctcaacaccttggtcctgtcccggaatcggctgtcaggcgctatcccttctgagctatgcgtggctttctcgcgcgagtcccattctgaattggagtacgtgcaacacattggattgattgatctgtcgcggaacagattgactggtcacatcccgagagcaatcaacaattgttctatactggtagagctacacctgcaagacaacttgttaagtggcactatacctgtggaacttgctgagctgagaaacataacaaccattgatctatcttccaatgcattggttggacctgtccttccatggcctgtaccattggcaagcctccaaggccttcttctgtctaacaacagactcagtggctccattccttctggcattggcaacattcttccccagatcacaatgctggacttatcgggtaacgcgcttaccggcactcttccattggatctactctgcaaagagagcctaaaccacctggatgtcagtgacaacaacatctctggacaaatcccattttcctgtcatgaggacaaagaatccccaatcccactgatcttcttcaatgcaagcagcaaccatttctcagggagcctggatgaatcgatctccaacttcacaaagctgacctatcttgatctccacaacaacagcctcactggaagattgccatcagcaatagcaagggtcacttctttgtactatcttgacctatcaagcaatgatttcagtggcaccatcccttgtggtatctgcggtatgtttggcctgaccttcgcaaacttctccggtaaccgcgacggtggcactttcaccttggcagattgtgctgctgaagaaggcggggtttgcgccgctaaccgtgtcgatcgaaagatgccggatcatccgttccatgtactggaagcaaccatttgttgcattgcaacggccattgtcattgtgctggtggtgatcctggtggtttatctgagacgacggaggaagatgttgagaaggaggcagtttgtccttgtccctgccggtgacaacgccatggctgaccatgagacaaccttgagtaacaatcttttggggaggaggaggatgaagaagagggagccaccgagcatcaacctcgcgacgttcgagcacgcgcctgtgagggtcaccgtggacgagatcatgagagccaccgggaatttcgacgggatgcacgtcgtcggcgacggcggcttcggcaccgtgtacagggcggagctccccggcggccggagggtcgccgtcaagaggctccacggcgtcggccgccggttccagggcggcgaacgcgagttccgcgccgagatggagaccgtcggcaaggtgaggcaccccaacctcgtccccctcctcggctactgcgccgccggcgacgagcggttcctcgtctacgagtacatggagcacggcagcctggaggaccggctgcgcggcggcggcggcgcggcgctcgggtggccggagcggctcacgatctgcggcggcgccgcccgcgggctcgcgttcctgcaccacggcttcgtgccgcacgtcatccaccgcgacgtcaagtccagcaacgtcctcctaggcgagggcctccagccgcgggtgtccgacttcggcctcgcgcggatcatcagcgcgtgcgagacccacgtcagcaccgtcctcgccggcacgctcggctacatcccgccggagtacgcgctggcgatgcggtgcaccgccaagggcgacgtgtacagcttcggcgtcgtcatgctggagctgctcacggggcggccgccgacgtggtcgtcggcggaggtgacggcggagggtgacgacgagcgcggcggcggcgggagcctcgtcgggtgggtgcggtggatggcggcgcgcgggcgtggcggcgaggtgttcgacgcttgcctgccggtgtccggcgcggagcgggagcagatggcgcgggtgctcgacgtcgcccgcgactgcaccgccgacgagccgtggaggaggccgaccatggcggaggtggccaggagggtgggggcgatcgaggcgatggagtacgggcctctggtggtggcagtgtccagtggcgagccgccggcgatgccatgatcttgctgctgctatactgtatactgtagtgcatcatgctcctttttgtgaattaaggtgttttgatctcatcttatatgcggacacagagatgcagcagaaactcaattttttaacaagttcatacctcacaggcatttcatcaaacacctgttatgcgtgcaaccaacccgctcattataacctcatctttttttttaatgcttatccttataagttaatatttaaaattttcaaccttaaatttgaatttcattttaggttttt

SEQ ID NO: 21 - DNA, 1905 bp, Zea mays
  CDS (143)..(1588)
ggcgagggagctcaccaggagagaggggcctgtgtgagcattgagcaaagcaaacgaagcagtacatacatctctcgggggccccggcgaggccggccggctccatgcaacaagggaggacgacgagcggtggcggtgggcgatgatgatgatgatgatggcgggggagcacgtgctggccgctctgggcaccctgctgctggcctcgctcctgaccctggtgctgaaccacttcctgcccttgcttctgaaccccaaggcccccaggggaagcttcgggtggccgctcctcggcgagacgctcaggttcctcacgccgcacgcctccaacacgctgggcggcttcctcgaggatcactgctccaggtatgggcgggtgttcaagtcccacctgttctgcaccccgacggtggtgtcctgcgaccaggacctcaaccacttcatcctgcagaacgaggagcggctgttccagtgcagctacccgaggccgatccatggcatcctgggcaagtcctccatgctcgtcgtcctgggcgaggaccacaagcgcctcaggaacctcgccctcgccctcgtcacctccaccaagctcaagcccagctacctaggcgacatcgagaagatcgcgctgcacgtcgtcggcgcatggcgacggcacggcggcgtcagggtcgtcgcattctgcgaggaggcaagaaagttcgcattcagtgtgatagtgaagcaggtgctggggctgtcgccagaggagccggtcactgcaaggatactcgaggacttcctggccttcatgaagggcctcatctccttccccctctacatcccagggaccccatatgccaaggctgtccgggcgagagagaggatatccagcactgtgaagggcatcatcaaggagcggaggagcgctgggtcatggaacaagcagggcgacttccttgacgtgctgctgtcaagcaacgagctatctgacgaggagaaagtgagctttgtgctggactccctgctgggaggatatgagaccacctcgctcctcatctccatggtcgtttatttccttggccagtctgctcaagatctggacctggttaagagggagcacgacagcataagatccaacaaaggcaaggaggagtgcttgacttcagaagactacaagaagatggaatatacccaacaagtcatcaacgaggcgctgagatgcggcaacatcgtcaagttcgtccaccggaaggcgctgaaagacgtcaaatacaaagagtatctgattccatctggctggaaggtcctaccggtcttcactgccgttcatctgaacccctcacttcatggagacgcgcagcagtttcagccctgtaggtgggagggcacaagccaagggacaagcaagaggtttacaccgttcggtggtggcccccggctctgcccaggatcagagctcgctaaagtggagactgctttcttcctccatcaccttgtcctcaattatagatggagaattgatggcgatgacattccaatggcatacccgtatgtggagtttcagagaggtctgccaatagaaatcgagccaacgtcccctgaatcttgactctcctggagctacagccatcagttatcacaccagagagaaaaggggaaggtgcatggagtatacatgaatggtcagtgacagatctcacaagtgaaggaacactgagggcgcgtgctagtagctagcatatgaggcagctgagactgtaatttaatgtacatggtgtagatatattttgtccatggcaattgcttgaagtggctgattcacttcaccctgtaaaacattctccagtggtttcaactgctatcctataaaaaagaagggcccctgtgtttagtaaaaaaaaaaaaaaaaaaaaaaaaaaaaag

SEQ ID NO: 22 - DNA, 3885 bp, Oryza sativa
  CDS (1)..(3885)
atggtatccaatagtttctggcttttcatcctgctagtgagcttcatccccatttctgcttgggcagaatcacgtgatataagtactctgttcactctgagggattcaatcaccgaaggaaaaggctttctccgtaactggtttgattcggaaactcccccatgcagctggtcaggcataacttgcataggacataatgttgtggcgattgatttgtcctctgttccactctatgctccgtttccattatgcattggggcattccagtcacttgttcggctcaacttcagtggatgtgggttttccggagagcttccggaagctttgggaaatttgcagaatctccagtacctagacttgagcaataacgagcttactgggccaatacctatctcactatataacctgaagatgctgaaggaaatggtgcttgactacaactccttgtcaggacaacttagtcctgctattgctcagctgcagcaccttactaagctatctatatccatgaattccatctccggaagccttccaccagatctgggcagcctgaagaacctggagttgttggacattaagatgaacacattcaatggatctataccagcaacttttgggaacctgtcttgtctcttgcactttgatgctagccagaataacctaactggatcaatattccctggaataacctcgttgacaaacctattgacacttgatctatcatcaaacagttttgagggaacaattcctagggagattggtcaactggaaaatctggaattactgattctaggaaagaatgatctcactggaaggattccacaagagattggtagtctgaagcagcttaagttacttcatctcgaggaatgtcagttcacaggcaaaataccttggtcaatcagtggactcagcagcttgacagaacttgacatatcagataacaactttgacgctgagctcccatcatccatgggtgagcttggcaatctaacacagctgattgcaaagaatgctgggctcagtgggaacatgccaaaagaacttgggaattgcaagaagcttactgttataaacctgtcattcaatgcccttattggacctattcctgaagaatttgcagatttagaggctattgtctcattttttgtggaaggaaataaactatcgggtcgtgtcccagattggattcagaaatggaaaaatgcaaggtccatcaggttgggacagaacaaattcagtggacctttgccagtgctgccattgcagcatctgctaagtttcgctgcagaatccaaccttctctcaggttctataccttctcacatatgccaagccaactccttgcattcactcttattgcatcataacaatctgactgggactattgatgaggcatttaaagggtgcacgaacctcactgaattgaacttgttagacaaccatattcatggggaggtaccaggatatttagcagaattacccctggttactctggagttgtcacaaaacaaattcgcagggatgttacctgcggagctgtgggagtcaaaaacccttctagagatatctctcagtaacaatgaaattaccggcccaatacctgagagtattggtaaactctctgtattgcaaaggttgcatatagacaataacttactcgaagggcctatccctcagtctgttggtgatctaaggaatctgaccaatctatccctgcgtggcaataggttatctgggatcattccactagcacttttcaactgcagaaaacttgccacgctggacttgagctataacaatctgactgggaacattccaagtgccatatctcacttgacattgcttgatagcttgattttgtcttccaaccagctgtctggttctatccctgctgagatttgcgtgggatttgagaatgaggctcaccctgactcagagtttcttcagcaccatggtcttcttgatctgtcatacaaccaattgactggtcagatcccaacatctataaagaactgtgcaatggtgatggtgctcaacctccaaggcaatttgctgaatggcaccattcctgtggagcttggcgagctaacaaatcttacatccattaacttgtcatttaatgaatttgttggaccaatgcttccatggtctggacctttggttcaattgcaaggccttattctgtccaataaccacctagatggctccattcctgctaagataggccaaatccttcccaaaattgcagtgctagacttgtcaagcaatgcactcactggcactctaccacagtctttgctctgcaacaattacctaaaccatctggatgtcagcaacaaccacctatctgggcatatccagttctcttgccccgatggcaaagaatactcaagtacactgctcttcttcaattcaagcagcaaccatttctcagggagcctagatgagtctatctcgaacttcacacaattgtctactcttgatatccacaacaatagcctcactggaaggttgccttcagcactttctgatctcagttctttgaattatcttgatctgtcgagcaacaatctctatggtgccataccctgtggaatctgcaatatatttggcctctcatttgccaacttctcaggtaactatattgacatgtacagcttggcagattgtgctgcaggaggcatttgttctactaatggtactgatcataaagcattgcatccatatcatcgggttcgaagggcaattaccatctgtgcctttacattcgtcatcatcattgttttagtgcttctggctgtttatctgagacggaagctggttagaagcaggcctttggcttttgaatctgccagtaaggccaaggctacagttgagcctacctcaactgatgaactgctaggaaagaagtcaagggaacctctgagtatcaatcttgcaacatttgagcatgcacttctgagggtcaccgcggatgatattctgaaagccacagaaaacttcagtaaggtgcacataataggtgatggtggatttggcactgtctacaaggcagcgctccctgaaggccggagagtcgcgatcaagaggctccatggtggccatcagttccaaggtgaccgtgagtttctagctgagatggagacaattggaaaggtgaaacatccaaacctcgtccctctacttggctactgtgtttgtggcgatgaacgattcctgatctacgagtacatggagaatgggagcctcgagatgtggctgagaaaccgagcagatgcacttgaagctcttggatggccggaccgtctcaagatctgcctcggttcagcccgtgggctcgccttcctgcatcatggctttgtgccccatatcatccaccgggacatgaagtcgagcaacattctactggatgagaacttcgagccgagggtctctgacttcggccttgcaaggatcatcagtgcctgtgagacccatgtcagcactgacattgccggtacatttggatacattcctccggagtatggcctcacaatgaagtccaccacgaaaggcgacgtctacagcttcggcgtcgtcatgctggagctcctcaccggacggccacctacaggccaggaggaggtgcaagggggtggaaacctcgtcggctgggtgcggtggatgatcgcccgcggtaagcagaacgagctgttcgatccatgcttgccggtttcaagcgtgtggcgggagcagatggcgcgcgtgctcgccatcgcccgggactgcaccgccgacgagccgttcaagaggccgacaatgctggaggtggtgaaggggctcaagatgacccacggcatggaatgtggacctctggtggtgaccgtctccagggacatgtaa

SEQ ID NO: 23 - DNA, 3333 bp, Oryza sativa
  CDS (1)..(3333)
atggacattctcatcccacttctcctctcctcgatctacgtgtcgtcgtcggcggcggcggcggaaaccgatgcggcggcgctcctccgcttcaaggcgttcgtccacaaggatcctagaggagtcctctcgtcgtgggtggatcctggtccatgtcgctggcgtggcgtgacgtgcaacggcgacggcagggtgacggagctcgacctcgccgccggcggcctcgccgggcgcgccgagcttgccgccctctctggtctcgacacgttgtgcaggttgaacctctccggcaatggcgagctgcacgttgatgccggtgacctggttaagctcccgcgcgcgctgctgcagctcgacctctccgatggcggcctcgccggccggcttcccgacggctttctggcgtgttaccccaacctcaccgatgtcagcctcgcgaggaacaacctcaccggcgagcttcccgggatgctcctggcgagcaatatccggtcgttcgacgtgtccggcaacaacatgtccggcgacatctccggcgtgtcgctccccgcgacgctggccgtcctcgacctgtccggcaaccgcttcaccggcgccatcccgccgtcgctgtccggctgcgcgggcctcacgacgctcaacctgtcgtacaacggcctcgccggcgcgataccggagggaatcggcgccatcgccgggctcgaagtgctcgacgtgtcgtggaaccacctcaccggcgccatcccgcccggcctcgggaggaacgcgtgcgcgtcgctgcgtgtcctccgcgtctcgagtaacaacatctccggctccatcccggagtcgctgtcgtcgtgccacgcgctccggctgctcgacgtcgccaacaacaacgtctccggcgggatccctgccgccgtgctcggcaacctcacggcggtcgagagcctcctcctcagcaacaacttcatctccggctctctcccggataccatcgcccactgcaagaacctccgcgtcgccgacctgagcagcaacaagatctccggcgcgctcccggccgagctctgctcgcccggcgcggcgctggaggagctccggctgccggacaacctcgtcgccggcacgatcccgccgggcttgtccaactgctcgcggctgcgggtgatcgacttcagcatcaactacctgcgcggcccgatcccgccggagctcggccggctccgcgccctggagaagctggtgatgtggttcaatggcctcgacggccggattccggcggatctcgggcaatgccggaatctccggacgctgatcctgaacaacaacttcatcggcggcgacatccccgtcgagctcttcaactgcaccggcctcgagtgggtgtcgctgacgagcaaccagatcaccggcaccatccggccggagttcgggcggctgtcccgcctcgccgtgctgcagctggcgaacaacagcctcgccggcgagatccccagggagctcggcaactgcagcagcctcatgtggttggacctcaacagcaaccgcctcaccggcgagatccctcgccgcctcggccgccagctcggctccacgccgctcagcggcatcctgtccgggaacacgctggcgttcgtccgcaacgtcggcaactcgtgcaagggagttgggggattgctggagttcgccggaatccggccggagcggctgctgcaggtgcccaccctcaagagctgcgacttcacgcggctctactccggcgccgccgtgagcgggtggacgcggtaccagacgctggagtacctcgacctctcgtacaacagcctcgacggcgagatccccgaggagttgggcgacatggtcgtgctccaggtgctcgacctggcgcggaacaacctcaccggcgagatcccggcgtcgctcggccgcctccgcaacctcggcgtgttcgacgtgtcgcgcaaccggctgcagggcggcatcccggactccttctccaacctctccttcctcgtccagatcgacatctccgacaacaacctctccggcgagatcccgcagcggggccagctcagcacgctgccggcgagccagtacgccggcaacccggggctgtgcggcatgccgctggagccctgcggcgaccgcctcccgacggcgaccatgtccgggctcgccgccgcggcgtcgacggatccgcccccacggcgcgccgtggcgacgtgggccaacggcgtgatcctcgccgtgctggtgtcggccgggctggcgtgcgcggcggcgatatgggcggtggcggcgcgggcgcggcggcgtgaggtgcgctcggcgatgatgctgagcagcctccaggacgggacgcggacggcgacgacatggaagctcgggaaggcggagaaggaggcgctgagcatcaacgtggcgacgttccagcggcagctccggaagctgaccttcacgcagctgatcgaggccaccaatggcttctccaccgccagcctgatcggctccggcgggttcggcgaggtgttcaaggcgacgctcaaggacgggtcgtgcgtggcgatcaagaagctgatccacctgagctaccagggcgaccgcgagttcatggcggagatggagacgctgggcaagatcaagcacaagaacctcgtccccctcctcggctactgcaagatcggcgaggagcggctgctggtgtacgagttcatgagccacggcagcctggaggacacgctgcacggcgacggcggcagatcggcatcaccggcgatgtcgtgggagcagcggaagaaggtggcgcgcggcgcggcgaggggcctgtgcttcctccactacaactgcatcccccacatcatccaccgcgacatgaagtccagcaacgtgctcctcgacggcgacatggaggcgcgcgtcgccgacttcggcatggcccgcctcatcagcgcgctggacacgcacctgagcgtcagcacgctcgccgggacgccgggctacgtgccgccggagtactaccagagcttccggtgcacggtgaagggggacgtctactccttcggcgtcgtcctcctcgagctgctcaccggccgccgccccaccgacaaggacgacttcggggacaccaacctcgtgggctgggtcaagatgaaggtcggggacggcgccgggaaggaggtgctcgacccggagctcgtcgtcgagggcgccgacgccgacgagatggccaggttcatggacatggcgctgcagtgcgtcgacgacttcccctcaaagcgcccaaacatgctgcaggtggtcgccatgctcagggagctcgacgcgccgccgccggcaactgccatataa

SEQ ID NO: 24 - DNA, 3366 bp, Oryza sativa
  CDS (1)..(3366)
atggattccttgtgggcagcgatagcggcactgtttgtggcggcggcggtggtggtgaggggggcggcggcggccgacgacgcccagctgctcgaggagttcaggcaggcggtgccgaaccaggcggcgctcaaggggtggagcggcggcgacggcgcgtgcaggttcccgggggccgggtgccggaacgggaggctcacgtcgctgtcgctcgccggcgtgccgctcaatgccgagttccgcgccgtcgcggccaccctgctgcagctcggcagcgtcgaggtgctgagcctccgcggcgccaacgtcagcggcgcgctctcggcggctggcggcgcgaggtgcgggagcaagctgcaggcgctcgatttgtccgggaatgccgcgctccggggctccgtcgccgacgtggcggccctggccagcgcctgcggcggcctcaagacgctgaatctctccggcgatgcggttggtgcggcgaaggtcggtggcggtggtggcccgggctttgccgggctggactcgcttgatttgtccaacaacaagatcaccgacgatagcgacctccggtggatggtggatgccggagtcggggcagtacggtggttggaccttgccctgaacaggatctccggtgtcccggagttcaccaactgctccgggcttcagtaccttgacctctccggcaacctcatcgtcggtgaggtgcccggcggggcactttccgactgccgcggtctgaaagtgctcaacctctccttcaaccacctcgccggcgtgttccctccggacatcgccggcctcacgtcgctcaacgccctcaacctctccaacaacaacttctccggcgagctccccggcgaggctttcgcaaagctgcagcagcttacggcgctctccctctccttcaaccacttcaacggctccatcccggacaccgtagcctcgctgccggagctccagcagctcgacctcagctccaacaccttctccggcaccatcccgtcgtccctctgccaagatcccaactccaagctccatctgctgtaccttcagaacaactacctcaccggcggcatcccagacgccgtctccaactgcaccagcctcgtctccctcgacctcagcctcaactacatcaatgggtccatcccggcatccctcggcgaccttggcaacctgcaggacctcatcctgtggcagaacgagctggagggcgagataccggcgtccctgtcgcgcattcagggcctcgagcatctcatcctcgactacaacgggctcacgggtagcatcccgccggagctagccaagtgcaccaagctgaactggatttctttggcgagcaaccggctgtccgggccaatcccttcatggcttgggaagctcagctacttggctatcttgaagctcagcaacaattccttctcggggcctataccgccagagctcggtgactgccagagcttggtgtggctggacctgaatagcaatcagctgaatggatcaatacccaaagagctggccaaacagtctgggaagatgaatgttggcctcatagttggacggccttacgtttatcttcgcaacgacgagctgagcagcgagtgccgtggcaaggggagcttgctggagtttaccagcatccgacctgatgacctcagtcggatgccgagcaagaagctgtgcaacttcacaagaatgtatgtggggagcacggagtacaccttcaacaagaatggttcgatgatatttctcgatttgtcatataatcagctggactcggcgattcctggcgagctgggggacatgttctacctcatgatcatgaatcttgggcacaacctactgtcaggtaccatcccatcgcggctagcagaggccaagaagcttgcggtgcttgacctgtcgtataaccagttggaagggccaatacccaactctttctcggcactttccttgtcggagatcaatctgtcaaataatcagctgaatggaacaattccagagcttggttcccttgccacatttccgaagagccagtatgagaataacactggtttatgtggcttcccactgccaccatgtgaccatagttccccaagatcttccaatgaccaccaatcccaccggaggcaggcatcgatggcaagcagtatcgctatgggactgttattctcactgttctgtataattgtgatcatcatagccattgggagcaagcggcggaggctgaagaatgaggaggcgagtacctctcgtgatatatatattgatagcaggtcacattctgcaactatgaattctgattggaggcaaaatctctccggtacaaatcttcttagcatcaacctggctgcattcgagaagccattgcagaatctcaccctggctgatcttgttgaggccacaaatggcttccacatcgcatgccaaattgggtctggtgggtttggtgatgtctacaaggcacagctcaaggatgggaaggttgttgcaatcaagaagctaatacatgtgagcgggcagggtgaccgggagttcactgcagaaatggagaccattggcaagatcaaacaccgtaaccttgttccacttcttggctattgcaaggctggtgaggagcggttgttggtgtatgattacatgaagtttggcagcttggaggatgtgttgcatgaccgcaaaaagatcggtaaaaagctgaattgggaggcaagacggaaaatcgctgttggagcagcaaggggtttggcattcctccaccacaattgcattcctcacatcattcaccgagacatgaagtcgagcaatgtgcttatcgatgaacaactggaagcaagggtatctgatttcggtatggcgaggctgatgagcgtggtggatacacaccttagcgtgtccactcttgctggaacgccagggtatgtaccaccggagtactaccagagcttcagatgcaccaccaagggtgatgtttatagctatggtgttgtgttgctggagctgctcaccgggaaaccgccgacggactcggcagactttggcgaggacaataaccttgtggggtgggtcaagcagcacaccaaattgaagatcacggatgtcttcgaccctgagctactcaaggaggatccatccgtcgagcttgagctgctggagcatttgaaaatcgcctgtgcgtgcttggatgaccggccgtcgaggcggccgacgatgctgaaggtgatggcaatgttcaaggagatccaagctgggtcgacggtcgactcgaagacctcgtcggcggcagcgggctcgatcgatgagggaggctatggggtccttgacatgcccctcagggaagccaaggaggagaaggattag

SEQ ID NO: 25 - DNA, 1686 bp, Oryza sativa
  CDS (1)..(1686)
atggcagatctgcaggagcccctcgttcgtccgaagaggaagaaggttttggtggactacttggtaaagttccgatggattctggtgatctttgtggtgctccccatttccgctctgatctacttcaatatctatttgggcgatgtctggtctgccatgaaatctgagaaacgtcgccagaaggaacatgatgacaatgtgcaaaaagttgtgaagcggctcaagcagaggaacccaaagaaggatggccttgtttgcacagctaggaagccctggattgctgttggcatgcgcaatgtagactacaagcgtgctaggcattttgaggttgacctttccgccttcaggaacattcttgagattgacagagagagaatggttgccaaggttgagcctcttgtcaacatgggccagataaccagagctacatgcccaatgaaccttgcccttgcagttgttgctgagcttgatgaccttactgttgggggactgatcaatgggtatggtattgaagggagctctcacctctatggtcttttctctgacactgttgtcgccgtggaagttgttcttgcagacggtcgagttgttagagccactaaggataatgagtactctgaccttttctatggcattccctggtcccagggaacacttgggtttcttgtttccgctgagatcaaactcattcccatcaaggaatacatgaggctcacatatactccagttaaagggtcactgaaggagatagcacaaggttattgtgattcgtttgcaccacgagatggtgatcctgcaaaggtcccagacttcgttgagggaatggtgtacacagaaaatgagggtgtcatgatgactggtgtttatgcttccaaagaagaggcaaagaagaagggcaataagatcaactgtgtcgggtggtggttcaagccttggttttaccaacatgctcagacagcactcaagaagggtgagtttgtggagtacattccaacaagagagtactaccaccgtcacacccggtgtctgtactgggaggggaagctgatcttgccattcggcgaccaattctggttcaggttcctcttgggctggctgatgccaccaaaggtgtctctgctcaaggccacacagggtgaatctatcaggaattactaccatgacaaccatgtgattcaagacatgctggttcccttgtacaaagttggagatgctcttgagtttgttcacaaggaaatggaggtttatccactgtggctgtgcccgcaccggctctacaagctccctgtgaaaaccatggtgtacccagagcctggctttgagcaccaccacaggcaaggtgacactagctatgcccagatgttcaccgatgttggtgtgtactatgctcctggtgctgtcctgaggggcgaggagttcaatggcgctctagctgtccacaggctggagcagtggctgattgagaaccacagctaccagccacagtacgctgtatctgagctcaacgagaaggacttctggaggatgtttgatgcttctcactacgagcattgccgccaaaagtatggtgccgtcggtacctttatgagcgtctactacaagtccaagaagggaaggaagactgagaaggaggtgcaggaagccgaggccgccatcctcgagccagcctacgctgatgaggcgtaa

SEQ ID NO: 26 - DNA, 2056 bp, Zea mays
  CDS (138)..(1823)
attcggctcgagcgcaggcagcatctgcatctctcgcccacctccgctccgcctactgctgctggtggtagggaggcggagaaggaggcccttgcgcccgcccgccggccggatcagagccgtagcaaccaccacccatggcggacgtgcacgaacctttggtgcgccgtaagaggaagaaggttttggtggactacttggtgaagttccgatggatcctcgtgatcttcgtggtccttcctatttcaactctgatctacttcaacatcttcctgggcgacatgtggtccgccatgaagtcggagaagaagcgccagaagcagcacgacgagaacgtgcagaaggtcgtgaagcggctcaagcagaggaacccgaagaaggacggtcttgtttgcacggccaggaagccctggatcgctgttggcatgcgcaacgtggactacaagcgtgcgaggcatttcgaggtcgacctttcttccttcaggaacatccttgagatcgacaaagagaggatggttgccaaggtcgagccccttgtcaacatgggtcagataaccagagctacctgcccaatgaaccttgcccttgcggtcgtcgccgagctcgacgacctcactgttggtgggctgatcaacggttacggcatcgaggggagctctcacctctatggccttttctccgacacggttgtcgcgatggaggttgttctcgcagatggccgggtcgtcagagccaccaaggacaacgagtactctgaccttttctatggcattccctggtcccagggaacactggggttccttgtctctgcggagatcaagctgatccccatcaaggagtacatgaagctcacctacactccagtcaaggggggtctaaaggagatcgcgcaggcctacgcggattctttcgcgccgagggacggtgacccggcaaaggtccctgactttgttgaagggatggtgtacacagagagcgagggtgtcatgatgacgggcgtgtacgcttccaaagaagaggcgaagaagaagggcaacaagatcaactgcgtggggtggtggtttaagccctggttctaccagcacgctcagacggcgctgaagaggggcgagtttgtggagtacatcccgacgagggagtactaccaccggcacacccggtgcctgtactgggaggggaagctgatcctgcccttcggcgaccagttctggttcaggttcctgctgggctggctgatgccaccgaaggtgtccctgctgaaggcgacccagggcgaggctatcaggaactactaccacgacaaccatgtgatccaggacatgctggtgccgctgtacaaggttggggatgcgctggagttcgtgcaccgcgagatggaggtgtatcctctgtggctgtgccctcaccggctgtacaagctgccggtgaagacgatggtgtacccggagcctgggttcgagcaccagcacaggcagggcgacacgagctacgcacagatgttcacggacgtgggcgtgtactacgcccccggggcggtgctgaggggggaggagttcaacggcgcggaggctgtgcacaggctggagcagtggctgatcgagaaccacagctaccagccgcagtacgcggtgtcggagctgaacgagaaggacttctggcgcatgttcgacgcgtcgcactacgagcactgccgccaaaagtacggggcggtgggcacgttcatgagcgtgtactacaagtccaagaaggggcgcaagacggagaaggaggtgcaggaggcggaggcggccatactggagccggcctacgcggacgaggaggcctaaaagctcgtggtcgttttgcttagcccattttaattagaacttgatggatgtagtgtgtgtctgtctcaagtcattttaattagaactcttaaagctcgtggtcggtcggtcagtcagtcagtcattgtcgttgatgtccagcgttgtgttttttttatattctctaatggaatctctcagattgattcgggaaaaaaaaaaaaaaaaaaaaaaaaaaaaaaaaaaaaagg

SEQ ID NO: 27 - DNA, 717 bp, Oryza sativa
  CDS (1)..(717)
atggcgggcggcggcggcgagtacctgcgccagttcgtcgaggagacggcctggtacaacgagatcttcctcagccatgtggtcccgggcgactggtggcgcgccctcccccacccgctccagtcgtggctccgcaacggcctcggcggctacctcatctacttcgcctgcggcttcctctggtgcttcgtcatctactactggaagcgccacgcctacatccccaaagattctatacctacaatcgaagctatgaagaagcaaataattgttgcatcaaaggctatgcctctctattgtgcccttccaaccttatctgagtacatggttgagaatggatggacacagtgttatgttaatatcagtgaagttggttggccaatgtacctggtttatctggctttatatcttatctttgttgagtttggaatttactggatgcacagagagttgcatgacataaagccattgtacaagtacctgcacacataccaccatatttacaacaaggagaataccctatcaccatttgcagaggccgtgtggacaactaacatccatgactgcattcacggcaaggtttggccggtcatgggtgctggctatcacaccattcaccatacaacataccgtcacaactatggccactacaccgtgtggatggactggatgttcggcacccttcgagagccagaagatatcttgaagaaggattag

SEQ ID NO: 28 - DNA, 1112 bp, Zea mays
  CDS (60)..(881)
caactccccaccccagccgatcccaacgcacactgcacccagtgcggcggccgccggcaatggcggtgcacggcggcgactacttgcggcggttcgttgcggagacggagtggtacaacgaggtcgtcctcaacgccgtggcgccaggcgactggtggcgcggcctgccgcacccggtgcagtcgtggatgcgcaactgtgtcggcggttacctcctctacttcatctctggtttcctctggtgtttcgtcatctactactggaagcgccacgcctacatccccaaagatgccatccccacaaatgaagctatgaagaagcaaatagctgtagcatccaaggctatgcctttttactgtgctcttccaactttatctgagtatatgatcgagagcggatggacccggtgttactttaatatcagcgaaatgggtttttctgcgtacctttgttatatggctatgtatctcatttttgtggagtttggaatttactggatgcacagagagttgcatgacataaagccactatacaaacatctgcatgcgacccaccatatttacaacaaggagaacaccttgtctccgtttgctggactcgcgtttcacccactggatggtattctgcaagcgataccgcatgtgcttgcgctcttcctcctcccaacgcacttcaggacgcacatcgctctcgtgttcttggagggcgtgtggacgacaaacatccacgactgcattcacggcaaggtatggccagtcatgggcgctgggtatcacaccatccaccatacgacttaccgccacaactatggccactacaccgtctggatggactggatgtttggtacgctccgtgagccagatgatatcctcaagaaggcctgagttcgtcgtagctgtggttttcctacggtgctggatgtgcttggtctgttctgtccccagtgcctctaatccgctgagcctgttcagcgctctgtttctgtaggctttggtgtgctatttagtttgctaggtttatatgttgtgcttattctgtaatttagtgatgtttgtctgatgacgcaacggagttcaggacgaataaagaaagatttgctagacaaaaaaaaa

SEQ ID NO: 29 - DNA, 1214 bp, Zea mays
  CDS (43)..(870)
cacacacacttcacccagcgcggcggccgccggccgccggcaatggaggccgtggcgcgcagcggcgactacctttggcggttcgtggcggagacagagtggtacaacgaggttgtcctcagcgccgtggcgccaggcgactggtggcgcggcctgccgcacccggtgcagtcatggatgcgcaactgcgtcggcggttacctcctctacttcatctctggtttcctctggtgcttcgtcatctactactggaagcgccacgcctacatccccaaagatgccatccccacaaatgaagctatgaagaagcaaatagttgtagcatcgaaggctatgcctttttactgcgctcttccaactttatctgaatatatgattgagagcggatggactcggtgctacttcaatatcagcgaaattggtttttctatgtacctctgttatatggctatgtatctcatctttgtggagtttggaatttactggatgcacagggagttgcatgacataaaaccattatacaaatatctgcatgcaacccaccatatttacaacaaggagaataccttgtctccatttgctggacttgcatttcatccactggatggtattctgcaagcaataccgcatgtgttcgcgctcttcctctttccaacacacttcaggacacatattgcactcttgttcctagaggctgtgtggacaacaaacatccacgactgcattcatggcaagatatggccagtcatgggcgctggatatcacaccattcaccatacgacttaccgccacaactatggccactacaccatctggatggactggatgtttggtacgctcaatgagccagaagatatcctcaagaaggcttgagtttctcggagctgtggtatccctatggtgctggtgctggaactgctcgatctgttcccagtgtttctaatccgttgagcctgttcagcactgtctgtttatgtaggcatcagtgtgttaattagtttgctaggttcatatggctttgtgcttattctgtaatttagtgatgtttgtctcatgacgcaacggagttcaggacgaataaaactttgctagacacattctggattccagttgcttgtacaatgttgcaactcaactgtcaatataggatgtaaaacggattccttctaaaaaaaaaaaaaaaaaaaaaaaaaaaaaaaaaaaaaaaaaaaaaa

SEQ ID NO: 30 - DNA, 1313 bp, Glycine max
  CDS (158)..(1006)
gataaaaggagatccaaagtaaagaacacagatggcatgacaccacgaaaccaaattaaaaactgcgccttctctgtctctgtttgttcttctcactttatattctctctctgtgtatatctcttcactcttattattccttctcttctcaacgacgatggaggacccatcagcagcaacaacgttgttgctgaacagcgaatattcgaggctgttcgtcgaggacacggacttgtacaatcgcattgtgttgggaaccctcttgccgcacttcgtgtggggcccactcccgcacttcctccagacgtggcttcgcaattacctcggcggcgtcctcctctacctcctctccggcctcctgtggtgcttctacatttattattggaagcgcaacgtttatgttcccaaagatgctattccctctcgaagagccatgctcttgcaaatatctgttgctatgaaagccatgccttggtacactttgcttccaactgtttcggagtacctggtagaaactggctggacaaagtgctatcctagattatataatgttggttggcttgcataccttgtgtatttagcaatttatctaagtattgtagagtttggtatttattggatgcacagagaactgcacgacataaaaccgctttacaaatatcttcatgctacccatcacatctacaataaacagaacactctctccccttttgctggtttggcatttcaccctcttgatgggatacttcaggcattacctcatagcctttgtttgttttttatgccaatccattttactacacatttagtcctcatattcattgagggcatttggactgctaatattcatgattgcattcatggaaaattgtggcctgttatgggtgctggttaccacaccattcaccacactacatatcggcacaactatggccactacaccatatggatggattggctatttggaactcttcacaaccccgaggaggacgagggcaaggctatgtgatgaattgcagacttacattggcagtcatttattatcatgtttggattgttgaaatgtgcttacttgcatgtaaagcataaatgtgttagctatatttttctggtgtttcatcacaaggtgatggctctatattagagagacagggttgagggttaaagtggagcttccctgtctctaatcccattgttagtgtatgtgattgaggttattttctttctcaaattgtgtggtagagttgagatagtaatgcagttttttcttttttgaaggtaatgcagttttctctaaaaaaaaaaaaaaaaaa

SEQ ID NO: 31 - DNA, 1982 bp, Oryza sativa
  CDS (78)..(1490)
cctcgtcgctgcgttgtgtttgtgctgctgcattgcgacattccgatcggagcttagcttagctttcgtcgtcgcgaatggcgacgcgagggcggattgtagcggcggtggcgagcgttgtggtggcgtggctggcggtcgccgtcggcgtgaacggcggcgggtgcgaggcggagcgggaccgggtggaggcgctgccggggcagccaccggtggcgttcgcgcagtacgccgggtacgtggcggtgagcgaggcgagcgggcgggcgctcttctactggctcaccgaggccgccgccgccgccgccgccaccaagccccgcgcccgctggctcttccccggtcctggatgctcatcgattgcgtatggagcatctgaagagattggcccatttaggattaagacaaacgggacagggctctatctgaacaagtactcatggaacagagaggcaaacctcctgttcctggaatcacctgccggagttggcttttcatactccaacaccacctctgatctcaagacatctggtgatgagaggacagctcaagatgcgttgcagttcttgatcagttggatgtcccgcttcccacagtatcggcaccgggatttctacattgctggagaaagctatgctggacattacgttccccagttggcaaggaagatcgttgagttcaacaaggcctcaccatatcctttcatcaacctcaaggggatccttgtgggcaatggggtgactgacaactactacgacaacatcggcacggtgacctactggtggacgcacgccatgatctcggacaccacctacaaggccatcatgtcgtcgtgcaacttcaccagcgccaacgtctccaggctctgcaaccgcgccatgagctacgccatgaaccacgagttcggcgacatcgaccagtacagcatctacacgccgtcctgcgccgccgccgccgccaacgccaccggccgccgccgcggcaaggccgccgtgctgaggttcaaggacaccttcctacggcgccggtcgttcggctacgacccctgcacggagacatacgccgagaagtactacaaccggccggatgttcagaaggccatgcatgccaacatcactgggattccttacagatggacagcctgcagtgatgtgctcatcaagacgtggcgagattcagagttctccatgctgccgacttacaagttgctgatgaaggccgggctgaggatatgggtgttcagtggcgacacggattcggtcgttccggttactgcgacgaggtttgcgcttagccatcttggactgaagacgaagatccgctggtacccttggtactcagctggacaggttggaggatggtctgaggtgtatgaagggctcacatttgcgtcagtgagaggtgctgggcatgaggtgccactgtttcagccaaggagagcattcaggatgtttcagtcgttcttggcaggggagccattgccaaaatcctgatggtttcctgccaacaactgatgtctagctacaaagtctagaaatctgtaaaagatgcttggtagaggtgcagtgtagttgataggtgaggagtgtgattgattggtgttgggaaaaggataataagagaataaggatggttgtgccatggaaaccatgggcatcgcaacaaggagctaataaacttgaagccttccgctctgtttaccactaaggttccatttggattggaggaatttcgctggaattttagaggaactgaactatttcctgtgaaaatcctataaaattcctgtgctctgaaggaaccctgagcaattatctcatcgaaaaagaatatatcatgtacgcaattcaacgcaaaagggagccatgaagtaatttgctgaatatagccatgtatagtgtcaccagtaacggaagtacctttatttatcatgaaaataagttccctgacatacagggataacatgcaaaaaaaaaaaaaaa

SEQ ID NO: 32 - DNA, 1906 bp, Zea mays
  CDS (109)..(1548)
ccggccgggccggggttcacacaccgtcgcgagctagctagccacaccacaccttcctcctcactcccaattccatatagttcctctgcccacgcgcgcacaaaggccatggcgacgacgcggcctcgcggtgggggtggggcggcgagcggcgcgctggtcatggcgatcgtcgtgctgctgctactgccgccatatggagccggcgcggaggagtgcgaggacggcggcatcagcagccgggcgcgcgcgggcgaccgcgtggaggcgctgccggggcagccggcggtggcgttcgcgcagtactccgggtacgtggcggtggaccgggaccgcggccgcgcgctcttctactggctcaccgaggccgtcggcgacgacgcggccgccaagcccctcgtgctctggctcaacggaggtcctggatgctcgtcggtggcgtatggagcgtcggaggagatcggcccgttccggatcaaaccaaacgggacaggcctgttcctcaacaagtactcatggaacagagaggcaaaccttctgttcctcgagtcgcccgcgggagtcggcttctcctacgccaacaccacctcggacctcaagacgtcgggcgacgagaggaccgctcaagacgcgctgcagttcctggtcagctggatgtcacggttcccgcagtaccggcaccgagatttctacatcgccggagaaagctacgcgggccactacgtcccccagttggcaaggaagatcgtcgagtacaacgaggcctcgcctcaccccttcatcaacctcaagggaatccttgtgggcaacgcggggaccgacaactactacgacaacatcggcacggtcacctactggtggacgcacgccatgatctccgaccgcacctacaaggccatcctcaggtggtgcaacttcagcagcagcagcatctcgcgcccctgcaaccgcgccatgagctacgccatgaaccacgagttcggggacatcgaccagtacagcatctacacgccgtcgtgcgccgccgcggccagggccattcggctcgagctcaggttcaagaacaccctcgtccgccgccgccgctcctccggctacgacccctgcacggagacctacgccgagaggtactacaacaggatggacgtgcagagggcgatgcacgccaacaccacggggatcccctacagatggactgcctgcagtgatgtgctgatcaagacatggcaagattcagagttctccatgctgccgacgtacaagaagctgatgaaagcaggactgaggatatgggtgttcagcggcgacacagattcagtcgtcccggtgaccgcgacgaggttcgccatcagtcatctcggtctgaagatcaagacccgctggtatccgtggtactcagctggacaggtaggaggatggtctgaggtgtacgaagggctcacgtttgcgtcggtgagaggcgcagggcatgaggtgccgttgttccagccccggagggcgttcaggatgttccggtcgttcttggccggggagccattgcccaagtcctgaaggttcctcacatgtgactgaggccatgcatgcctacctgatcatgtctagctacggtcctgacgggtgagaaggtgacgttccccaggtagagaatgacttgttgataggcgcgcagttcatagctgaggagtgattgattggtctcgggagaaggatgtagagaataataaggatggctatgttatgccatggaaacccatgagcattgcaatgattagcgaataattttcagtgatctcactctcaagtgcttatgttatgttatgttatgttatgccatggaaacccatgagcaatgcgacgaataaatttgaaggatctcactcttgaaccaaaaaaaaaaaaaaaaaag

SEQ ID NO: 33 - DNA, 1593 bp, Oryza sativa
  CDS (235)..(1227)
cgacgacgcctccctcgtacgccggcgctctcgcagttgccgccgccgccgcgaacgcccaccgcccgcgctctggtcggtggatcgtgacgtgctgtggtggtctctgatctgctctgggggtgggtgggcgtctcgcggagtcgccgtgttcgtcgagggctcgatcggctcggggagagcgagtgagaagaggtgagggttggggggaggcacatccgcggcggcggagagatggcggatttccggacctccacgcatcgggagaggtggatcttccagacgaacgatctgatggatagatggggggcggcgaaccagcgggccacggagacgctcgttcagtatggaacgacgcggttgaaggtggaccctgttgatgggtcgctgtcatacccggaacctgcgcctgatcatgttgtagggagctcaggtgtaaagcctctgtcttgtgaagaggagcgattgatgcgggtattttatgagcaaaagattcaagaagtatgttcagcatttaagttccctcacaaaatccaggctaccgcaataatatatttcaagagattttatctgcaatggtctgtaatggaacatcacccaaagcatattatgttaacttgtatttattcttcttgcaaagtggaagaaaatcatgtttctgctgaggaacttggtaaaggaattcaacaggaccaccagattattctaaataacgagatgattgttctcaaatctttagattttgatctgattgtttatgctccgtatcgatctatcgaaggatttgttgatgacatggaggatttctgcagagcaggtaatggtgagcaccaacggttgcaggatttacgtcaaactgcgatatctcaggttgacaaaatgatgttgactgacgctcctcttctctacactcctggacagttggctctggctgctttgcacaaatccaatgatatgcacaagatccttaattttgaaaggtacttggaaagtgttttttcaaggcaacattctgattgtccaatcgaacaatttgttgggtcaatcaatatgatcaattatttggttgagcagcttaaaatacctactcctaaggacatgaggcatattgaccgcaagcttaagcattgtttggatccaagctcacaggatgagcataagaagaaagagaagaagtcgaagcacaaatcaaaaagggcagctaatgaagcccaacttgacagctagaaaacatacggttgggctgcaccgtgtaagaatcagttctttagtttgttgtggctccaattgatcaaaagagctactttcctgagcaggtgaggttccgttttagccgaggacaaccaattttgagatgaagcgagataatacccatgacctcgccttcttgtaatcttgtatgcctggaagccctagcaaactcctcgttgcaatggctactgtactttttttggggggtaatttatcccttgtcaaatgggaagaagcagcatacatcggatgattgcctccatatacgaaaatgacagctaactcagacttttgtcggttgcatttttctgtttaaaaaaaaaaaaaaaaaaaaaaaaaaaa

SEQ ID NO: 34 - DNA, 1764 bp, Oryza sativa
  CDS (173)..(1447)
cgcgcatcgcagccgagacgagccgccccccgcaccgcactctccgccgccggccgcgccgacctcctccgccgcgccgcctccccggcgcgcgcccccgtcaccctctctcgcctcgccgccgccgccgctgcctcctcgtgaggggggacggtggtgggggcctctgcctatggcgagcggcgacggcggcgacgacgcgggcgtgaagcgcgtggcggaccgctacctgaagcgcgaggtcctgggagagggaacctacggcgtcgtcttcaaggccgtcgacaccaagactgggaatacagtcgcaataaagaaaatccggctagggaagtacaaggaaggtgtcaatttcactgcattgagggaaattaaacttcttaaggagctgaaagattctaatattatagagctgattgatgctttcccttacaagggaaacttacatcttgtatttgagttcatggagactgatttggaagctgtcatacgagataggaacattgtattatctccagctgatacaaaatcttatattcagatgatgttaaaaggtttagccttctgccataagaaatgggtgctacacagggatatgaaaccaaataatttactcattggcgctgatgggcagcttaagcttgctgactttggtctggcgcgcatatttgggagtccagagcggaacttcactcatcaggtctttgcacgatggtaccgagcaccagaattattatttggcaccaagcagtatggatctgcagttgatatttgggctgctggttgtatttttgctgaactgctgcttaggcgaccgtttctccagggttctagtgacattgatcaacttgggaagatctttgctgcatttggaactccaaagtcttctcaatggccggacatggtttatcttccagattatgttgaataccaatttgtctctgcacctccacttcgctcattgtttccaatggccagtgatgatgcattggatcttctatcaagaatgtttacatatgatccaaaagcaagaattacagctcagcaggctctagaacaccggtactttttatcagtaccagcgccaacaaaaccatcacagcttccaaggccaccacctaagggtgattcagggaataacaagataccagacttgaacctgcaggacggccctgttgttctgtccccgccaagaaagttgcgcagggtgactgcccatgaagggatggaagtccatatgcatcgggcggatagaacagaagagcatccttcaggggcaaggcacatggatgacatgtccagccagagttctagaataccaatgtcagttgatgttggagctatttttgggacacgacctgctcctagaccaacgttaaacagtgccgacaagtctcgtttaaaacggaaacttgatatggatccagaatttggatacacagagtaaatcaccattttttccatactggcttgttgatttttaaaatattctttggggagatagttccactatctaccaacaaaagaggattgtgtcgaaagccataaaaacttcactgaagggcgctgacaggatggcacagccaactatgctgttatcgtttttgactaccaaagccggctcaggaagaggaaactgaagagttacgtgttacgatgctaatttacaccaggacgtgcacatgccatttcattttggctggcatacataaatctgtaatctttattgcatagatgagtttgcttgtgtgagcatgtttcttc

SEQ ID NO: 35 - DNA, 1583 bp, Glycine max
  CDS (14)..(1240)
attcggctcgaggatggatcctccaccgaagagctggagcatccacacccgatccgagatcatcgcaaaatacgaggtcatggagcgggtcgggtcgggagcctacgccgacgtctaccgtggccgtcgcctctccgacggcctcaccgtggccctcaaggaaatccacgactaccagtccgccttccgagaaatcgacgcgttgcagctcctcgagggctccccaaacgtcgtggttttgcacgagtacttctggcgcgaagacgaggacgccgtcctcgtccttgagttcctcagaaccgacttggccaccgtcatcgccgacaccgccaaggccaaccagcccctccccgccggcgagctcaagtgctggatgatccagattctctccggcctcgacgcctgtcaccgccacatggtcctccaccgagatttgaagccctctaatctcttaatttccgaacacggcctcctcaagatcgctgattttggacaggcaagaattctcatggagcctggtattgatgcttctaataatcatgaagaatattctagagttttagatgacattgacaataaggatactattactagcacccacgatgggaatgcaacatgcaacacaagtgacgtagatagggaagaggaagaacttggttgttttacgtcatgcgttgggactcgttggtttagggctcctgagttgctttatggatcaagaaactatggtttagaggttgatttgtggtccttgggatgtatctttgcagagcttttaacgctgcaacctttgtttcctggaactgctgatattgaccagcttagtagaatcattggtgttttgggtaaccttgatgagaatgcttgggctgcttgttctaaacttcctgattatgggataatctcctttagcaaggtggagaaccctgctggtcttgaagcttgtttgcccaatcggtcccctgatgaagtggctctggtgaaaaaactggtttgttatgatcctgccaagagggccacggcgatggagctgcttcatgacaagtactttagtgatgagcctcttcctgttctggtttctgagctgcgagttcctctgaccagaaaagagcaagatggggattcccctggtgggtggggtgatatcaacgatatggattccgattccgattcccagtttgatgagtttggccctctgaatatcacaaggactggtactggtttctccatacagtttccttgaagaattcaaggtacattgtattcttggaactgcctttttgccttttctgtcgtgttgctcaactgttactatttgctggaaattcttcggtgagaatattgataagaaaaatccctttttttttttctgatttgtcattcacttgtgaacaaagggataaattattcaaaagtaattagaatgattgtgtgtttacatgacattcatagttgaccatgacactcacagttgatagtttatataatacatggacttgtatccttccaaattcacacatataatgatagcacgtactatagttatttttgtgttaaaaaaaaaaaaaaaaaaaaaaaaaggc

SEQ ID NO: 36 - DNA, 964 bp, Zea mays
  CDS (164)..(745)
cggacgcgtgggtgccgttgaggcataccgcatacgtttctcccccattcctctccccactccgaaccctagccaccgtgctcacttcccaggtcgaacccgccgcggcgcgagtccacggcagtgcaggacctgatcctgcggtctaggccgcggcggtgagatggtgatggtgtcaggcggcggggggaacgcgtgggcgaaggagatgaccctccgccgcaggatagccagcatattcaacaagacgcaggaacacttccctactctgaaagactacaacgattatctggaagaagttgaggatatgactttcaacctgatcgaagggatagatgtcgaggagattgaagcaaaaattgcaagataccaacaggaaaatgcggagcagatatacttgtccagagctaaaagggcggaagatcttgcggcagcacttaaagcaagcaggatgaaccctgtaaaggccgaagcaaatgatacggctgctgggagttctcagggtattagtggcggggcaggagttcagggccagtatgcacctgccgctgttcttgggggagtggctcagcctcgccccacaggtatggcgccccaactaatcggcagtgggtcggatcctctgcaaggagacgacgaggagaccaggagactacgcgcagagcgagcagcacgggctggcggatggactgctgaattgagcaagagaagagcgctggaggaggcgtttagcgccatattcatctaggattagatcaaaaagcaacacatggcctggaggaaagccagcatacttaaaatggctgtcaaactacaaagcgttggatgatctgtgtcgtgattatctttgggacatggaattctcacaaattgtggtgaagcaccctttgtgtgcctttggttgcaaaaaaaaaaaaaaaaaaaaaaaaaaaaaaaaaaaaaaaaaaaaaaaaaaaaaaaaaaa

SEQ ID NO: 37 - DNA, 1961 bp, Zea mays
  CDS (198)..(1484)
ttcgcccttctactctgggctcagcggccgcccgggcaggtgccaaaagtccggaccacagctcgcgccgcccgccgcgccttgcccagacgtgcgctcccttctcccgcgccgtcgcctctgccctggccgacccgctgggcccagtgtgcgcagccctcccgggttaaggcggaggtgcttggggacccgctcccatggcgagcgccggcatcagcggcagcggggacgacgatgcaggagggaagctcttggcggatcgctaccagaagggcgaggtcctcggcgagggcacgtacggagtcgtcttcaaggccttcgacaccaagactggaaatacagtcgcggtaaagagaatctgggtagggaaggacaagaaggaaggtgttaacttcaccacattgagggaaattagactacttaaggagctgaaaggtcctaatattatagagctgattgattgtttcccttacaaggaaaatttgcaccttgtatttgagtttatggaaactgatctggaagctctcataaaagataagaacataatactgtctccagctgacacaaaatcatatctccagatgctgttaaaaggtctatcgttctgtcataagaaatgggtgatacacagggatatgaagccaaataatttactcattggtgccgatgggcagctcaagcttgctgactttggtctggcccggatgtttgggagtccaggaaggaacttcactcaccaggtctttgcacgttggtaccgggcaccagaattattatttggttcgaagcagtatggatctggggtggatatttgggccgctggatgtatttttgctgaactgcttactcgcagagcctttctccagggttctagtgacattgatcaacttgggaagattttcgcagcacttgggaccccaaaatcttctcaatggcctgacatggtttatcttcctgattatgttgaataccaatatgttgctgcaccaccgctacgtacattgcttccgatggccagtgatgatgctttggatcttttgtcaaaaatgcttacgtatgatccaaaagcaagaatcagtgctcagcaggctctagagcacaggtacttttcatcgttacctgctccaacaagaccatcacagcttctaaggtcacggtggaaaggagatcaagggaataacaagatgcccgatctgaacctgcagcatggccctctggtgctctctccgccaagaaagctacgtagggtgatagcgcatgaatggatggaaggtatgcacagggcagataaagtggacgagcatccttctgggatgaggcacaccgatgacatgcccagtcagaagagttctagaattccaatgtcagttgatgttggagctgtgtttggcacacgacctgcacctaggccaacattgaacagtgcggacaagtctcgtttaaaacggaaacttgatatggatccagagtttggatttgcggagtaaaagaaactttgttaacatgcaccattcttttcttactgagatgttggtttcgaaaatattctttgggagatatttccacagttcactcagaaaagaggatttgcattgaagccacaaaactgcaccgaaggattctgacacaatcaactgggctgttaccgacatcggctcacgaagaggaaaacaaaggagaggccattctaatttatcctgagtcgcatggggcattatagctaaccgattccgtaaagaaggctcttagaaacagcatgctctatgccatgcgagtggagagtgttatgtggaattgggggcatagaaacgctcgctccagttagaaatgtgtgtttgtgctaaatgtgatctactagtcctccattctccgtggtttcaatttccttcaattcttgtacggacacttaggtttgagcattcttcactcagtcactttacgtataaaaaaaaaaaaaaaaa

SEQ ID NO: 38 - DNA, 6440 bp, Saccharomyces cerevisiae
  CDS (1552)..(6087)
tagttttctatggtggagtgaagcacagcagaaagaacgttaggaaccttagctaaaagatagaaaaaaagagcactacaaaaatcttatcctcgatttgaaatactaatgtcgagccagatcaaattaaatgaaatcgaaatgatataacgttgctcttgcacgtgtatttcgctgcttaggaaagttgtttccacatattatcttttgtacgattttaaacagtaaaatcgatgcatattaagggaggcccaatacccgcgggcagtaaccgcatctttggaaataccgggtaataataaatgcccgggaaaaaagagcataaaacagagaggcgatataggaatgaatatgtgctatttacggaagggaaaaacacttattgtttttctgaaatgtgacacagtaaagtccgtcatatacggttctccgttgggcgctaccacacacatatatataagcctgaatgcagtagacaaatttcagatatcatacaaaggaagcgttctctgggacccctttctatgtttagatggttcactgaacttgttcgttaacgtaaatatgtcttcctctttgattccaacaatgatattataaggaaattatcgtcacaatctaatcaacaaggacaaagaaaagaaaaagttgagagagagaacaaaagttcaaatcaaagaaaaaaaagaacatcaaattacctattacaataaacaattaagccatactcgcaacaatttgccataatagaaagcagcacctcgttggcgcagtcccttacatagtacacaacatttatcacttcacacaatcaggagtggaactcaatggaaaacaacaccacacgtatgatcttactaataaaagaacatgaacgttcctcagcgcgaacgttcgcattctgcgccttcgagcacaggataagttgcaggaagccatcacatctatgcaacgattatcacgacacaaccttgccgccgagaaaacgtccgtggagaaccattcggtcgattgcttcccacggaacgagtggactgaaacttaagactgcccctctctttccgcggaatcgctcatgccgcggtgccacaacattttcagatttactaagactccggtgagtgtgggctcacccgcgggtcgtgatcacgattcagcaccctttggactcgtgattccgtggaaaggtcagatctgtattcctacttatggtaatgtgctaaaaaaagagaaatgtctccgcggaactcttctacgccgtggtacgatatctgttgaacgtaatctgagcaatacaaacaaggcctctcctatacatatataattgtgatgtgcataaccttatggctgttcgcttttattatcataccttagaatgaaatccaaaagaaaaaagtcacgcaaagttgcaaacatataacaactgtgttagttatcactcgactttgttattctaattataaataaattggcaactaggaactttcgaaaaagaaattaaagacccttttaagttttcgtatccgctcgttcgaaagactttagacaaaaatgcccgaggccaagcttaacaataacgtcaacgacgttactagctactcctccgcgtcttcttctactgaaaacgctgctgatctacacaattataatgggttcgatgagcatacagaagctcgaatccaaaaactggcaaggactctgaccgcacagagtatgcaaaactccactcaatcggcacccaacaaaagtgatgctcagtctatattttctagcggtgtggaaggtgtaaacccgatattctctgatcctgaagctccaggctatgacccaaaattggaccccaactccgaaaatttttctagtgccgcctgggttaagaatatggctcacctaagtgcggcagaccctgacttttataagccttattccttaggttgcgcttggaagaacttaagtgcttctggtgcttccgcagatgtcgcctatcagtcaactgtggttaatattccatacaaaatcctaaaaagtgggctgagaaagtttcaacgttctaaagaaaccaatactttccaaatcttgaaaccaatggatggttgcctaaacccaggtgaattgctagtcgttttaggtagaccaggctctggctgtactactttattaaaatccatctcttcaaatactcatggttttgatcttggtgcagatactaaaatttcttacagcggctactcaggtgatgatattaagaaacattttcgtggtgaagttgtttacaacgcagaagctgatgtacatctgcctcatttaacagtcttcgaaactttggttacagtagcgaggttgaaaaccccacagaaccgtatcaagggtgtcgatagggaaagttatgcgaatcatttggcggaagtagcaatggcaacgtacggtttatcgcatacaaggaatacaaaagttggtaacgacatcgtcagaggtgtttccggtggtgaaaggaagcgtgtctccattgctgaagtctccatctgtggatccaaatttcaatgctgggataatgctacaaggggtttggattccgctaccgctttggaatttattcgtgccttaaagactcaagctgatatttccaatacatctgccacagtggccatctatcaatgttctcaagatgcgtacgacttgttcaataaagtctgtgttttggatgatggttatcagatctactatggccccgccgataaggccaagaagtactttgaagatatggggtatgtttgtccaagcagacaaaccaccgcagattttttgacctcagttacaagtccctctgagagaaccctgaacaaagatatgctaaaaaaaggtattcatataccacagaccccgaaggaaatgaacgattactgggtaaaatctccaaattacaaagagctaatgaaagaagtcgaccaacgattattgaatgacgatgaagcaagccgtgaagctattaaggaagcccacattgctaagcagtccaagagagcaagaccttcctctccttatactgtcagctacatgatgcaagttaaatacctattaatcagaaatatgtggagactgcgaaataatatcgggtttacattatttatgattttgggtaactgtagtatggctttaatcttgggttcaatgtttttcaagatcatgaaaaagggtgatacttctacattctatttccgtggttctgctatgttttttgcaattctattcaatgcattttcttctctgttagaaatcttttcgttatatgaggccagaccaatcactgaaaaacatagaacatattcgttataccatccaagtgctgacgcttttgcatcagttctatcagaaataccctcaaagttaatcatcgctgtttgcttcaatataatcttctatttcttagtagactttagaagaaatggtggtgtattctttttctacttattaataaacattgtcgcggttttctccatgtctcacttgtttagatgtgttggttccttaacaaagacattgtcagaagctatggttcccgcttctatgttattgttggctctatccatgtataccggttttgctattcctaagaagaagatcctacgttggtctaaatggatttggtatatcaatccgttggcttacttattcgaatctttgttaattaacgagtttcatggtataaaattcccctgcgctgaatatgttcctcgtggtcctgcgtatgcaaacatttctagtacagaatctgtttgtaccgtggttggagctgttccaggccaagactatgttctgggtgatgatttcattagaggaacttatcaatactaccacaaagacaaatggcgtggtttcggtattggtatggcttatgtcgtcttctttttctttgtctatctattcttatgtgaatacaacgagggtgctaaacaaaaaggtgaaatattagttttcccacgcagtatagttaaaagaatgaagaaaagaggtgtactaactgaaaagaatgcaaatgaccccgaaaacgttggggaacgtagtgacttatccagcgataggaaaatgctacaagaaagctctgaagaggaatccgatacttacggagaaattggtttatccaagtcagaggctatatttcactggagaaacctttgttacgaagttcagattaaggccgaaacaagacgtattttgaacaatgttgatggttgggttaaaccaggtactttaacagctttaatgggtgcttcaggtgctggtaaaaccacacttctggattgtttggccgaaagggttaccatgggtgttataactggtgatatcttggtcaatggtattccccgtgataaatctttcccaagatccattggttattgtcagcaacaagatttgcatttgaaaactgccactgtgagggagtcattgagattttctgcttacctacgtcaaccagctgaagtttccattgaagaaaagaacagatatgttgaagaagttattaaaattcttgaaatggaaaaatatgctgatgctgttgttggtgttgctggtgaaggtttaaacgttgaacaaagaaaaagattaaccattggtgttgaattaactgccaaaccaaaactgttggtctttttagatgaacctacttctggtttggattctcaaactgcttggtctatttgtcagctaatgaaaaagttggcaaatcatggtcaagcaattctatgtactattcaccaaccctctgctattttgatgcaagaattcgatcgtttactatttatgcaacgtggtggtaagactgtctactttggcgacttgggcgaaggttgtaaaactatgatcgattattttgaaagccatggtgctcataaatgccctgctgacgccaacccagctgaatggatgctagaagttgttggtgcagctccaggctctcatgcaaatcaagattattacgaagtttggaggaattctgaagagtacagggccgttcaatctgaattagattggatggaaagagaattaccaaagaaaggttcgataactgcagctgaggacaaacacgaattttcacaatcaattatttatcaaacaaaattggtcagtattcgtctattccagcaatattggagatctccagattatttatggtcgaagtttattttaactattttcaatcaattgttcatcggtttcactttcttcaaagcaggaacctcgctacagggtttacaaaatcaaatgttggctgtgttcatgtttacggttattttcaatcctattctacaacaatacctaccatcttttgtccagcaaagagatttgtatgaggccagggaacgcccctcaaggactttttcttggatttcatttatcttcgctcaaatattcgtggaagttccatggaatatattggcaggtactattgcttattttatctactattatccaattggattttactccaacgcgtctgcagctggccagttgcatgaaaggggtgctttattttggttgttctcttgtgctttctacgtttatgttggttctatgggtctgcttgtcatttcattcaaccaagttgcagaaagtgcagctaacttagcctctttgttgtttacaatgtctttgtctttttgtggtgttatgactaccccaagtgccatgcctagattttggatattcatgtacagggtttcacctttgacttatttcattcaggctctgttggctgttggtgttgctaacgtagacgtcaaatgcgctgattacgaattgctagaattcacaccaccatccggtatgacatgtgggcagtacatggaaccatatttacaactagcaaagactggttacttaactgatgaaaatgccactgacacctgtagtttctgtcaaatatctacaaccaatgattacttagctaatgtcaattctttctacagtgagagatggagaaattatggtatcttcatctgttatattgcattcaattatatcgctggtgtctttttctactggttagcaagagtgcctaaaaagaacggtaaactctccaagaaataatagaattttgaatttggttaagaaaagaaacttaccaagatggacttttttaataaacatacataatcactacatataggtgcgtaataataagtttttattttttttttcttaattcagcgagctttctacatttcaattttcttgaatttaccagctctgataaatcaaagttcaatgtccgaaagaattccgagaattttattcctaggttatctcatcggtactttttttttataggcatcagcatttagtgtgaaaacattatttcttaactgtgccttacggttaaaaagaaaggacgcaatggatatagttaaaatataagatatattatatcattatctgtccga

SEQ ID NO: 39 - DNA, 1977 bp, Arabidopsis thaliana
  CDS (85)..(1857)
ctcaaacaaaacagccttttacataagaacaaacacccccaaaaactgcaaaaaaaagagagagatcattaatccatcttcaagatgtctcttcctgaaactaaatctgatgatatccttcttgatgcttgggacttccaaggccgtcccgccgatcgctcaaaaaccggcggctgggccagcgccgccatgattctttgtattgaggccgtggagaggctgacgacgttaggtatcggagttaatctggtgacgtatttgacgggaactatgcatttaggcaatgcaactgcggctaacaccgttaccaatttcctcggaacttctttcatgctctgtctcctcggtggcttcatcgccgatacctttctcggcaggtacctaacgattgctatattcgccgcaatccaagccacgggtgtttcaatcttaactctatcaacaatcataccgggacttcgaccaccaagatgcaatccaacaacgtcgtctcactgcgaacaagcaagtggaatacaactgacggtcctatacttagccttatacctcaccgctctaggaacgggaggcgtgaaggctagtgtctcgggtttcgggtcggaccaattcgatgagaccgaaccaaaagaacgatcgaaaatgacatatttcttcaaccgtttcttcttttgtatcaacgttggctctcttttagctgtgacggtccttgtctacgtacaagacgatgttggacgcaaatggggctatggaatttgcgcgtttgcgatcgtgcttgcactcagcgttttcttggccggaacaaaccgctaccgtttcaagaagttgatcggtagcccgatgacgcaggttgctgcggttatcgtggcggcgtggaggaataggaagctcgagctgccggcagatccgtcctatctctacgatgtggatgatattattgcggcggaaggttcgatgaagggtaaacaaaagctgccacacactgaacaattccgttcattagataaggcagcaataagggatcaggaagcgggagttacctcgaatgtattcaacaagtggacactctcaacactaacagatgttgaggaagtgaaacaaatcgtgcgaatgttaccaatttgggcaacatgcatcctcttctggaccgtccacgctcaattaacgacattatcagtcgcacaatccgagacattggaccgttccatcgggagcttcgagatccctccagcatcgatggcagtcttctacgtcggtggcctcctcctaaccaccgccgtctatgaccgcgtcgccattcgtctatgcaaaaagctattcaactacccccatggtctaagaccgcttcaacggatcggtttggggcttttcttcggatcaatggctatggctgtggctgctttggtcgagctcaaacgtcttagaactgcacacgctcatggtccaacagtcaaaacgcttcctctagggttttatctactcatcccacaatatcttattgtcggtatcggcgaagcgttaatctacacaggacagttagatttcttcttgagagagtgccctaaaggtatgaaagggatgagcacgggtctattgttgagcacattggcattaggctttttcttcagctcggttctcgtgacaatcgtcgagaaattcaccgggaaagctcatccatggattgccgatgatctcaacaagggccgtctttacaatttctactggcttgtggccgtacttgttgccttgaacttcctcattttcctagttttctccaagtggtacgtttacaaggaaaaaagactagctgaggtggggattgagttggatgatgagccgagtattccaatgggtcattgatcatgaattcatgatcatgatcatgatgatgaacattatgcatgtctatgttgatatgtttgaatttgattttgagttttgtttgtatattttatgatgcttttcttaattaaaaaaaaa

SEQ ID NO: 40 - DNA, 1965 bp, Oryza sativa
  CDS (144)..(1898)
ggtggaggagagtgaggacggcccacgcggacgagcagagagtggcgggctcagtgtcgggctcgccggagtccgcgcaatccggccgttcatgcttcattctctcggacattaacctggtttacttgtaagaaagtagagccatggactcctcataccagcatgacaagcctctgctggatgaagagaactcctcgcaagtgacccttgaatatacaggtgatggatctgtttgcatccgtgggcatcctgctttaaggaaacatacagggaactggaagggttcctcattagccatcgttttttcattctgctcttatctggcctttacttcaattgtaaaaaacctagtcagttatctcacaaaagttctacatgaaacaaacgtggccgctgcaagagatgttgcaacttggtcaggaacaagttatcttgcacctctggttggagccttcttagctgattcatatctggggaagtactgtacaattctgatcttctgcacgatcttcattatcggattgatgatgttgcttctgtcagcagcagttccattaatctctactggtcctcactcatggatcatatggacagatccagtctcttctcagaacatcatattctttgtcggtttgtacatggttgctttagggtatggtgcacagtgcccctgcatatcatcatttggtgctgatcaatttgatgacactgatgaaaatgagagaacaaaaaagagttcttttttcaattggacctatttcgtagccaatgcgggctcattgatctcggggactgttattgtgtgggtgcaagatcacaaaggttggatctggggttttaccatttctgcactatttgtgtatttaggttttggtacttttatctttggctcctctatgtatgatttcagaaacctggaggaagcccctcttgcgagaatatgccaggttgttgttgctgctattcacaaacgcgataaagatttgccatgtgattcctcagttctttatgagtttctggggcagagttcagcaatcgaaggcagccgaaaattggagcatacaactggacttaagttctttgatagagctgcaatggtgacaccatctgattttgaatctgatggcctactaaacacatggaagatttgcacagtcactcaagtggaggaactgaagattttgatcaggatgttccccgtttgggcaacgatgatattatttgctgcagttctggacaacatgttttcgacattcatagaacaggggatggtgatggagaaacacatcggctctttcgaaatacctgcggcgtccttccaatccattgatgtcattgctgtccttatactagttccagtctatgaaagagtccttgttccagtgttcagaaaattcactggcagagcaaatggcattactccactgcagcgaatggggatcggcctgttcttttccatgctctccatggtatcagcagcattggtggagagtaatcggttgcggattgcgcaggatgaaggtttggtgcacaggaaggtggctgttccaatgagcatcctgtggcagggaccccagtacttcctgataggcgtgggagaggtgttctcaaacattgggttaactgaatttttctaccaggaatcaccggacgccatgagaagcttatgtctcgcattctcacttgctaacgtttcggcaggaagttacctcagctcgtttatcgtttctcttgtgccagtgttcacagccagagaaggcagtcctggatggatacctgataacttgaacgaagggcatttggatcggttcttctggatgatggctggcttgtgtttcttgaatatgctggcctttgtgttctgtgccatgaggtacaaatgtaagaaggcttcctgaaccttgttaacattagcaatataatggtggtggaaaaggacaattgtgttgcaaaaaaaaaaaaaaa

SEQ ID NO: 41 - DNA, 2229 bp, Zea mays
  CDS (494)..(2068)
tggccataaggagacgcggcgatcaggccttccttaattttcttctgttccatcctcgctctacctgcctgctgccagtttcaactctccaaggtcaacgccagccctcgcgcgcttggtgtactctagtttagtacaccaatccgcatgcattcttttttgtttgtttgtttgtttgtttgttttgattgacaaatatatgcggcagagttaagaacgaatcgactccgtcgtctcggctagtcgaccgtacatatccacgacctccaaaggccgccaaaacacccgatccggccagccttgtcgtgtcatcgtccagttagatgtcaactcccatctgaatctcctcctccatggcggctttcctataaatacgtcgcctttccatgttggatgtcattccacgcgtccgggcaacagcagctatagtttccaagggaaagggatacatcacctgctgctctagctctgctatagcgctagcagcaatataatggcggccgtcggcgccccgggcagctctctgcacggagtcacggggcgcgagccggcgttcgccttctccacggagcacgaggaggcggcgagcaatggcggcaagttcgacctgccggtggactcggagcacaaggcgaagagcgtccggctcttctccgtggccaacccgcacatgcgcaccttccacctctcctggatctccttcttcacctgcttcgtgtccaccttcgccgccgcgccgctggtccccatcatccgcgacaacctcaacctcaccaaggccgacatcggcaacgcgggcgtggcctccgtgtcgggctccatcttctcccgcctcaccatgggcgccgtctgcgacctgctgggcccgcgctacggctgcgccttcctcatcatgctgtccgcgcccaccgtgttctgcatgtcgctcatcgacgacgccgcgggctacatcgccgtcaggttcctcatcggcttctccctcgccaccttcgtctcctgccagtactggatgagcaccatgttcagcagcaagatcatcggcaccgtcaacgggctcgccgccggatggggcaacatgggcggcggcgccacgcagctcatcatgccgctcgtctacgacgtcatccgcaagtgcggcgccacgcccttcacggcgtggcgcctcgcctacttcgtgccgggcctcatgcacgtcgtcatgggcgtcctggtgctcacgctggggcaggacctccccgacggcaacctcaggtcgctgcagaagaagggcaacgtcaacaaggacagcttctccaaggtcatgtggtacgccgtcatcaactaccgcacctggatcttcgtcctcctctacggctactgcatgggcgtcgagctcaccaccgacaacgtcatcgccgagtacatgtacgaccgcttcgacctcgacctccgcgtcgccgggaccatcgccgcctgcttcggcatggccaacatcgtcgcgcgccccatgggcggcatcatgtccgacatgggcgcgcgctactggggcatgcgcgctcgcctctggaacatctggatcctccagaccgccggcggcgccttctgcctctggctgggacgcgccagcaccctccccgtctccgtcgtcgccatggtgctcttctccttctgcgggcaggcggcctgcggcgccatcttcggggtcatccccttcgtctcccgccgctccctcggcatcatctccggcatgacgggcgccggcggcaacttcggcgcggggctcacgcagctgctcttcttcacctcctcaacctactccacgggcagggggctagagtacatgggcatcatgatcatggcgtgcacgctacctgtggtgttcgtgcacttcccgcagtgggggtccatgttcttcccgcccagcgccaccgccgacgaggagggctactacgcctccgagtggaacgacgacgagaagagcaagggactccatagcgccagcctcaagtttgccgagaacagccgctcagagcgcggcaagcgaaacgtcatccaggccgatgccgccgccacgccggagcatgtctaagtctactactaataagatggatcgatccatcatccatgttcacctgctacctacctctacgtgtatgccttgtaacgcgccggaccggagcacttgtttgataaaaaaaaaaaaaaaaaaaaaaaaaaaaaaaaaaaaaaaaaaaaaaaaaaaaaaaaaaa

SEQ ID NO: 42 - DNA, 1952 bp, Oryza sativa
  CDS (97)..(1698)
aattgcatccgagctcacctagcttctctcttgcaaccagcgattcgatcgattccatctccaagaagcagcggctagcagcagctagtagttgccatggactcgtcgacggtgggcgctccggggagctcgctgcacggcgtgacggggcgcgagccggcgttcgcgttctcgacggaggtgggcggcgaggacgcggcggcggcgagcaagttcgacttgccggtggactcggagcacaaggcgaagacgatcaggttgctgtcgttcgcgaacccgcatatgaggacgttccacctatcatggatctccttcttctcctgcttcgtctccaccttcgccgccgcccctctcgtccccatcatccgcgacaacctcaacctcaccaaggccgacatcggcaacgccggcgtcgcctccgtctccggctccatcttctccaggctcgccatgggcgccatctgcgacatgctcggcccgcgctacggctgcgccttcctcatcatgctcgccgcgcccaccgtcttctgcatgtcgctcatcgactccgccgcggggtacatcgccgtgcgcttcctcatcggcttctccctcgccaccttcgtgtcatgccagtactggatgagcaccatgttcaacagcaagatcatcggcctcgtcaacggcctcgccgccgggtggggaaacatgggcggcggcgcgacgcagctcatcatgccgctcgtctacgacgtgatccgcaagtgcggcgcgacgccgttcacggcgtggaggctggcctacttcgtgccggggacgctgcacgtggtgatgggcgtgctggtgctgacgctggggcaggacctccccgacggcaacctgcgcagcctgcagaagaagggtgacgtcaacagggacagcttctccagggtgctctggtacgccgtcaccaactaccgcacctggatcttcgtcctcctctacggctactccatgggcgtcgagctcaccaccgacaacgtcatcgccgagtacttctacgatcgcttcgacctcgacctccgcgtcgccggcatcatcgccgcatccttcggcatggccaacatcgtcgcgcgccccaccggcggcctcctctcggacctcggcgcgcgctacttcggcatgcgcgcccgcctctggaacatttggatcctccagaccgccggcggcgcgttctgcctcctgctcggccgcgcatccaccctccccacctccgtcgtctgcatggtcctcttctccttctgcgcgcaggccgcctgcggcgccatcttcggcgtcatccccttcgtctcccgccgctcgctcggcatcatctccggcatgaccggcgccggcggcaacttcggcgccgggctcacgcagctgctcttcttcacgtcgtcgaggtactccacgggcacggggctggagtacatgggcatcatgatcatggcgtgcacgctgccggtggtgctcgtccatttcccgcagtggggctccatgttcctcccgcccaacgccggcgccgaggaggagcactactacggctccgagtggagcgaacaggagaagagcaagggcctccacggtgcaagtctcaagttcgccgagaactcccgctccgagcgtggccgccgcaacgtcatcaacgccgccgccgccgccgccacgccgcccaacaactcgccggagcacgcctaaggcgtaaacaattctgcgaccgagaccagcaatacgctggagttcgactcgatgataacacgccggagcacgtccttgttgcaaacgggtgatgaaattaagagtgaaatatttccttaggaattgaatcctttgaaattaattcctttggaatttctccgatacaaacggaggtataataagggagaggcatttatacctatgtacatgttacacttttttgaatttacagtgtattccatattgatgttgtc

SEQ ID NO: 43 - DNA, 1551 bp, Oryza sativa
  CDS (1)..(1551)
atggaggctaagccggtggcgatggaggtggagggggtcgaggcggcggggggcaagccgcggttcaggatgccggtggactccgacctcaaggcgacggagttctggctcttctccttcgcgaggccacacatggcctccttccacatggcgtggttctccttcttctgctgcttcgtgtccacgttcgccgcgccgccgctgctgccgctcatccgcgacaccctcgggctcacggccacggacatcggcaacgccgggatcgcgtccgtgtcgggcgccgtgttcgcgcgtctggccatgggcacggcgtgcgacctggtcgggcccaggctggcctccgcgtctctgatcctcctcaccacaccggcggtgtactgctcctccatcatccagtccccgtcggggtacctcctcgtgcgcttcttcacgggcatctcgctggcgtcgttcgtgtcggcgcagttctggatgagctccatgttctcggcccccaaagtggggctggccaacggcgtggccggcggctggggcaacctcggcggcggcgccgtccagctgctcatgccgctcgtgtacgaggccatccacaagatcggtagcacgccgttcacggcgtggcgcatcgccttcttcatcccgggcctgatgcagacgttctcggccatcgccgtgctggcgttcgggcaggacatgcccggcggcaactacgggaagctccacaagactggcgacatgcacaaggacagcttcggcaacgtgctgcgccacgccctcaccaactaccgcggctggatcctggcgctcacctacggctacagcttcggcgtcgagctcaccatcgacaacgtcgtgcaccagtacttctacgaccgcttcgacgtcaacctccagaccgccgggctcatcgccgccagcttcgggatggccaacatcatctcccgccccggcggcgggctactctccgactggctctccagccggtacggcatgcgcggcaggctgtgggggctgtggactgtgcagaccatcggcggcgtcctctgcgtggtgctcggaatcgtcgacttctccttcgccgcgtccgtcgccgtgatggtgctcttctccttcttcgtccaggccgcgtgcgggctcaccttcggcatcgtgccgttcgtgtcgcggaggtcgctggggctcatctccgggatgaccggcggcgggggcaacgtgggcgccgtgctgacgcagtacatcttcttccacggcacaaagtacaagacggagaccgggatcaagtacatggggctcatgatcatcgcgtgcacgctgcccgtcatgctcatctacttcccgcagtggggcggcatgctcgtaggcccgaggaagggggccacggcggaggagtactacagccgggagtggtcggatcacgagcgcgagaagggtttcaacgcggccagcgtgcggttcgcggagaacagcgtgcgcgagggcgggaggtcgtcggcgaatggcggacagcccaggcacaccgtccccgtcgacgcgtcgccggccggggtgtga

SEQ ID NO: 44 - DNA, 1957 bp, Arabidopsis thaliana
  CDS (76)..(1833)
gtcgacccacgcgtccgtagataggtagcttcaacgtaaggaatctaaattggttcagctcaaaaaacgaaaacgatgggttccatcgaagaagaagcaagacctctcatcgaagaaggtttaattttacaggaagtgaaattgtatgctgaagatggttcagtggactttaatggaaacccaccattgaaggagaaaacaggaaactggaaagcttgtccttttattcttggtaatgaatgttgtgagaggctagcttactatggtattgctgggaatttaatcacttacctcaccactaagcttcaccaaggaaatgtttctgctgctacaaacgttaccacatggcaagggacttgttatctcactcctctcattggagctgttctggctgatgcttactggggacgttactggaccatcgcttgtttctccgggatttatttcatcgggatgtctgcgttaactctttcagcttcagttccggcattgaagccagcggaatgtattggtgacttttgtccatctgcaacgccagctcagtatgcgatgttctttggtgggctttacctgatcgctcttggaactggaggtatcaaaccgtgtgtctcatccttcggtgccgatcagtttgatgacacggactctcgggaacgagttagaaaagcttcgttctttaactggttttacttctccatcaatattggagcacttgtgtcatctagtcttctagtttggattcaagagaatcgcgggtggggtttagggtttgggataccaacagtgttcatgggactagccattgcaagtttcttctttggcacacctctttataggtttcagaaacctggaggaagccctataactcggatttcccaagtcgtggttgcttcgttccggaaatcgtctgtcaaagtccctgaagacgccacacttctgtatgaaactcaagacaagaactctgctattgctggaagtagaaaaatcgagcataccgatgattgccagtatcttgacaaagccgctgttatctcagaagaagaatcgaaatccggagattattccaactcgtggagactatgcacggttacgcaagtcgaagaactcaagattctgatccgaatgttcccaatctgggcttctggtatcattttctcagctgtatacgcacaaatgtccacaatgtttgttcaacaaggccgagccatgaactgcaaaattggatcattccagcttcctcctgcagcactcgggacattcgacacagcaagcgtcatcatctgggtgccgctctacgaccggttcatcgttcccttagcaagaaagttcacaggagtagacaaaggattcactgagatacaaagaatgggaattggtctgtttgtctctgttctctgtatggcagctgcagctatcgtcgaaatcatccgtctccatatggccaacgatcttggattagtcgagtcaggagccccagttcccatatccgtcttgtggcagattccacagtacttcattctcggtgcagccgaagtattctacttcatcggtcagctcgagttcttctacgaccaatctccagatgcaatgagaagcttgtgcagtgccttggctcttttgaccaatgcacttggtaactacttgagctcgttgatcctcacgctcgtgacttattttacaacaagaaatgggcaagaaggttggatttcggataatctcaattcaggtcatctcgattacttcttctggctcttggctggtcttagccttgtgaacatggcggtttacttcttctctgctgctaggtataagcaaaagaaagcttcgtcgtagtaatgctgttatctatctactttcattacatacaaaagtttgtttctttcaactgtaactgtctctgtatcaataacaacattgctgtgtacttttcctttcaaaaaaaaaaaaaaaaaaaaaa

SEQ ID NO: 45 - DNA, 2065 bp, Zea mays
  CDS (75)..(1907)
cccacgcgtccggcggaagcgacccagcagcgaagcgacgactagctctgcggcctctgccccaagcgccgacgatgggtgccggtgctactgccagggacgaggagactgctaccggccgccaccatgggaggaagccgcatggcgcggcggcggagtacgcgcaggacgggtccgtggacctgcgcggcaatcccgtgctccgctcccagcgcggcggctggaccgcctgctccttcatcgtcgtgtacgagctgttcgagcggatggcctactacgggatctcgtccaacctcatcatctacctgacggacaggctccaccagggcaccgtcgaggcctccaacaacgtcaccaactggtccggcaccgtcttcctcacgccgctgctcggcgcctatgtcgccgacgcctacctcggccgctactggaccttcgtcgtcggctccgccatttacctcctggggatggtgctgctggtgctgtccgtctcggtgccggcgctgaagccgccgccgtgcggcgccggcggcgtgtgcccgcaggcgtcggcgctgcagctcggggcgtacttcggcgggctctacatcgtggccctgggaaacggcggcaccaagcccaacatctccaccatcggggcggaccagttcgacgagttcgacccgcgggagcggacgcacaagctgtccttcttcaactggtggatgttcaccatcttcctgggcatcctcttctcctccaccgtcctcgtgtacctgcaggacaacgtgagctggtccgtgggctacggcatccccacgctgggcctcatggtctccatctccgtcttcctcgccggcaccaggctgtaccgccacagggtgccgcagggcagcccgttcacgagcatgggcagggtcctggccgccgcgctctggaagtggagcgtcccggtcccggccgacgccaaggagctgcacgagctggacgtcgaggagtacgcgaggaagcgtaagttcaggatggactccaccgacgccatggccttcctcaacaaggccgccgccgtgcccagcggcgggccggcggcgacgccggcgtggagcctctgcacggtgacccaggtggaggagacgaagcagatcctgaggctggtgcctctcctggtggccatgatcgtgccctgcacgctcatcgcgcagaccaacacgctgttcgtaaagcagggcacgacgatggaccggcacatgggcccacgcttcgagatcccagcggcgagcctgggcgcgttcgtgacgctgaccatgctggtggccgtggtggtgtacgaccgggtgttcgtgagggccgtgcggcggtacaccaaggacccgcgcgggatcacgatcctgaggcggatgggcacgggcatgctgctgcaggtggcgaccatggcggtggcgtcggcgatcgagagccggaggctggcctacgcgcggagccacggcctggacgccacggggggccagctggggctcaccatcttcgcgctgctcccgcagttcgtgctgatgggactggccgacgcgttcctggtggtgggcaagatcgagttcttctacgaccaggcgccggagagcatgaagagcctgggcaccgccatgtccctcaccgcgtacggcatcggcaacttcctcagcagcttcctgctgtccacggtcacgcgcgtcacgcgggaccgcggccacgcctgggtcaccaacaacctcaacgcctccaacctcgactactactacgccttcctcaccgcgctcggcgtcgtcaacttcgtcgccttcctcgcgctcagcgccaggtacaggtacaaggcccagtccaccgacacgatcgacgctgccgtcggcctggagaccgagaaagccaagcttcaggcggagccactgggctgacgtcgacgacgacgacggggtgcgtctgcctctgctgttaaaagcggagaagatcagccatgaatgcgtatcgtccaaggcgacgtgtgtagcatcaactcacttgtaaaaaaaagcacaggatttccacccgaaaccaaaagcagtgtctgcaaaaa

SEQ ID NO: 46 - DNA, 2225 bp, Zea mays
  CDS (212)..(1954)
gccagagagagatgcgggtgggagttgggatacctcggaggcggcgacgacaggatcgcagtggtcagtagccgggtcggccggtggccgcagattctcaccagcagcgccatccctcgccgtcgcccggcgctccagcccagggcaggagaggaagccactctgactctgtcactctgagcttcgcgtcacctgagtactgacggacgacatgggagaagttgaggacatgtacacccaagacgggaccgtggacatgaaagggaatcccgccgtgaagaagggcaccggcaactggcgcgcctgcccctacatcctcgcgaacgagtgctgcgagaggctggcctactatggcatgagcaccaacctggtgaactacatgaagacccggcttggccaggtgaactctgtcgcctccaacaacgtcaccaactggcaagggacgtgctacatcacgccgctcatcggcgccttcttcgccgacgcgtacatggggaggttttggaccatcgccatcttcatgatcatctacatttttggcctggcgctgctgacgatggcgtcatcggtgaaggggctggtgcctacgtcgtgcggcgacaaggacgtgtgccacccgacggacgcgcaggcggcggtggtgttcgtggcgctgtacctcatcgcgctgggcacgggcgggatcaagccgtgcgtgtcctccttcggcgccgaccagttcgacgagaacgacgagcgggagaagaagagcaagagctccttcttcaactggttctacttctccatcaacatcggcgcgctggtggcgtccacggtgctggtgtacgtgcagacgcacgtgggctggggctggggcttcggcatccccgccgtggtcatggccatcgccgtcggcagcttcttcgtgggcacgccgctgtacaggcaccagaagcccgggggcagcccgctgacgcgcatcgcgcaggtgctcgtcgcgtgcgcgcgcaagtggaacgtggccgtgcccgcggacaagtcgcggctgcacgagacggtggacggggagtccggcatcgaggggagccgcaagctggagcactcggagcagctggcgtgcctcgacagggcggccgtggtgacggccgaggacggcgcggaggcgagcccgtggcgcctgtgctcggtgacgcaggtggaggagctcaagagcgtgatccggctgctgcccatctgggccagcgggatcgtgttcgcggcggtgtactcgcagatgagcaccatgttcgtgctgcagggcaacacgctggaccagagcatggggccccggttcaagatcccctcggcgacgctgtccatggtggacactatcagcgtcatcgtctgggtccccgtgtacgaccgcgccatcgtgcccctggtgcgctcttacaccgggaggccgcgcgggttcacgcagctgcagcgcatgggcatcggcctcgtcgtctccatcttctccatggtggcggcgggcgtgctggacatcgtgcggctgcgcgccatcgcgcggcacggcctgtacggcgagaacgacatcgtgcccatctccatcttctggcagataccgcagtacttcatcatcggatgcgcggaggtgttcaccttcgtggggcagctggagttcttctacgaccaggcgcccgacgccatgaggagcatgtgctcggcgctgtcgctcaccaccgtcgcgctcggcaactacctcagcacggtcctggtgaccatcgtcacccacatcaccaccaggcacggccgcatcgggtggatcccggagaacctcaaccgcggccacctcgactacttcttctggctgctcgcagtgctcagcctcctcaacttccttgcctacctcgtcatcgccagctggtacaagtacaagaagacggccgatgattaccctggcgccaaaggggagcacggtacagagcactgatgggcgagagatggcggaaattgagtgatttctatgtgtggttagctgtctgcctgtctgtcgacttgttttgccacagtttgggtgcttaaacgttaacgtacgtactagttcaatatagtgtctcgggggcgaattggttgtttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 47 - DNA, 2183 bp, Oryza sativa
  CDS (163)..(1944)
gtacccggagaccccacatatccagatctgcaagcggcctcctcctccttcctcctgatcctttagcttcctatatacgattccaccatcgaaggccagggcccagacttgcttgccgcaggttactgatccaccgaaggagggaggcgcccgcccgccgccatggccgaggtgacggtggtccgtgcggagcgcgaggaggagtccaccctggagcagggtctcctcgccatcccggaggaatccaaccaacttacatacactggagatggatctgtcgacttttctgggaatcctgttgtgaaggagagaactggtagatggagggcatgcccatttatcttaggtaatgagtgctgtgagcggttggcctattatggaatctccacaaaccttgttacatacttgacaaagaaactgcatgatggtaatgcttctgctgctagcaatgtgactgcatggcagggaacttgctacttaactccccttattggagctatactggctgatgcatactggggaaggtattggactattgcaacattctccacgatatacttcattgggatggctgtactgactctttcagcatcagttcctacattcatgcctccaccttgcgaagggtccttttgcccaccagcaaatccattgcagtatactgtcttttttcttggactttacctaattgctcttggtactggtggtattaagccctgtgtctcatcctttggagcagatcaatttgatgatacagacccagttgagcgaatccagaagggatctttctttaactggttctatttctcaataaacattggtgctctcatatcaagcagttttctggtttgggtgcaagacaatataggatggggaataggctttggcattccaacaattttcatggggctggccatcataagtttcttctctggaacatcactttatagattccaaaagccaggcggcagtcctattacacgagtatgccaggtggttggtgcctcctttcgcaagtggaacgtacatgttccagaggatagctctcgcttgtatgagttgcctgatggggcttcagcaattgaagggagtcggcaattggagcacaccgatgaactcagatgtctggacaaagctgctacaattactgatcttgatgtgaaagcagatagctttacaaacccatggcgaatatgcactgtgactcaggtggaagaactgaagatattggtaaggatgttccctgtctgggcaacgactattgtgttttctgctgtctatgctcagatgtccaccatgtttgttgagcaagggatgatgcttgatacatcagtaggtccattcaagattcctccagcatctctatctacctttgatgtggtaagtgtcattatatgggtccccctctatgatagtatcttggttccaatagctaggaggttcactggcaacccgaggggctttacagagttacagaggatggggattggtttggtaatctcaatcttttcgatggcggcagctgcagttcttgagattaaaaggttggacattgcaagggctgaacatttggtggatcaaaatgttccagtaccactgaacatctgctggcaaattcctcaatatttcttggttggtgcctcagaggtcttcacatttgtcgggtcacttgagttcttctatgatcaatcaccggatgccatgaggagcctctgcagcgcactgcagcttgtcacaacagctcttgggaattatctcagtgcattcattttgacattggttgcgtacttcacaacaagaggaggaaatcctggatggattcctgataacttgaatcaaggtcacctagattatttcttctggcttcttgctgggctcagttttctgaactttgtgatatatgtcatctgcgcaaacaaatacaaaagcaagaaagcagcttgagctaatcaggagttaaaagactgtcgtcatgggaatttcacttcaaaattctgtatatatgtgcacaaagtacatgttgaagcagcgaccgtaacaagagaactttaaccatcctgtactctgtatttgatgctactatacattttatactttttgttctgtagatattaatttattgaagctacttgtggaatgtagctttgcttccaatgcgtctccttaatctggtacacctgatt

SEQ ID NO: 48 - DNA, 1743 bp, Oryza sativa
  CDS (1)..(1743)
atgggagaggttgcagaagacatctacacccaagatggcaccgtggacgtcaagggcaacccggccaccaagaagaacaccggcaactggcgtgcctgcccctacatcctcgctaacgagtgctgcgagaggctggcctactatggcatgagcaccaacctcgtgaactacatgaagacgcggctcgggcaggagagcgccattgccgccaacaatgtcaccaactggtcggggacttgctacatcaccccccttctcggtgccttcttggctgatgcctacatgggcaggttctggaccattgccagcttcatgatcatctacatcctgggtttggcgttgctgacaatggcgtcgtcggtgaaggggctggtgccggcgtgcgacggaggagcgtgtcacccgacggaggcgcagacgggggtggtgttcttggcgctgtacctgatagcgctgggcaccggcgggatcaagccgtgcgtgtcgtcgtttggcgcggaccagttcgacgagaacgacgagggggagaagcggagcaagagcagcttcttcaactggttctacttctccatcaacatcggcgcgctggtggcgtcgtcggtgctggtgtacgtgcagacgcacgtcgggtgggggtgggggttcggcatcccggccgtcgtcatggccgtcgccgtcgccagcttcttcgtcggcacgccgctgtacaggcaccagcggcccgggggcagcccgctgacgaggatcgcgcaggtgctcgtcgcgtcggcgaggaagtggggcgtcgaggtccccgccgacgggtcgcggctgcacgagacgctcgacagggagtccggcatcgagggcagccgcaagctggagcacaccgggcagttcgcgtgcctcgacagggcggcggtggagacgccggaggacaggtcggcggcgaacgcgtcggcgtggcggctgtgcacggtgacgcaggtggaggagctgaagagcgtggtgcggctgctgccgatctgggcgagcgggatcgtgttcgcgacggtgtacgggcagatgagcaccatgttcgtcctccaggggaacacgctcgacgccagcatggggccgcacttctccatcccggcggcgtcgctctccatcttcgacaccctcagcgtcatcgtctgggtgccggtgtacgaccgcctcatcgtgccggcggtgcgcgccgtgacggggcgcccacgcgggttcacccagctgcagcggatgggcatcggcctcgtcatctccgtcttctccatgctcgccgccggcgtgctcgacgtcgtcaggctgcgcgccatcgctcgccacgggctctacggcgacaaggacgtcgtgcccatctccatcttctggcaggtgccgcagtacttcatcatcggcgccgccgaggtgttcacgttcgtcgggcagctggagttcttctacgaccaggctcccgacgccatgcgcagcatgtgctcggcgctgtcgctcaccaccgtcgcgctaggcaactacctcagcacgctgctcgtgaccatcgttacccatgtcaccacccggaacggcgccgtcgggtggatcccggacaacctcaaccgcggccacctcgactacttcttctggctgctcgccgtgctcagcctcatcaacttcggcgtctacctcgtcatcgccagctggtacacctacaagaagacggcggattcaccggacgacaaggccgagcacgccggagcaaactga

SEQ ID NO: 49 - DNA, 901 bp, Synechocystis PCC6803
  CDS (70)..(801)
ctatgagcagcagggctcaccagaggcgcaacggctagaactgcggctgcaagccatgggaattcggctatgacgggcaaagtctatctcgtcggcgctgggccgggcgaccctgaatatctgacgctgcaggcacagcaatgtttgcagtcagcagaggtgttgatctacgacgcgctgatcgacccccgaattctcgacttagtgccagctaattgcgatcgcattgccgtgggtaaacgcggtggcgcggagagtacgccgcaagccactatcaatcaactactggtcgagcactgccagcaagggcgcaaagtcatccgcctcaaaagtggcgatccctttgtctttggtcgcgctgccagtgaattggatgcgctggagcgatcgggctgtgattatgctgtcctgcccgggctttcgaccgctttagcggctccactgttggcgggcattccgattaccgatccggtgctgagccgtggctttgcggtttacaccgtccatgagccagacgcgttgaattgggaagcgctggcgcaactggaaacgctgattctgctgatgggtagtcgccacttgctgacgattggccacgagctgattcggcatgggcgatcgccggatagtcctgtggcgctgattcagtgggccggacatccacagcagaccgttttggaaagtagcctcagccgcatggcgcagcagtggggcgatcagccgttatcgccctgcgtaattgtgattggcgaggtggtacggttgcgaaagtactgggcgcactaccgttacgatggctgagcagccgctgatcggtaaaaccattttgacgacgcgagccgcggggcaatcttcgccctttgccgcacaactgcgggccgctggcgcagccgtgatcgag

SEQ ID NO: 50 - DNA, 774 bp, Xylella fastidiosa
  CDS (1)..(774)
atgagcgtcaccctggtgggcgctggcgccggcgacgccgggctactgaccttaaatgcactgcgcgccttgaatgaagccgacatcatcctctacgaccgcttggtcagcgacaccgtgttacaggtggcacggcgcgatgcggagcagatcgaagtaggcaaatccgcgacaggccacagtgtgcgccaagaagacattcacagcctgatgctgcaacacgcccgtgctggccagcgtgtcgtacggctgaaaggtggcgatccattcgtcttcggtcgtggcggcgaagaactggaatttttacgtacccacaacatcccctatgaggtcatccccggaatcactgccgccctggcctgtgccgcctatgccggtatccccttgacccaccgcgaccatgcccaatcgctatgcctgatcaccgcccattgccaatcctcgctagacaccctggactgggctgcactagcacaagaacgccaaacgctggcgttctacatgggcgtggcggggctacccaccatccagcaacgcctgtgtgaggctggacgcgccgaaacaacgccttttgcactgatcgaaaatggcgcacgcgcgcaacagcgggtgctcaccggaacgctgaaaacactcgcgcacaccgcacagacatatgccgtgcgcccccccgcactgctgatcctcggcgaagtcaccacgctggccgaacacctgcattggttcggcaccgcaccattatctgccccatgcccccccgcactcatcctataa

SEQ ID NO: 51 - DNA, 1637 bp, Zea mays
  CDS (15)..(1286)
ccccgcgcatcgccatggctctcgccgtccgcacgcctcgcttccagcctcgaccggcctccatttctgcgcccacaacacccgcatcgacctccctcgccgccgggaacgcgaggccccgcccctgcgccggcgccgccgttcgcgcctcgcccttcaccgaggccacctcctcctcgcgctaccgccgcgacgcctggtcatacgccgccgatggctcctccaactccgcatccccgtcctccgctgccgctgctgccgcgggccgtcgggatgacgagatcgcgctgcagctgccggaactgcggaggctcctggacgtgctgagggcgtccagggggaggggcgccgaggagggcggcggacccggggaggtggcactggtgggcacagggcccggggaccccgagctgctcacgctcaaggcggtccgggccatcgaggcggcggacctggtgctctacgacaggctggtgtctaacgacgtgttggacttggtcggggagggcgccaggctgctctatgtcggcaagaccgcgggataccacagccgcacccaggaggagattcacgagctgctgctgagctttgcggaggccggtgccaatgttgtgcgcttgaaaggtggcgatcctctggtttttggaaggggtggagaagagatggatttcttacagcaacagggaattaaagttgaagttatcccaggaattacttctgcttcgggtattgcagcagagctaggcattccgttaacccatagaggtgttgctaccagtgtcagatttttaactggccactccagaaatggtgggacagatccactatatgtagctggaaatgcggctgatccagacactactttggttgtgtatatgggtttgtcaacacttccatcacttgctccaaagttaatgaagcacggcctgccaccagatacccctgctgttgcagtagagcgcgggactacaccccaacaacgaacggtgttcgcctcgttgaaggatcttgtggatgaagtcaagtcagccgatctagtttctccaactctaataattattgggaaagtggtatccttgtcacccttctgggttgagtcatctgaacatgatgcactgaaagttcagagctcgtatgcaaatgaggcagatgacaacagattttcttggtttttagtgactggacaatacttgagaaatgcaagatcccagatatgggagcacaggttcgacctggtgtacacagaaacatctcaggaagcatggatcctgaatggcggatggtagcttaagcttataacagacttggggcagaagcgcacttggactgatcatgcttgattctttggcctaatctacatgagattcacaatttttcgatttagttgagttcgacaatagttgtgtgcttctttgttactagtagccatgtacgtgcggcgcagcggtgtttacgattctatgccctagcatagtaaggctattccaacgctgccacgttatgattttatgataatgggagtttcgtagcaccatgataatgagaaatagtgctacgaagctcttattatatgacaagtgccataaatcgtagcacttatgattttatgatatggggagcttcgtagagctctttct

SEQ ID NO: 52 - DNA, 1052 bp, Zea mays
  CDS (171)..(755)
ccacgcgtccgctgttcgaagctttcagccgagcaccatcgtcacagtcagtagccaagcatatttctttctccgagtgatttgcgctgagcgatcagttcatccagagcgagcggagctgagctgagctgagctgagcgagcttgcgttgcttgagagaccctgctgccatggcttcccaccaggacaaggctagctaccaggccggcgagaccaaggcccgcaccgaggagaagaccgggcaggcggtgggggcgaccaaggacacggcgcagcacgccaaggaccgggcggcggacgcggcggggcacgcggcgggcaagggccaggacgccaaggaggccaccaagcagaaggcgtccgacaccggcggctacctgggaaagaagaccgacgaggccaagcacaaggccggcgagacgacggaggccaccaagcagaaggccagcgagacgacggaggcgaccaagcagaaggccggcgagacgacggaggccgccaggcagaaggcagccgacgccatggaggcagccaagcagaaggccgccgaggccgggcagtacgccaaggacaccgccgtctccggcaaggacaagtccagcggcgtcatccagcaggccactgagcaggtgaagagcgcggcggcgggcgccaaggacgcggtgatgagcacgctggggatgggcggggacgacaagcagggcgacgccaacaccaacaccaacaaggactcctctaccatcaccagggatcactagacgcgtgtatgcacacgcacttggtccgatcctgtcgtccgtgaccctgtttgcttgttcgcgagtccagtatgggtttgtgcatgttttcagtgtcatggtttccttttctacgaatttggcgttgtaagttcgattcgcaggtacgttgctgtgttttttttctgcgccatcaggtgtctgtaaacgagtcgggcgggtttgagtgtcctttgttgtgataataaagttggtaaatcgtaattaatatatagcatgcgactgtcttgctatggcctaaaaaaaaaaaaaaag

SEQ ID NO: 53 - DNA, 834 bp, Zea mays
  CDS (70)..(456)
ccacgcgtccggaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtcgtgtaccttacgtgacatgctgtagcacgtacgctagcagagcagcacctcaatgtccttgggtttgctttgctggctctctgttttcgtcttgtgttgcttttaatctggcacaggtttctaaattataataatgaatacttttttgtccattaaaaaaaaaaaaaaaaag

SEQ ID NO: 54 - DNA, 1050 bp, Glycine max
  CDS (6)..(704)
cagccatgttcttaaccagaagcgcgctttttcgcttttcaaagtctctcccttatgccccttcactctcccttaaaccctccatggtcaccttctcctctactcccaattcaggctggagaaatgcagcagaaggaggaagaagagacggaagaaccaattggacgtatgattctgccgaggcaagacgcgaggcagatgaaatgtctgagagtgccaaagaaacgatgaatgaaggctatgacagggccaaggatcaagcgcgggaagccaaagacagaacaaaggatttcgcacacgacgcaaaggagaagacaaatcagcctcaaagtcaccaggtatctacaattctgccactgctgacaacaaaaccggttccaaggtcggagagtacgcagattatggttctcagaaggcgaaagaaacaaaagatgcaacgaaggaaaaagctggagagtacacagattatgcttcgcagaaggcgaaggaaacgaaggacaagacaatggaaaaggctggagagtacactgattatgcttcgcagaaggcgaaggaaacgaaggacaagacaatggagaaggctggagagtacacagattatgcttcgcagaaggcgaaagaagccaaggacaagacaatggagaagggaggggaatataaagactatgctgcagagaaggctaaagaaggaaaagatgctactgtgaataagatgggagagtataaagattatacggcggagaaggctaaagaggggaaagatacgacgttggggaagcttggggagctgaaggactctgcggctgatgcggcgaagagggcagtgggttacttgagcggcaagacagaggaaaccaaagagaaagtctcggagacggcagaggcgacggctaataaggcggcggagatgaaggaggccaccagggagaaggctgccgggactgcggaggcggccaagaacaaggccgcagaggtaaaggacagagctgcagaaaccgcggaggcggccaagaacaagactgccgagactgctgaggcagcgaagcagaa

SEQ ID NO: 55 - DNA, 1378 bp, Glycine max
  CDS (33)..(710)
gtacttccttacaatcaaaaccaacaacaactatggcaagttatcaaaagcactacgatgatcagggtcgcaaggttgacgagtatggcaacgttgagaagcaaaccgacgaatacggcaaccctgttcatgctgctagtgtcacctatgtagccaccagaactgctgctggtggttacagtgatgacattaataagcaacatgataccaccaatgcctacggcgtagacactggtagacagcattctagtggtggctacgatggtgacactaataaacatcatggaactactggtggctataatgatgacaccaatagacatcatggaactaccggtgtctatggtatagacaccgataggcaacaacatgggactactggtggctatgccggtgacactggtaggcaacatgggaacatcggtggcccttactatggaaccaacaccgcagacaccggtactggtcccagaagtggaaccacgggcggcaccggttatggaggcactggtggcactgattatggaacaactggtggcactggttatggaagtggaactgggtatggagtcaacactgggggtgcgcacactgaagcaggatataggaaggaacatcgtcagcatgaccaatctcatggtgatcagaacgagaagaaagggattatggacaagattaaggagaagcttcctggaggacacagtgacaagtagatgcatcgtgcatcatgcatgcatgcatatatataatattgttgtctttgaataaatttgctgcatatgtacttacgtacgtacagtgtcttgtcatgtatgtggaggatatagtatatggttatagtttatgtagaagaataaaaaatgtatgcatgtagtaatgtaagggtcttatatatgtggctgaaatataaaccataataaaggcagagatgttgtgccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccccccccttaagaattttcccccccggaaattaatttcggaccgggccctgggggggacccaattttcccttatgggggggctataaaaacttggggaaaaaaggggaaaaaatttttcccggggaaaaatgttttcccgtaaaaattccccaaaaaaaaaaaaccgaaaacaaaaaagggaaaaccccggggggcctaagggggggcccaacccaactaattgggttggcccaactggcccttttcaaggggaaaaactttgggccctcttctttaatgaatgcccaaccccggggaaaagcgttttccttt

SEQ ID NO: 56 - DNA, 856 bp, Zea mays
  CDS (91)..(558)
attcggctcgagggcttctcctccccctccggttcgggttcgggttcgtgaggttctccggggttcggtttcgtgggtgggcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccgtgatggcggcggcggctacggcggtggcggcggcggctacggtggcggcggtggctacggtggtggtggtggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtctcgtttgttgttgcccatctgtgtttttgattgcaaggtcgctctgtgtcagttgttagtgctgcgttcatcctcggctccagcagacccatgcatcaaccagcatggactgtggatcgatggatgctgttactcctgtcaggatttgttctaagttaatcctaaggaaaaaatggtgcttcttggtgctgcaaaaaaaaaaaaaaaaaaaagg

SEQ ID NO: 57 - DNA, 839 bp, Zea mays
  CDS (84)..(584)
ccacgcgtccgcacgatcgagcacacaaccacgaagactcgtttattaggagaaaccacaaaccaccaagccgtgcaagcatcatggagtacggtcagcaggggcagcgcggccacggcgccacgggccatgtcgaccagtacggcaacccagtcgggggcgtcgagcacggcaccggcggcatgaggcacggcacgggaaccggcggcatgggccagctgggtgagcacggcggcgctggcatgggtggcgggcagttccagcctgcgagggaggagcacaagaccggcggcatcctgcatcgctccggcagctccagctccagctcgtcggaggacgacggcatgggcggaaggaggaagaagggaatcaaggagaagatcaaagagaagctgcccggaggccacaaggacgaccagcacgccacggcgacgaccggcggcgcctacgggcagcagggacacaccggcagcgcctacgggcagcagggacacaccggcggcgcctacgccaccggcaccgagggcaccggcgagaagaaaggcattatggacaagatcaaggagaagctgcccggacagcactgagcggcgcctatacacgtggctgtgctttgctggcgcgtcaaagccgtaatgttcagtgtttcatagataataagataaacccatgaataagtgtcctacccttgatcatgtgacagggacagggacagtttcctgtacttgtggggtgaatttgtacgtgtgatacggtaactgggtccgtgtactgtttatgctacgttttccatacttaaaagtacgtatatataaaaaaaaaaaaaaaaaaaaaaaaag

SEQ ID NO: 58 - DNA, 1341 bp, Zea mays
  CDS (98)..(967)
cactgaagaagccagtcaatagcgagttctactactagtagctagcctgctgatctgttctgttgtttagttcgcaaagccttctgtttcggcgaccatggaggatgagaggaacacccagcagcaccagggcggtgaggcccagcaggacgccgccgatcaggtggacgtgaaggatagggggctcctggacagccttctcggcaggaagaagcacgacgacgaccaggagaagaagaagcagacggatgagctggcgaccggcatggagaaggtcacggtgtccgagcccgagaagcacgggcacaaggaggaggagcacgaggtcgtcggcgagaagaaggagggccttctcgccaagctgcaccgcaccagttccagctccagctcgtcgagcgacgaggaagaggaggcgatcgatgagaacggcgagattatcaagaggaagaagaagaagatgggcctcaaggagaagctcaaggagaagctgccgggccacaaggacggccaccacacggccgcaccgtccccggcgcccgcgcccgtggagacgcatgcccaccaccaggaggaagcgcacaggccgcacgtcgtcccgaccccggccccgccgcctccaccgcacgtccaccagcacgaccacggcgtcgtcgtccaggacgacgtgaagaccgggaccccgccgcatgcaccggaggaggagaagaaaggcctgctggacaagatcaaggagaagctccccggtggccacaacaagaagcctgaagccgctgccgctgccgcaccggctccgcccgtccacgcgccggcgccggcgccgcaggcggagaacgtgagcagcccggatggcaaggagaagaagggcttgctgggcaagatcatggacaagatacccggctaccacaagagctcagctgaggaagcagaccacaaggcggacgccgccggcgagcacaggaccagctcctaaggtcgcagtcgcagcgcgtgtcctggccgtggccgggccttgggcgatcagaaggtagctagcgttggcatgtgggttcggttctggtttgcttttaccaaaagtttgtttcaaggtggatcgcctggtcaaggtccgtgtgctttttaaggtggatcgcgtgactggcagtgagtgttgctgcttgtgtaggacgtggtacgtacgggttttattttggttccaagtcaaaagtcacggtcggtctggatgttgtgtactgggtttgttgaattatgagcagctgcgcgttgtaattcggctgggctacctggatgcgttaataattgctttggtttctgcccaaaaaaaaaaaaaaaaaaaaaaaaaaa

SEQ ID NO: 59 - DNA, 2073 bp, Saccharomyces cerevisiae
  CDS (1024)..(1527)
gattgtgttacacgctctatcttctttctcacaccttccttcttctacttccggagtatagtctctagcttatccttgatggctctttttatgcaggcagaataattacagtgacgtatttgtggcttctttggcacaacgttttgttccacgatcacctcatatcaccgttaagttcttcatcgtccaattccggagttccccgtcagccgtgcgaccatgtggtatttcacccgaataattaagggaaaacagaaggagaattacgtatcttaaaggagctagactctttgcctcattgaggctttctatacatcgggtccccatgtatggtccgttccatagtcgaagcatccttaatttcctgtgacattacagtagtttcgccgtagagcctttcacgggaagaatatgttcagtggttccaggtatgggtttgaggatgttcttgtaaggtgtgtagatcccatcttttttagggatcacaaagggaaaataactacacagcatgtggtggtacagatgaggtcaatggcagttttgccttagttgtaagtaattaaccaatccttgtcgtgcttctcatgaatgtgtatgaatttatgttcatcagaatatccctctttaaccacagttcttgcgtaaagcatagtctggcttcctttagaaaaaggaaatgtggtaattctaggaccacgttttgggcttcgtcatttcttttcactcctccacttttatgacatttgatcgcaagttcctccatacatcatgcctagtaatcaaaacaaataacgcacaagggagtaaagggaaatggttagaaaagaccgaaatcctttttttggtctccgttacgtgcttgttaatcaggctcccttgaagcagtcaatatttcttggactataaaagcacattactatttcatcaaaaaaaggatacatacctaccctcaactcttaatatctactagcagcagagccaaacactaccgcataaaagctaagtacgaataacaattaagaaatgtccaatctattaaacaagtttgctgataagttgcacggcaacgatcatgatgaacgttacgaagacgacaatgacgaccagactagacaacagcgtcatgaaaaacatcaacagagggaattcaggaatcaaggatccaaggccgatccctacggcgaagaaaaccaagggaatttccctcaacgccagcagccacagtctaatctaggcggtaacacgcagtttggcggtaacgacttccagcaacaaactactgactacactgccggcactggtggtggcacttatacccaaacttaccgcgaaactaacactcaaggtcagttggacgacgatgaagacgatgacttcttgacttcgggccaacagcaaaaacaaggtcgtacaagaggtgctcaaagtaaccgctaccaatcctctaatatcggcagcggtagacgcgatctgtctgggtcaggaaacgatgaatatgatgatgatagtgggaaccaaggcgtctggtagatgcggtggtcgaagcttctattacatgcctgaggtgcgggtctcacccttgagcagcaagtgagaaattttaccctaatttcgtcttcttttttcttttttcttcatctggacctattattggtcatgatgccactttttacaaactatttcatatgtttaatctagtttatttagatctacagctgtcagtttatacgtttttattaatgtcagtttgatttgattagtagtgacctttttcgtcgaggtatgccgtttcacggacctccagatccaggtgtataacaatagaattatgggaaaacggggtgggaaggtcgttgtctaactcaaacctcctggaattagcgggtaaagtgtcgttattgtgctgggcaacaacttttttttacgatttctttttacctctcatctaggttagtgttagttgtaaaaacccgagcagattggtgccttttcaagtgcgttcttacaaccatacttttttattctagaacgtgtaagcaattactttctcaaaaaagcaaacgcaataaagat

SEQ ID NO: 60 - DNA, 1106 bp, Saccharomyces cerevisiae
  CDS (683)..(934)
aatatgcctgtaaaaactatgtaatatatcacaagtaacaacatttcatcaccattactaccattatgtagaaatttatgagcaaagacaaataagtaaagaaaaagacattgatataatataagagtatgctttcttcattttaatgtttggttgtgaattgaaagaataccattcgggcacgcaatagttatgaacttaaccgagctcaaataatttaaagataaaagataaaagataaaagataaaagacaaaagaaaattcatagcccatgttgaagtatcccagcgggaaatgttgctatccaacagaaagtaccaagccagtttcaaaaaggtacagaattaagtgatgctatccgtcccacaactaattttctccagcggaggaaatatacgcggagggggggaggaaaacctctcagtaagcaatgaagggatagataatgggggcgcgcctgcctagcttaggctaagaaactccttcgaaaacagggggctgcgagcgcagaagcgaacacttgtcatttgtataaaaggactatttataagtttgctttttgtcactctcttggccctaattacccatactattgtaacaattgttgtgtaaactcaattatacaaataaacgaacaatcaacagtaacaaaccgctcaagtgtacaaccaatcagaaaaaatgacgagaacaaacaagtggaccgaacgtgaaggaaaggctgatccaaagtacttttcgcacactggtaactacggtgaatctccaaatcacatcaagaagcaaggttccggcaagggtaattggggtaagccaggcgatgagattgatgacttaattgataatggtgaaatacccccagtgttcaagaaagatagaagaggctcaaatttgcaatcgcatgaacaaaagtttgaaaacgtccaaaaggaatgagggcgttttcaagataaaaaaaggttttttgatctctgaaggatagtggccttctccactgatttatatgcatctataggtatatacttgcatgcctacttcatgacttatgtaatacagttttcttacatccatttaatttacgttcgaagaagttttcaacatttgt

SEQ ID NO: 61 - DNA, 1042 bp, Saccharomyces cerevisiae
  CDS (376)..(855)
ggtacccctttaagacaactatctcttaaccttctgtatttacttgcatgttacgttgagtctcattggaggtttgcatcatatgtttaggtttttttggaaacgtggacggctcatagtgattggtaaatgggagttacgaataaacgtatcttaaagggagcggtatgtaaaatggatagatgatcatgaatacagtacgaggtgtaaagaatgatgggactgagagggcaattatcatccctcagaatcaacatcacaaacatatataaagctcccaattctgccccaaagttttgtcctacggcatttttcaatctttcgttatctgtgctctttactttagtagaaaggatataaaaaagtatagtcaagatgtctaacatgatgaataagttcgctgaaaaattacaaggtaacgatgattcccatcagaagggaaagaacgccaaatcctccaacaaggaaagggatgatatgaacatggacatgggtatgggtcatgatcagtcgaagggaatgaagatgggccatgatcaatctggaacaaagatgaacgctggcagaggaattgcgaacgattggaagacttacgaacatgaaaatatgtacgtttttggcgcattaaccaagtcctcttatttttttaatggtttatttatgaattgtttatgtttatgttctttatactcaaaatcaataagtgcttattttagcgaattttcttctacgaatatatataagtcatatctaagacttccatccgtgctttattacgtttgtatgatgcatacaatgatgccaaatcagcttgatgctgttggtattcagtcgtccgaaagcctgttgatgtgacactcaaatcttcggcatgtgtgaacggtggccgagcatagttcgtgaacatcatcacttaaaataagaactacactttacatcagcgtggaagataaaggttgttttaagctcaagggcgctggaggtgtagcgcttcggaggaaaataatattgaataacttcgctttttgttccaaattctaga

SEQ ID NO: 62 - DNA, 1446 bp, Saccharomyces cerevisiae
  CDS (744)..(1130)
actgaaaatataattttactgacctacctacactgatttgtctcgaagtagatatgataccttgagcagcacgaggatattaaaaagtagggcaattctgcttttaacgtataagcaacaccaagtacacgtaatttattttgatgattcttctatattttttttttcttcattgttattttttcactatctttttcatccctccgcaaaaggacgcgatccttttttagcacgtgaacggtaataacgggtcctggacgatgtattagagtcacctaatcaccaagcgagccaatggcgactcacttgacttgcatgtttgcataacctatttagcgaaccctccaacttctgagcgcaccagcttaacttgtgcgctaagctgccttgcccgacatagtgccatcgctcattccacctcacacctgattaactaaaagttttaaaactacgggactgcgaaaaagtagagctacgttactgcagacctacaataattgcacacatcggcctgataacgaatgcttctaaaattctactgtgctactatcggctggtcgcgcccgacgggttcgctcagccgctctgcgccctcttactcttcagccattctgctgcggccgaagctataaaagtatgtcaatttggctttttccaaaatccccctctggctctttctcttctcaagacaagcattgaagagactcactagtaagcttaagatagtcctacacacaaccaccatgtctgctaacgattactacggcggaaccgccggcgagaagagccaatattcccgtccctccaacccgccaccttcatccgctcatcagaacaaaactcaggagcgtggatacccaccccaacaacagcagcagtactaccagcagcagcagcagcatcccggatactataaccaacaaggatacaatcagcaagggtacaatcagcaagggtacaatcagcagggctacaatcagcagggatataaccagcagggatataaccaacaaggccatcaacaaccagtctacgtccaacaacaaccaccccagaggggtaacgaaggttgtctggctgcatgtctggctgcattatgtatatgctgcaccatggatatgctattctaagagaacccgcaaaagtattcaagaatgaaaaaaaaaaaaagaataatctccccttctgttctttgcagttgcctttcttcccctcagtgttattttttttcacaaggagataaaaaaaaaaactttaacatgtcactttaagcatgtatgtaatacgtctattaattatatgtaacttttataactattttcatttctatgtgatccatttgcagttatgcaccttttttttttttccgaattgtgctatgtatatatcactagtaataatgtaccaaactatacaaacacgtaggatacagtaaaaaaaatttta

SEQ ID NO: 63 - DNA, 665 bp, Saccharomyces cerevisiae
  CDS (282)..(611)
cccacaaacacagaccagaagcactctagacggagagtaactagatgtacagcccctggaaaatcgttggtcaactttgaggttccggtcgtccccctcttgatctgaaaggtctttctctaaatctatattaaaacgtataaataggacggtgaattgcgttctacttcctcaattgcgtttgatcttatttaatctctctctatatatagaaaaaaaaaccatctgttattcgataatctcaaacaaacaactcaaaacaaaaaaaactaaatacaacaatgtctgacgcaggtagaaaaggattcggtgaaaaagcttctgaagctttgaagccagactctcaaaagtcatacgctgaacaaggtaaggaatacatcactgacaaggccgacaaggtcgctggtaaggttcaaccagaagacaacaagggtgtcttccaaggtgtccacgactctgccgaaaaaggcaaggataacgctgaaggtcaaggtgaatctttggcagaccaagctagagattacatgggagccgccaagtccaagttgaacgatgccgtcgaatatgtttccggtcgtgtccacggtgaagaagacccaaccaagaagtaaatctttcggaactctttgtagttacatgggtttttttctttgtgatgtgtgtga

SEQ ID NO: 64 - DNA, 958 bp, Oryza sativa
  CDS (87)..(686)
gttcgatcaagataatcgagcaaaatccatcagagttctaacattcgcgcgtgaatttcgaggttaatttttgaagcttaggatcaatggcttcccaccaggaccaggctagctaccgcgccggcgagaccaaggcccacaccgaggagaaggcggggcaggtgatgggggcgagcaaggacaaggcgagcgaggcgaaggacagggcgtcggaggcggcggggcacgccgccggcaaggggcaggataccaaggaggcgacgaaggagaaggcgcaggcggcgaaggagagggcgtcggagacggcgcaggcggcgaaggacaagacctccagcacgtcgcaggcggcgagggacaaagccgccgagagcaaggaccagaccggcggcttcctcggcgagaagaccgagcaggccaagcagaaggccgccgagaccgctggcgccgccaagcagaagaccgccgagacggcgcagtacaccaaggactctgccatcgccggcaaggacaagaccggcagcgtcctccaacaggcgagtgagcaggtgaagagcacggtggtcggcgccaaggacgcggtgatgagcacgctggggatgaccgaagacgaggccggcaccgacgacggcgccaacaaggacacctctgccaccgccgccgccacggagacgacggcgagggatcactagacgccgtgaatgatttccctttgggtctatttatgtatgttttcacttcaaattcggtgcaagtttgaatttgtttttgtgtcgttttgagtctgtatcgatgctgtatgaagtggtggtcgtcgcaggggaggatttctgacgggtgtgggtgatgtgtactgatgatgttcagttgttttcgtcagagtttctcgtctgtgttctgtttattatggcgtaacaataataaaagtttgggcctaaagcccgcatttgtggtttaaaaa

SEQ ID NO: 65 - DNA, 958 bp, Oryza sativa
  CDS (70)..(714)
gagtgtgtgtgactcgatccagcgtagtttcagttcgtgtgttggtgagtgattccagccaagtttgcgatggcttctcagcaggaacgggctagctaccacgccggcgagaccaaggcccgcgccgaggagaagacggggcgcatgatgggcacggcgcaggagaaggcgcgggaggccaaggacacggcgtccgacgccgcggggcgcgcgatgggcaggggacacggcgccaaggaggcgaccaaggagaaggcgtacgagaccaaggacgcgaccaaggagaaggcgtacgaggcaaaggacgcggcctccgacgccaccggccgcgccatggacaagggccgcggcgccgcgggcgccacgagggacaaggcgtacgatgccaaggacagggcggctgacacggcgcagtccgccgccgaccgcgcccgcgacggcgccgggcagaccgggagctacattggacagaccgccgaggccgccaagcagaaagcggccggcgccgcgcagtacgccaaggagaccgcgatcgccggcaaggacaagaccggcgccgtgctccagcaggcaggggagcaggtgaagagcgtggcggtgggggcgaaggacgcggtgatgtacacgctcgggatgtcaggcgataacaagaacaacgccgctgccggcaaggacaccagcacctacaagcctggaactgggagtgactaccagtaatacggtataagaagcatgtgtcgtctttggcactgatgccaaagtgtacgtgttgtatcctcttttttaagtttcagctcgacttcgacgtgttcggtgtcacactttggtttttcagttgtgctcaactgttcatgtttctggttccatggagggccagtgtggaggtcaatgtttaagctttcgttttaaaatctgataataaagttggttaagacctgaaagcgttaaaaaaaaaaaa

SEQ ID NO: 66 - DNA, 1156 bp, Zea mays
  CDS (94)..(1008)
acccatccacaattggtagctcgttgatccaaatccaagacctcacgtcaacgcactgtctcgcctgttaattagtcgtcgacgtcgtcgtctatgtccaggctgatggctgccatgctgctcggaggcgcgcgcgtcgccggcgccgcaaagctcaccggtaacggcaacgctgctggcatgcaggctcttcccatgccggcgtgcttccttccgccgcgcccgcaggcagcgacctggacccgcctctgcttgcaggctgcgccaagatcgtcccaggcatacgacaacgcgccggaagaccggagagaaataggggacaagtacaaggacgcggcggaggaggcgaaggacgccaccggggacgccaaggagcacgccaagaggatggccggggagacgaagagcagggcgcaggacaaggccggccgcgtggcggaccaggcgtcgggcatggccgagcgggccaaggaccaggcgaagggcgtggcggaggacgccgcggacacggcgtcccgggcgacggagcgagcgaagaacgagacgcgtgacgcggcgcgggaggccgcggacagggcggggcacgtgaaggagcgggccaaggaggcgggacacgaggccgcggaccgggcgcagggggcggcgaaggcggccaaggaccggaccggggaggcggcggggcgcgccatggacagggccggggaggccaaggaccgggccgtggaggggaccgcgtcgtacggggagaaggtggtggagatgaccaaggagggcgcggggaaggtggccgagacggcgcaggccatcggggacatggcgaagcaggcggcgcggagcacctgggacgcggccaaggacaccgcgcacggcgtcaaggagcgcgtggtccccgacgcggaggacgtggacgccgccgtgaaggagcgggaccggatcgcgcgggatgtggacagggtagagcgggagcggaacatgagggaggccagggagaagggctcgggcttgccgtaggcccagctccaattttccctctccagaagacgaattttactcaactagctagctgaataaatgtttggcgatacatcgtgcgcgcgccagtttggttgtgttgaataattagacaaattccaaattaaatttcgaataaaaaaaa

SEQ ID NO: 67 - DNA, 1009 bp, Zea mays
  CDS (85)..(777)
cgagttaacgaaagccttttatccaagctcagggaagggaagctcacagtttcgttggatccaatcttttatccaagctcagcgatggcttctcgtcagcagcatcctactagctaccacgccggcgagaccaaggcccgtgccgaggagaagacgggtcaagtgatgggggcgacgcaggagaaagggagggaggccaagcacaaggcgtccgacgcctccgaccgcgccatgggaatgggccacgacgccatggaggcgaccagggagaaggcgcgcgccgccgcggaccgaaccatggggatgggccacgacgccggggaggcggccaaggacagggcgtaccgggccaaggacgcggcctccggtgccgctggccgcgccagggacactgcgtccgacgcggccggcgctgccggggaccgcgcccgcgacggcgcgcagcagaccgggagctacgtcgcgcagacggccgaggccgccaggcagaaggcggccggcgccgcgctgtacgccaaggacaccgtggtggccggcaaggacaagaccggcgccctcctgcagcaggcaggggagaaggtgatgagcacggccgtgggggccaaggacacggttgtcagcacggccgtgggggccaaggacacggttgtcagcaccgccgtgggagccaaggacgcgatgatgaactcgctcggcatggccggcgaggacaaggacggcaccaccaccaccgacgccggcaaggacaccagcacccgcaagcctggcagggactattagaggacacggcagccaaacttctcagtgtttctgttccagaagtttctgatcccatcatttaggttcaaaagtttctcatttcatttcaaactttcagtgtttggtgcatgctgtaaactctcttcaggacgggtcgtttgacatttgtgtcgactgaagcctccgcgctttcgactcaacgatgtatatgtaataataaagtcgcaaagctgttgttttattttaaaaa

SEQ ID NO: 68 - DNA, 1623 bp, Zea mays
  CDS (125)..(1156)
gtcgacccacgcgtccggagatcggctgcctcgatttctcttcgagtgccaagcagtactgctagttctacttctgtacttcagcagtagtaggccgctgttgctacaattttgactgactgagatgggaatcctctgcctcggtgcttcctccacactgctctgcggggaggacaggaacaacgtactcggcctcggctgcggcaacgagctggtggaggtggggagcggccatgacggcttggactccgtcgtcggcgccgtgttccccgtggacacagatgaggccgtgcgggcgttgttggagaaggagacggaccacaagcctcaagacggctatgcggagaggctggagcgcggcggattggagtactcctggaggagagacgccatggattggatttgcaaggtccattcgtactacaggtttggaccactcagtctttaccttgctgtgaattacctggatagattcctctcctcatatgatctcccacacgataagccttggatgcgacagttgttgtcagttgcttgcctagctctcgctgtcaagatggaggagaccgtgctccctcttcctgtggaccttcaggtctgcgatgtgaaatttgagtttgaagcaaggactattgggaggatggagcttcttgtgctggccaccctgaaatggagaatgcaggctgtgacccccttcactttcatcagctacttcctcgacaagttcaatggtgggaagccgccgagtatggcactagcgtcacggtgcaccgagatcataattggcacactcaaaggctctacattcttgtcattcagaccatctgagattgccgcggcctcagctctagcagcagtttctgagaatcaggttgttggctcctcgagtgctctttcagcatctgaagtccctataaataaggagatgattgctagatgctatgagctgttgcaagagcaagcgctggtgaggaagacagggcacatcaatggaagcccttcagtgccgcaaagcccgattggcgtgctggatgcaacatgcttcagctttaggagtgaagatgtaagactaggatcatcgcaatcaaacaacatcagtagtagtagtaacgacaatcaagtttctaagaggagaaggctaagcatatcaccaatctgagtagatcaaaactctgttggcagtgtcgcattgtgcgcttggttatgcattgatcatcttaacctcagagcttgtcagagcaacaagtagtggtacaaaaggacccagtgaagcattgtaacaagcagaggatggtgacagtaataagttagaagcagcttcttgatctctgcgacgaaataggtgacgaggaacgtttcttcctctagtaactttgaatccccttcctccccggtccctttgttttattccttttcctttttatcggtatctcaaggcatttgtggggactggggagatatatgtggatatgagattggagacgtgaggattaaagagagagagagggagggagggagataaaaaaaaaacaggtttgttcctttgttctctgccaatatacaaaaaaactgtcgtgcgaaaaaaaaaaaaaaaaaaaaaaaaaaaaaaaaaagggcggccgc

SEQ ID NO: 69 - DNA, 1793 bp, Oryza sativa
  CDS (148)..(1407)
  unsure (1)..(1793): unsure at all n locations
aaataataatgtcttgccttttgtagatccgcgtggctcgtactgctacatgttcatatcgctgcctgtttcttcgatttctgacaaaaaaagcgttcgtgttctgacaaaatttcggtttggtttttctacagtagaacgtcagcaatggagaacatgagatctgagaactttaaccaaggtgtttcaatggagggcgtcaagcatgcgcccgagatggcaaacaccaacaggagggctctgcgggacatcaagaacatcatcggagcacctcaccagcacatggctgtgagcaagaggggtttgctagataaacctgccgctaagaaccaatctggacaccgtcctatgacgaggaaatttgctgcaacactggcaaaccaaccctccattgctcccctggcacccattggaagtgagaggcaaaaaaggacagcagattctgcatttcatggtccagcagatatggagtgcaccaagatcacatctgatgatttgccattgccaatgatgtctgagatggacgaagtgatgggttctgaactgaaagaaattgagatggaagacattgaggaggcagcacctgatattgacagctgtgatgcaaataactcccttgcagtagttgaatatgttgatgaaatttacagcttctacaggaggagtgagggtttgagctgtgtctctcctaattacatgttgagccaaaatgacataaatgagaagatgcgcggcattctcatcgattggctgatagaggtgcattacaagttagagctattggatgagaccctcttccttactgtgaatatcatagaccgattcttggctcgcgaaaatgtggtgcgaaagaagcttcagttggttggcgtgactgccatgctgctcgcctgcaagtatgaagaagtgagcgttcctgtagtggaggatcttatcctaatctgcgaccgcgcctacacaagaacagatattctcgaaatggagaggatgattgtaaacactcttcagtttgatatgtcagttccaactccatactgtttcatgagaaggttcctcaaggctgcacaatctgacaagaagcttgagctcatgtctttcttcataattgagctgagccttgtcgagtatgagatgctcaaattccagccgtcaatgctggcggctgctgccatctacactgctcagtgcaccattaatgggttcaagtcctggaacaaatgctgtgagctgcatacaaaatactctgaagaacagctgatggagtgctccaagatgatggttgagctccaccaaaaagcaggacatgggaagcttactggagttcatagaaagtacagcacatttaggtatggttgccccgcaaaatcggagcccgccgtcttcttgctcaagagcgtggcactgtaactgattggctcactatacacactctaactacttccatggaaagagggaatgaggggtgtatatatagaggccggctgctttgatgaaattacagagaagagatctgcatatatgcaacagctgttgcaaaggattatttgatgggtgggttgggttggtgcaatgtgtgcctttacttccaataacttaacatcgtcgagacattgatctgcgtttggatgttttaggttgcttccaattaaatctgttggaacttgatttcatgttgtatttaagagaattattcttcatttgttctgtggcacatgcaatttgccaataaacattaattgaattgcctgttnaaaaaaaaaaaaaaaaaaaaaaaaaaaacaaaaaaaaaaaaa

SEQ ID NO: 70 - DNA, 1223 bp, Oryza sativa
  CDS (97)..(870)
ttcccccctcccctccggcgaactccgagctcttcccggtgagcgccgccgattcggccggagaggctcgccggagtcgcctccgccctgcccacgatggccgccaacttctggacgtcgtcgcactgcaagcagctgctggaccaggaggacgtggacaaggtcccccaggcggacagcgaccggggcatcacgctggaggagttccgcctcgtcaagatccacatgtccttccatatctggcgattggcacaacaggtgaaagttagacaaagggtgatagctactgctgttacttatttcaggcgtgtatacacaagaaagagcatgactgaatatgatcctcgtctggtagcaccaacctgtttgtatttggcatcaaaggtggaagagagcacagtgcaagcaagacttcttgtcttttacataaaaaagatgtgtgcttctgatgagaagtaccggtttgaaatcaaggatatccttgaaatggaaatgaagctcctggaggcacttgactattatttagttgtttaccacccatatcgtcctcttttacagttattgcaggatgctggcataacagatctgacacaatttgcctggggaattgtcaatgatacttacaagatggatcttattctcatacacccaccatatatgatagcattagcctgcatctacattgcaagcgttcttaaagacaaggacataactctgtggtttgaagagctccgtgttgacatgaacattgtcaagaatatctcgatggaaattttggacttctatgacacctacaagattgatcctcaaagagggctcccagaggacaaaatagcccctgtgatgaacaaactgccttcaaaggcctaaagcagactgagccctagttcagttgttatcagtctgagcgtcaaatcaccttatgctcgtacaacaggaaatatgtgtcaccttccttggagaactttatatttcaaagccatatatatatatagtatcagaattcagaattgcccctaacgaacgatttaattcagaattccgaactatatacagctgttcctgttgcagcagcttgcgaggcaaatcatttacaatgaagatcccaacgggttgggaatggtctgtatctgtatgtgtttttgatgtgtaaaaaaaaacatggctttggtactatttagtttctatagcaaatgaaatcctgaaaaattcttgcggtgaaa

SEQ ID NO: 71 - DNA, 1611 bp, Oryza sativa
  CDS (74)..(1336)
cccacgcaggccatcgccatgggcgtctcggctctcctccgcctgtagatcgtgtggatcgtgcttacctgcgatggatagggcgagcgagaaccggaggctggcggcggtggggaagcccgtgccggggatcggagagatggggaaccggaggccgctcagggacatcaacaacctcgtcggggcgccgtcgcacccgtccgcgatcgccaagaagccgatgctagagaagagtgggaaggaagagcagaagcctgcattggtggtgagccaccggcctatgttgaggaatttcgcggcctccttgacgcgaaaagaacagcttgaccatcaggtttccgtggctgatgcagcggtcgtctgcactgatccacagaagaaccccatccccgatggcacagttgacgacgatgtggaatcgtgcgaatcgaacgactatattgccgtggatgaatgcaatgatactgatgaggatgagtccatgatggacattgacagtgccgactcagggaatccgcttgcagcaaccgagtacgtcgaagagttgtacaagttctatagagaaaatgaggaaatgagttgtgtgcagcctgattacatgtccagtcaaggagacataaatgaaaagatgagagcaattctgattgattggctcattgaggtccatcacaagtttgagctgatggatgagactctctttcttactgttaacatagtagacagattcttggaaaaacaagttgtgccaaggaagaagttgcagctagttggagtgacagctatgctccttgcttgcaaatatgaggaagtcgcagtccctgtcgtcgaggatctagtgctaatttctgaccgggcttatacaaaaggacaaattctggaaatggaaaagttgatcctaaacacactccagttcaacatgtctgtaccaacaccttacgtttttatgagacggtttctgaaggcagctcagtctgacaagcagctacagctactttcctttttcattctggagctctccctggtggaataccaaatgctcaagtaccgaccttcgcttctttctgctgctgcagtttacacagcacaatgtgctctcactcgttgccagcagtggacaaagacctgcgaactacatagtagatataccggagagcagcttcttgagtgttctaggatgatggtagatttccaccagaaggcgggagcaggcaagctcaccggcgtgcaccggaaatacagtacgttcaagtttgggtgtgcagccaaaacggagcctgctctcttcttgcttgagtcaggagcaggaggttacaaccttcagaagcagccttgttgaatgaatctattcccctggatagatttttttaacttagcttcagaacaactacagcaagcatgttgatgcttcacaaaagtgcagcagatttaccttactacagctcttttgtggtaatgtaaacttggtgtgaatgatggataatctgggtggtggtcagtccttcagttatactggggggctaataaatgattcaggcattcagcctatgtaagctgaatctcttgtaaatctacatgtgttcaagtagcatgaagaaaataacttgcatgttg

SEQ ID NO: 72 - DNA, 2004 bp, Oryza sativa
  CDS (97)..(1623)
gtcgggaagagcacccaaaccctcgcttccgccctcgcaaaccctagcgcccggaggaggaggaggtgggttgcggtggtagtttgccgtccgccgatgtcgagcaacctagcagcctcccgccgctcgtcgtcgtcgtcctcggtggcggcggcggcggcggcgaagcgacccgcggtgggggagggaggaggaggaggaggagggaaggcggcagcgggcgccgccgcggcaaagaagcgcgtggcgcttagcaacatcagcaacgtcgccgctggtggtggcgccccagggaaggccggcaatgcgaagttgaatttagctgcctcagctgcaccagtgaagaagggatctttggccagtggccgcaatgtgggcacgaatcgggcctcggcggtgaaatcggcttccgccaagccggctccggccatatcccgccatgagagcgccacacagaaggagtctgttcttcctcctaaagtgcctagcattgtgccgactgctgcactggcacctgtcactgtaccctgcagcagcttcgtctcccctatgcattcaggagattcagtttcggttgacgagacgatgtcgacgtgtgactcaatgaaaagcccagaatttgagtacattgataatggggattcctcctcagttctaggttccttgcagcgaagagcaaacgaaaacctgcgtatctcagaggatagagatgtcgaagaaactaagtggaagaaggatgctccttccccaatggaaatcgaccaaatttgtgatgttgacaataactacgaggatccgcagttgtgtgctactcttgcttctgatatctacatgcacttgcgcgaggctgagaccaggaaacgtccatcaactgattttatggaaacaatccaaaaggatgtaaacccaagcatgagagcgatcctgatagactggcttgtggaagtcgctgaagaatatcgtcttgttcctgatacattatacctgacagttaactacattgatcgttatctttctggcaatgagatcaatcgtcaaagactgcaattacttggagttgcttgtatgcttattgctgcaaaatacgaggagatatgtgcacctcaagtagaagaattctgctatataactgacaacacatacttcagagatgaggttttggaaatggaagcttctgtcctgaattacctgaagtttgaagtgactgcacctacagcaaaatgctttttgaggagatttgtccgtgttgcacaagtatcggatgaggatccagcattgcatcttgagttcctagccaattatgttgctgagctatcactgctggagtacaatctactttcttaccctccttcactagtagcggcatcggctattttcttggccaaattcatactgcagccaacaaagcacccttggaattccacccttgctcactacacacaatacaagtcgtcagagttaagcgactgtgtaaaggcattgcaccgcctttttagcgttggtcccgggagtaaccttcctgcaatcagggagaagtatacccaacataagtacaaatttgtggcgaagaagccctgcccaccctcaataccgaccgaattctttcgcgacgcaacatgctgaactagaaaaataaaccaaggattagttacagttgctgactgaattcttcctccagaggcacctatgccaggttgtgccgtagaccgttcagataaccttgatgcaaggcatgctgcttgccccccccccccccccccctggttctttcaggcggtttggctgagtgtagatagatcgatgcttctgctgtgtgtggtaacttttatggtactgatgtgctttcttctatcttcttttccctgtacctagatgatccatggttttcagtactttgtacatcggagtcctgcagcaaagctttaaacatcttgtttgatattagctgccaacctgggcgtctcctaggttgatgtatgatagagtctctgttcgtgttgcttt

SEQ ID NO: 73 - DNA, 5100 bp, Oryza sativa
  CDS (292)..(361), (1019)..(1347), (1447)..(1572), (1657)..(1908), (2059)..(2217), (2315)..(2493), (3276)..(3432)
gaccgttggaaagatagacgccacggcaaaattcctcaattccccaccaaaaaaaaccaacccatcgcctacaaagccatagccctccctcttcttctccttcgaaaccaatccatctcgagttctcgccgtcaagaatcggaggagcagaggagagggaggagaattcgagagagaggagaggaggaggaggaggaggaggaggcggagtgaggtgtaagggggtggtggtgacgcgtcgctgattcgtgcggtttgctctgtggacgccgatcccggccgtttcgggcgatggcgtcgaggaggcagtggggagccggtgccggcgccgtcgatgttcctgctcaggaacgcaagggaggtaaggcggccaccgatcatctcctgcgcgcgttctttgccgtgttctttgttctggaggggctctcatggcggcggcggcggcggcgcgatggggagggggttttcttgctgcgatacgtcgcgtgcctgctttgccttcgtaggtttctcccgtccccggagattaggatttttaggatcgatggtgtgttcttgcggggttcttttacggtttcttgtccgatcgacgcttgattgcgaaattgtatgggttctttgatacgggttcttgttctgattcggcgtaaagagagcaccttttgaaaatcatgttcatgtgtggattattttttggtcccaaaatatgatcggaacgcatgtgcccgtggtggaagcagatgtttgtcgcgttggttgatttattgaatcgataggaatttcgcatgggttcttttggcatagaaatgatcttttgctggcgctgtgatggtttctgcgttgttctttgggtttgcttcgataaatctggcatcttcccagaattgcgtttcacctattgaatcgcgtttcttgttctgaatcatgcgtgcgctttcacctatttccgtgcaaaatttctcccttagcgattctgtgctttctcttgttactgatctgaaatttcgactttgtgcagaggctgccaagattgcgaggaggccaaagaccacgacggttgttgctcagcaaccgccaagaatccgtcgagccctcgccgacgtcagtaatctcgtcaatggccgggctgctctgcctgtcgtaaatcgccagaaggcagcagcagcagcagctgacaagtgcaggaaaccaatcaagcagcgcaacgagaacaacaaggcggccaagccagaagtcatcgtgatcagttcagactccgagaaacataagaaaaatccagcccagagagcagcctcccggagggcgccaatccaaacgctcacctcgattctgaccaagtgcagcagggtatgtgttctttggtgttgtttgattctgtaatgttgggaaatttttgtctgaagaatccgttttgttcttcttttgctgaacttgttctgaacacaggcttctgacggtgtgatcagcccgaaaaaggagctgatatacgacatcgatgcatctgattctcacaacgagctggcagtggttgattacgtcgaagatatctacagattctacaggaacaccgaggtgagcttagcttcctcttcttttatgccaaatcaattggtgatggaacggtgattgattactcttgctgcttgatttgtccagaacacctaccggcctctctgcacctacatggtgtcacagaccgagatcaacgagagaatgagagcaatcctgactgattggctcatcgaagtgcactacaggcttatgctgatgccagagacactgtacctcactgtctacataattgatcagtacctgtccctggagaatgtgcccaggaaggagctgcagcttgtcggtgtaagcgccatgttgatagcctgcaagtatgaggagacttgggctccattggtaaggattccacttctgcacaccactgatgccgttcaattttgcatatgatatgctcaacttgctattgtgttcaatgctgttcaatttgcatatgactttcagcttgcacttgcttcttgtcttacagttgagctgccatttttgcaggttaaggacttccttgtcatatcagacaactccttcagcaggcagcaggtcctgagcacagagaagtccatacttaacaagctccagtggaacctgactgttccgacaatgtacatgttcatccttcgatacctgaaagctgcattgggtgacgaggaggtaactaacaagcacagtccattttcagttgttcttctgctggtgctatacatcttcaatgtgttgtaatgtgccattcttttttctgtcaatgcagctggagcacatgactttcttctacgcagagctcgcactggttcagtactccatgctcttttttgcgccatcggtgatagcagccgctgccgtctacgctgctcggtgtacccttggcctgagcccactatggagcgatcttctggagtaccacaccggcttagctgagccgcaattgctgtatgtcttcttcttcatgacttgatctttgcccatgaaatttgattacatattgaatctgaagaatatgacctgtgaattgaattgtgttgactgcgttcccagaaagggatttcagttatataaatttggaatgctaaataatccatcttttcacaatcgttgataacctgttgtccttaagtttcatattcagagatggtcttttttctcatttgctttagttacttaaatcttgcctatgaaattttgattacacgttgaatctgaagaatatgacttgtgaatgaattgtgttgactgcttgcctagaaaaggatttcagttatatataaatttggcatgcttagttacattgttgtgtctccaccagactgactgaattttgtactactgaaagtttcagttgaatattgtcctggactagttggtgatgtccaaactttctttgtatgcaatggcatgttatgctctctctagtctaatccaagaacttaatctgttcatgtggcttgatacagatagttgtaacctgaagaatgctgaacagatagtcctaacatatgctttgaacatagaacaaaatatgaatctactacatgcgtatgctgctaaaattgctagtgcctaaccaattactttgatctgcaccattcaattaaaacgcctgtatgcataaatatgctgatcaagattttgattacatgactcttatcaaagatctgcaccatccaaattattaaaacttaatctgttcatgtggcttgttttttgagctgcagggagtgtgcgaggcggctggtgagcctgcacgcggcggcgccggagagcaggcagaaggtggtgtacaagaagtacgcgagccccaagctcggagccgtctccctccactcgccggccaagaagcttctcccgccgccgtcgccggtggcggcttgagctctcgctgttggaattttggcctcgattggaagaacatgtgcatagataggatcggatcgtcgccgcgtcgtcgtatcatcgctttgatgttaccccccgtttctgatttgattcttccaaattttgggttcctgatttgattggattgctactgattcgaatttggtgcgaatgaaattatgaaaaatcatcttgatgtttattctttttccccctttcctttttgagaggtggtaataatatttacatctttatattacctgaaaaaaatgttgccacggatgggtgggacccacgtggacacgtggccaaacggcagccaagattttgatagcctctggccagattcgctttccagccacacgatttcttctgtgacgtgtggcgtgagataactcacgcagctcagctggggccgacttcgtgggtcccacgagtcccatcccgatgatatgtggggccactggtatccgcgggcccacttgtcagtgtcaatggtgggagcatttaagtagaagaaaccagcactcaatcttcgactcctcctgctctgtttgttcgagtaattaattaagctccgaccacgaagcttctggcgattgtcggcgtcaagaacagcttgacgagcaggcagcaagaggattcgttcttcttctgtggtggatcttgattgggctccctgttttagtgttctgttcttcgcaagaaaggggccattctcttttggtttctacatgcaggtttgtgttcttcagttcttggtttgttgttgttgttatgggcatatacagtaagttctttcatggttagctggatgagaaatgaaagaaaaaaaatattgagaggatcggtgatgtccttgacgggagttaattgtgtgcaattgagtgatctgcttcagcttactcctctgttcttcttctttaatatgatcggttgtttgttcttctcaagaaaggccattctttttggtttctgcatgcaggtttgtgttcttcagttcttggtttgttgttgttatggcatgtacagtaagttctttcatgcttagcaggatgagaaccgaaaggcacaaattattagtgaaaagccaccgtgtgcgattgagtgatctcttccagcttactcttctactaccaattactctgttttcatcgaattcttcttctttgatatgatcttccacggttctgatctctgtcatgttatgatcctgtctgctaactagaattcttttttttttttggcttttcttttctgaatattgctgaacttttctaactcaactagagataactacaccactaattttcgaaatgacaccatgctcttgcataattaatcctgttgcctgcctttcggtgcacaagtatttgcaaagtaatcctgaattaaaatattctgccctgtttttgttttctttcagatgagtagcatggcatgccattcccttccagagagtggaagcaacttgtcagctgctgatgaactctttcagaaccaaaggtcagagcagggaatttactggacactctgggactccaggctatctgatgatctgaacacaacgaccgtatattcagacaatcatggcagcaacggtggcggcacgcaatctttcgacacctctgaacattgcagtacagtgccttcagattcagatga

SEQ ID NO: 74 - DNA, 1506 bp, Zea mays
  CDS (107)..(1222)
gaattcccgggtcgacccacgcgtccggcgacctgctcctgcccccgccgccgccgtgcacgcacagccggagcaggagcagcgctgcccgcctttaccgttgcccatggagaactctgccgccgccgccgccgcccggccgcgcctcacccgcgcagccgccaagcgctcagccgtcgtcacggctgtggccgtcgccgccaagcgcaagcgcgtcgcgctcagccagctgcccacgctccccaacgccgtgctcggcgcgcacgacgacgacgacgacaagcccgtcaggaagcagcgcctcctccccgccgccaagcccaagcccaagcccaaggcagcgcccgcgcctgccgcgcccgccgccgcggatgacacggatgacgacattcagctctgcaagccctacgcttccgacatctactcctacctccgctccatggagtcgcaggccaagcgccgcctcgctgttgactacatcgcggcggtgcagatcgacgtcacgcccaacatgcgtggcatcctcatcgactggctcgtcgaggtcgccgaggagtacaagctcgtctccgacacgctctacctcaccgtctcctacatcgaccgcttcctctctgccaaagttctcaacaggcagaagctgcagctcctcggcgtctccgccatgctcatcgcatccaagtatgaggagatcagcccgcccaacgtggaggatttctgctacatcaccgataacacctacaccaagcaggaggtagttaagatggagagtgatatactgaatgtcctcaagtttgaggtgggcagtcctaccgccaagacgttcctgaggatgttcatcagatctgcccaagaagacaacaagaagtatcctagcctccagttggagttcctggggagctacctttctgagctgagcttgctggattatggcttgattcgctccttgccgtcacttgttgcagcctcagccgtctttgttgcaaggctgaccctggatccacacacccatccctggagcaagaagatgcaaacgctaacaggctataagccatctgagttgaaggactgtgttgctgccatacataatttgcagctcaaccggacatgtcaatccatggtggcgatccgggagaaatacaggcaacaccgattcaagggtgtatcagctttgctacctcctgttgagatccctgcatcatacttcaatacactgaaggagtaggtgttccttgataatctaagagagccaagcacacagctttcctcaagcaagatgtgcaatgctaaggttgttagggtactgaggttcttggatgctgcatctaggcttggcttggagcattcagagttgatttgtttgaagttcaaactcaatagaaagttcggtgtatcaaatcttgtacttgtgtatcataattatacattacaaccaggtgcctttatttattgggggcacaattccaaaaaaaaaaaaaaaaaaaaaaaaaaaaaaagggcggccgc

SEQ ID NO: 75 - DNA, 1699 bp, Zea mays
  CDS (137)..(1408)
gaattcccgggtcgacccacgcgtccggtcacggggctcctccgtccgtaaggcaccgccgcagcgtctcggctggatcaacaggccggccgatccgtcttcttcccctcctcctgcgggtcggcgtttggggatcatggcggcgcgggcggctgacgagaacaggagaccggcggcagggaagcccgcgccaggcgtccgagacatggcgagccggcgcgcgctcacggacatcaagaacctcgtcggggctgccccgtacccctacgccgtcgccaagaagcccatgctgcagaagagcaaaagggacgaaaagcagccagcgttggcaagcagccggcccatgacaaggaaattcgccgcctccttggcgagcaagggccaacctgaatgtcagccgatcgtagctgatccagaacccgaagtttgtcaacagaaggaatcagtaggcgatggcaccgttgatattgacgtggaactctacgagctggtcgacggtagtgatagtgacatcgacatgggtgcgacagagaacaaggacattatgaacgaagatgaattgctcatggatattgacagtgcagactcggggaacccgtttgctgcaacagaatatgttaaagagctttacaccttttacagagaaaatgaggctaagagttgtgtaaggccagattacatgtccagccaacaagacataaactcaaagatgagagcaattctgattgactggctgattgaggttcactacaagtttgaactgatggatgagacgctctttcttatggtaaacataatagatatattcttggaaaaggaagtggttccaaggaagaagctacaactggttggagtcacagctatgctgctcgcttgtaaatatgaggaggtatctgttccagttgttgaggaccttgtgctgatatcttaccgtgcctacacaaaagggcaaattttagaaatggaaaagttgattctgaacacgctgcagttcaacatgtctgttccaacaccttatgtcttcatgaagaggtttctgaaagctgcagatgcagataaacagcttgagctagcgtcatttttcatgctggagctctgcttggtagaataccaaatgctgaattatcggccttcgcatctggctgctgctgcggtttatactgcacagtgtgctatcaatcgttgccagcactggacaaaggtctgcgagtctcatagcagatacactagcgaccaactcctggagtgctcgaggatgatggtagattttcaccagaaggctggaaccagtaagctcactggcgtgcacaggaagtacagtacctacaagttcggttgcgtggccaagattttgcctgcgcagttcctgctggagtcgggagggacaccgcctccttcaggtgcaaactagttgaatcgacctattcaactgggtggattttttaaagtttttagaatactccatgaacaagatgcagaaaacatcgtgttgatgttgcccaaaagtgcatcgaatttctttggagagttatgattaacaactttttttttatctatgttgaatgacgagtgacggtcggtcacgttgtgcttgtgcagttatactgcggctaataacaaactgtccagttattctaaaaaacaacgaacgatgttcaggaaaaaaaaaaaaaaaaaaaaaaaaaaaaagggcggccgc

SEQ ID NO: 76 - DNA, 1751 bp, Zea mays
  CDS (82)..(1518)
gaattcccgggtcgacccacgcgtccggtccgacgagccctagggaacgcgagaccggccgtcggcgagagaaggactcgaatggagtgcgcaagggagttgcgggttcgctccacgtttacggcggcggccatggcgtccaagaagcaggtggggcctggaggcgcggttcccgctcaggaacagatgaacggcggcgatgccgccagactggtcaggaagccaatggatacatttccacagccagcggcggcaagaggccgtagggcacttgtcgacgttggcaatcttatgaatggccggccttctcttgtgaaccatcagaagcaagcggttgcggcagcggcaaccagtcataaaccactcaacgtcggcaacaagaagccacttgttcctcaggcagcagcaagaggcctgcgaccccttgccgacgttacgaatcttatgatcaaagaccgtgctgctcctgcaaatcgtcagaagcctgtggatgctgtgtttaacaggaacgggaaggcagtaaagctgaaggaatgcaaggtgaagcctgaagtcattgtgatcattccagattccgagaaggagaagaaaggcaaattccctggaggtcagagagtctgtaggagggtgccaacactttttgacaatttgacaaaatgcagcagggcctctgatgggattaccaccccgaagaagaaggatccatatgacattgatgcacctgattcttgcaatgagctggcagtcgttgaatatgttgaggacatttacagattctacaagagcactgagggcacctgccttcctctcagcagctacatgagctcacaggctgaaatcagtgagagaatgagagctatccttattgactggattatcgaggtacagtacaggcttactctaatgccagagacactttacttgaccgtctacatcatcgaccagtacttatctatggagagtgtaccaagaaaggagctacagctcgtcggcataagtgccatgctgatagcaagcaagtacgaagagatatgggctccactggttaaggacttgatgtgcctatgtgacaacgcatttaccagagaccagattctgaccaaggaaaaggccatcctggacatgctccattggaacctgacggttccaacaatgtacatgttcattgttaggtacctgaaagccgcaatgtgtgacgcagagcttgagaacatgacattcttctactccgagctggcattggtccagtacgcgatgctggtttaccctccatcggtgaccgcagccgctgccgtctatgctgccaggtctacacttgggatgaatccacagtggactgatattctggaacatcacactggcctagctgagccacagttactggactgcgctaggcggctgatcagcttccatgccctggctccggaaagcaagcaaaaggcggtgtacaggaagtactccaagcccaagctcggctccgtcgcgcttcaatcccctgacaagaagctgttgtcaggttgaggctcgctgctgctcattgtattgtatatcatcgcttcgatggtaccatttgtttgggtcgtgtgctcttatgcttttctactgaagcagagcatgtgttggttagtcagtttgcttaaacgactactgaagcagagccttgtatgtgtgttgggagaatgtgatatgtgatgtcaagctcaaaaaaaaaaaaaaaaaaaaaaaaaaaaaaaaaaaaaaagggcggccgc

SEQ ID NO: 77 - DNA, 1850 bp, Zea mays
  CDS (254)..(1579)
gaattcccgggtcgacccacgcgtccgcgtcccccctcaagaactgtacccatcacgcgccgccatcgattgaccttgaccgacccgaccacccatcacgcttcttgttgccgccgctgttgcttgccgatacgcggtggctgcgctcgccggcggggaagaggggtcgcgggctgcgcgcctccagtctttcttcgcctccgtgctctcgggcctcttcttcggccaggccgatcaggacgaggaccaagagatggcctcgcgcaaccacaacgccgccgctccgcagcttcaccatcacaaccgagccggtgttcccgctcttggaaaggccaaggccgtgcccgcccgagctgacgctctgaaccggcgaccccctctcggcgatataggcaacctcgtcagcgtccgcccagccacagggaacccgcaggagcaggtcaatcgccccatcactagaagcttcggcgctcaactcgtcaagaaagcgcaggcgaaggccgcaatcaagaatgccgcaatcctgcctgcgaggcatgcgccgaggcaggagaggaaggctcctgtcaagcagcaaccgccgccggaggatatcatagtactcagctccgattctgaacagagcagggcgcagtccgagagcagcgctagctccgtccgctccaggaggaaggccatcaacaccctttcttccgtgctctcggctcgctcaaaggctgcctgtggaatcgctggtaagcctagacaagtggtcgatgacatcgacaagctggacgtcaacaatgagctcgcggtggtggaatacattgaggacatctacacgttctacaagattgctcagcacgagagacggccatgtgactacatcgacgcccaactcgagatcaactctaagatgagggctatcctggctgattggataattgaagtacaccacaagtttgaactgatgcccgaaactctctacctgaccatgtacatcatcgatcagtacctctcgctgcaaccagtcctgcgtaaggagctgcagcttgtcggcgtttcatctatgctgatcgcctgcaagtacgaggagatttgggccccagaggtgaacgacttcatcctcatatcagacagtgcatacagtagagaacagattctttcgatggagaagggaattctgaataggctggagtggaacctgactgtccctacagtgtatatgttccttgtccgttttctgaaggccgcaacattgggcggcaaagttgagaaagagatggagaatatggtgttcttcttcgctgaattggcgctgatgcaatacgatttggtgacacgcctgccatcgctggtcgctgcttctgctgtctacgcagccagactcactctcaagagggctcccctttggaccgacaccctcaagcaccacacgggcttcagggagtcagaggcagagctcattgaatgcacgaagatgctggtgatcgcgcactcgactgcccctgagagcaagctgagggttgtatacaagaagtattccagcgagcagttcggaggggtcgcgctgcgtccacccgcagaggagatctgcaagtgaacgaaggctactttatccgtgtttgcctattgcttgctttaggggaagtggcgatggaaggcgagtctgacattcgctaggcttttttatgtttgcttgtttcagacagccgtttgtttgctaggctgttctcagagtcggttgttatctgacttgtgatggcaactataattctatctagtacaacatttttattcataaatgtgaatggtgttttacaaggtaaaaaaaaaaaaaaaaaaaaaaaaaaaaaaaaaagggcggccgc

SEQ ID NO: 78 - DNA, 1628 bp, Zea mays
  CDS (220)..(1380)
gaattcccgggtcgacccacgcgtccgcgtcactacccacgccactgcatagaccgagaaaaaggacgaattttttcctcgccgcaacctcacaccatggaagaggcgatgccgccgccgccgccgccgctctcatcttcctcctccgccgccgtggcctgagctctcccatcgctcgctctctccatcgggcctacctatcctagcagtgaataagtcatggcagctttcgccgcgttgttcgaccccctctactgcccggaggagcacctcgatctgtaccacgaaggacccgtcgaggttgtggacgagcagtggcaggaccagcgcggacagcagcaaccggcggctcttgacgacgagctgccggcgctgttcgaggcgctccgggacaaggagggggtggtgctggcgggtgatggggaggaggatgggtacggcggctcggcaggccgggaggccgcagtcggctgggcgtcacgcgccgcggcacggctgggcttctctgcgctcacttccgcgctgtccgccgcctacctggaccgctgcttcctccccgggggcgcgctccgtctcggcgaccagccctggatgtcgcgcctcgccgccgtcgcctgtgtcgcgctcgccgccaaggtcgaggaaacgcgcgtgccgctgctcctcgacctccagctctgcgccgccgccagctccgacgctgacgcagcggacgcggacgtgttcgaggccaagacggtgcgccggatggagctgctcgttctctccgcgctagggtggcggatgcaccctgtcacgcccttctcctacctccagcctgtcctcgccgacgctgcgatgcgcctacgcaactgcgaggccgtcctgctcgcggtcatggccgattggaggtggcctcggcaccggccctcggcgtgggccgccgccgcattgctcaccacagccggcggcggcgacgacgactcggagctgctcgcgctcatcaatgcccccgaggacgagaccgcggagtgcgccaagatcatctccgaggtgacaggcatgagcttccttgtctgcgacgtcggcggcatgatcgccgggaataagcgtaagcacgcggcggcgcggatgtactcgccgccgctgagcccgagcggcgtgatcggcgcgctgtcctgcttcagctgcgagagctcgttgtccgccacagcggactcgcgcaccctcgctactacggctgcgggggtcggcccgtgggcaccgtcagcgcccgtgtccgtgtcgtcttcccctgagcccccaggtcgggcccccaagcgcgctgcggcggcgggggtcccgcatccgcttccccccgacgaggagagccgcgacgcctggccgtccacctgcgccgcgtgacgcaccgtgccggaacggtgcctatggcgagatcccccgctcaggtagtcaggtggcggtggggatataaaggagcatcagaatctcgcgccggtgacgagaacgaaccattttgcccattgccgcgagagatggggggctagattgcaagaagaaaaggatgtaatgtctgcatgctcatgtatggcagcacattttgcaatgatggttctcgatcgtaaaaaaaaaaaaaaaagggcggccgc

SEQ ID NO: 79 - DNA, 2067 bp, Zea mays
  CDS (218)..(1180)
gaattcccgggtcgacccacgcgtccgctaccctccctcatcacttgttccactacgaccggccacctagctcgccgcgcgcgcaagcctgcgccaccacccactctactagcttagtctcccctcgtgcagcgcgacgacagccagcaatggccgccgcccagtgaggcagggtcgcagtgacggcacgagacgcacacccacgggcgctggcggcatgccgggcgacgcctacgacctcctgtgcgccgaggacgacgccgccggcagcgccctgctgtgcaccaccgacgacgacgacgggtgctgctccgctgtcgaggaggactcggcggcggcggcggcctccatcgccgagctcatcggcggcgaggcccagtactcgcccaggccggactaccccgacaggctccgctccaggtccatcgacccggccgcccgcgccgagtcggtcgcatggattctcaaggtgcaagaatactatgggtttcttccattgacagcctacctcgccgtcaactacatggaccggttcctctctctccaccgtttgccggaggacgggtgggcgatgcagctgctggccgtgacctgcctctccctcgctgccaagatggaggagaccctcgtgccctccctcctggacctgcaggttgagggcaccagcagatacgactgcttcgagcctgggacggtcggccggatggagctcctcgtcctgatggcgctcaactggcggctccgctcggttactcccttcaccttcgtcgacttcttcgcgtgcaaggtcgacccaggagggaggcacaccaggtgcctcattgcccgggccacgcaagtcattctggctgcgatgcatgacgtcgagttcttggaccactgcccgtcatcaatggcggcagcggccgtgctctgcgccatcggtgagacgccgtcactggagtcggtcagccctggggctgccgtcagctggtgcatcggccttgcagaggaagggatcagcagctgctacagactgatgcagcggctggtgataggcaacgtccggacaagggtcgccagcacgacgaccatggcagcagtgaacctgtgctgctcggatgaggcgctgtcctcgcattcctccgccacctcctcgccacccccggccaagaggaggaagaggtcgccgacggccacgtgaaaactgaagaacgcaagtagataggattatttatacgcttttggggggcagattaacagggtttgatcgatttctttgcagtttgtttgtcgttttttcttctttgtgattctttctcctttttcccccttttgccatttatttgttctgttcttttgggttggatctctactcctcggtggggggattctgcctgcctgctcgaccggcccagtcatcatggcggcctctggcctctgcaccgccagccagtatgtgaaggcgacgagactcgagagagagaaagaaagacagctactacgtataacagacacatctgtgtttctctgtgcaacactctgtggggcttcttcaaccccgacgcagagctgcagagagggaccattgattggtgagcgagggcagccatggcggcagatggagatggagagggaggggggaagaggcaatgagttgcggtggatggatgatgattggtagggttaaatgaggtggtcaaagggccgggcggtcagtgctcctgccaagatgcagccctgcctgcaaagtttctgttcatattcatgagggcaaaaattgtttgtttccgagtggtttgtttgtattttgttgatgccgctgaggcgagggcgtcagagagagagaaagaggggcatgctttgctttgctgtgatgggagtcacatggatatgccctactgtggtggtgctctggagggaaatatttgtccatctccagagctaacagtgtccaagcatggggcttttgggggcccttgctgattgtttgtatctcttttttcttgcttgtgtatcaatgaagattttgccatttgaattggcctgagaagagagtaaaaaaaaaaaaaaaaaaagggcggccgc

SEQ ID NO: 80 - DNA, 1823 bp, Zea mays
  CDS (288)..(1334)
ggtaccggtccggaattcccgggtcgacccacgcgtccgcatgaccccatttcatttctctacctctccagctgcccacttctctgtgagcgcgcgcgagtgtggagagaagggagggaattcccccctttctgttcggcgcacgcacccgcacgccccacgctgcacagtgcacgccgccttttcctccgccttgctgctgcgagtccgcaaccactggaggaaaaatcttttccttcacttttcttccctttccccccgcgcatgcacgggctctgattgacgccatgggggacgccgcggcctccacgtccgctcccaccacgcccacctccatcctcatctgcctggaagacggcagcgaccttctcgccgatgccgacgatggcgccggcactgacctcgttgtcgcccgcgacgaacgtctgcttgtcgtggaccaggacgaggagtatgtagcgctgctcctgtccaaggagagcgcgtcaggcggcggcggcccggtggaggaaatggaggactggatgaaggccgcgcgctccggatgcgtccgctggatcatcaagaccacggcgatgttccggttcggcgggaagaccgcttacgtcgcggtgaattacctcgatcgcttcctggcgcaacggcgagtcaatagggagcatgcgtggggtctgcagctgctcatggtggcgtgcatgtcgctggcgaccaagctggaggagcaccacgctccgcggctgtcggagttcccgctggacgcgtgcgagttcgcgttcgaccgcgcgtccgtgctgcggatggagctcctcgtcctgggcaccctcgagtggcggatggtcgccgtcacccccttcccctacatcagctgcttcgcggcgcggttccggcaggacgagcgccgggctgtcctcgtgcgcgccgtggagtgcgtcttcgcggcgatcagagcgatgagctcggtggagtaccagccgtcgaccatcgccgtagcatccatcctcgtcgctcgcggcagggagacgcccgccggcaatctggacgcgctcaaggcgatcctgggctcatcatttccgcagctagacaccgggcatgtgtactcctgctacagcgcaatgattcgggaggacgacaagtcgccgacgcagtcgacgtcgacgtcgacgggggtggcgtcctcgggcgtctctgtcgccgcgcacgccggggggagcgggagtcccagccccccgggcgcttccgtgtccgtgggcgccaataatgccgctggcaccgccccgccggcaaccacggacaaccgcaacaagaggagacggttgcgctcacctcagcgacagtaggagcagctcagctgctggcagtgcattgcagtgcagtgcagtccagctgcgttttcttttttcagctcaccatttccttttgctgccgattgtttcttcaggggtggccgtagagtgatttggtaatttagtgccggaaagattagtgcggtgtcgcagagtgatttggtaatttagtgccggaaagatttctttgttttgaggagatctttcgcgggaccaaagggaggggggcagtgtaaagacgacagaacaagcgtgaaggcctcgagagtcgagacctcacagggtaccgcctagcgcctactggggtgaaagtgaagtcaaggagtcgggagggtgtgtgtgaataccgtttgtagcagctagtgcgtccgtctgtcttttttttttctttctgtttattaattattaatagcctgctcaaaaaaaaaaaaaaaaaaaaaaaaaaaaaaaaaagggcggccgctctagaggatccaagct

SEQ ID NO: 81 - DNA, 1679 bp, Zea mays
  CDS (88)..(1425)
cttctccttgtcccgtgtcttttcaaggatagcccgggcgcacgcagcatttcttggcgtcggtgtccgcgggttggcgactaagcaatggcgacgaggaaccaccgcgccgctgccgctccgcagccggcgaacagaggtgccgcgagggtcgccgggaaacagaaagccgccgccgccgggacacgccgagccctcggtgacattggcaacgtcgtctccgatgccctcgacagggcgatcaagctgccggaggggatccatcgccccatcaccaggagcttcggcgcccagctcatgaaggccgctttggcgaacaagaacgccgacgccgccgtagctcctgctcagcctgtagcggcgcgcgccgttacgaaaccagctaggaaagtgactacgaagaacgtccctcgtcctggcgctgggcaggctcccaaggagaacaagaagccatcagcagagggtgccgccgccgcgagcggccgctctgtgcagaagaacaggaggaagaagcccgcgtgcacgctttcgaccgtcctttctgcgcgttctaaggctgcctgtccggttaccgagaagccaaaggagcccatcgaggacattgacaagttcgacggcgacaaccagcttgctttggtggactacgttgaagacatctacacattctacagaccgcccatgcatgagagccgccccattgactacatggggcaaaccagccctgagctcagccccagaatgcgctccatcctcgcggactggctcatcgagtctcaccgaagattccagctcatgccggaaacgctctacctcacaatatacatcgtggaccggtacctgtcgctgcagcccacgccgaggagggagctccagctcgtcggcgtggcagcgttgctgatcgcctgcaaatacgaggagatctgggcaccggaggtaaatgacttaatccatatagccgatggcgcgtttaaccggagccagattcttgccgccgagaaggctattctgaacagcatggagtggaaccttacggtccccaccccgtaccacttcctgctgcggttcgcgaaggctgccggtagtgctgatgaacagcttcagcatacgataaacttctttggagagctcgcgctgatggactacggtatggtgatgaccaatccttcgacggcggctgcttgcgctgtgtacgctgctcgcctcacgttggggaggagtcctctctggacagagaccttgaagcaccacactggtcctcaacgagcagcagatactggaagggccaagacactggtcggatctcatgctgctagtgctagccctgatgcgaggctgaaggccgtctaccagaagtacgccacggagcagtttgggcgtgtggctctgcacccaccggcaccggctgctcttcccgaccttgtctagagtttttacttgacaaggctgagggatttagttgagttcgctttgattgacaagttcgagagttgtttcgtatactctattctcgcggtgtattagacactagtagtaacaactattcataactatatgaataaccacaatcaaaatttatgattggctgaagcttctttcgaaagactgtgaggtatttccacagttttgtaagactgtcagaatgaaacggtcttgattaaaaagagctgtctgccaactgc

SEQ ID NO: 82 - DNA, 1864 bp, Zea mays
  CDS (250)..(1422)
ggtaccggtccggaattcccgggtcgacccacgcgtccgcccacgcgtccgcgtcactcgccacgccacgccaaagaccaagaaaaaaaaggacgattttttcctagctgcaacttccctcacgccatggaggaggagatgccgctgcagctgctctccgcttcctccgccgccgtcgctgtctgagctcccccttcgctcgatctctccatcgggccgggcctacctctcctagcagtgaatcaaaccatggcagctttcgccgcgctgttcgaccccctgtactgcccggaggagcacctcgatctgtaccgcgacgaacccggcgagggtgcggacgagcagtggccgggccagcacggacagcaggagccggctgtcctcgacgacgagctgccggcgctgttcgaggcacaccgggccaaggagggggtggtgctggcggaggatggcgggtacggcggcgcagctgggcgtgaggccgcggtcggctgggtttcacgcgccgcggcgcggctaggcttatccgcgctcaccgccgcgctcgccgccgcctacctcgaccgctgcttcctccccgggggcgcgctccggctcggcgaccagccctggatggcgcgcctagccgccgtcacctgcttcgcgctcgccgccaaggtcgaggagacgcgcgtgccgccgctcctcgacctccagctctacgccgccgctgacgccgcggatccgtacgtattcgaggccaagacggtgcgccggatggagctgctcgtgctctccgcgcttgggtggcggatgcaccctgtcacgcccttctcctacctccagcccgtcctcgccgacgctgcgacgcgcctgcgtagctgcgagggcgtcctgctcgcggtcatggccgactggaggtggcctcggcaccggccttcggcgtgggccgccgccgcgttgctgatcacagccgccgccggcgacggcggcgacggcgacggcgacacggagctcctggcgctcatcaatgcccccgaggacaagaccgccgagtgtgccaagatcatctccgaggtgacgggcatgagcttcctcgcctgcgatgtcggcgtgagcgccggaaataagcgtaagcacgcggcggcgcagttgtactcgccgccgccgagcccgagcggcgtgatcggcgcgctgtcctgcttcagctgcgagagctcgacgtccgccaccgctatggctgcggcggtcggcccgtgggcgccgtcggcgtccgtgtccgtgtcgtcctctccagagccaccaggtcgggcccccaagcgcgcagcggcggcgtcggcgtcggcgtcggcgtcagccggggtcgcgccaccggtccaggtcccgcatcagctaccccccgacgaggagagccgcgacgcctggccgtccacctgcgccgcgtgacgcaccgtgccggaaacggtgcctatggcgagaccgccgttcggtggcggtggagaatggagaacaaggagcatcattggctcgcgtcggtgagcaggagaacgaactattttgcccattgccgtgacagatggggggcaagagagataagaaaagatgtccttgtttgcatgcttatggcgggagtaatgtttgcatgcttgtggcagcacattttgcaatgatggttctcagagaacttagctggaggtggaagatgattagcggataatttgccgtcgagatcgatggcgatttagtatttgttgcaactgtagtgatgctagttcttgccgtgttcttgttggttcttggcattgcttgcttggaaggggcctccgacctccgttgtcctgaaaaaaaaaaaaaaaaagggcggccgctctagaggatccaagct

SEQ ID NO: 83 - DNA, 1647 bp, Zea mays
  CDS (229)..(1275)
gaattcccgggtcgacccacgcgtccgaatagaggtgtgatcggctcaagcaccagctagccacctcgctgcctcgctggtgctcttccacctcctgcaccacagcgccattgcgcttccacggccagctaccgctgccggaatatacactggtggatctttaacaggttcctccggtccgatccaccgccagcttccgacgtcgtactcgggcggatcggttccacaatgggggaacggggagcagaggaggacggctcgggcggctcctccctctccctcatgtgcctggaggacggcgccgacctcgacgccggtggctccgcggagagcgccgacgacggcgagccggccgtcgttgctcacagcgacgccggtgaggaccaggaggaggagtacatggactacctcgtgtccaaggagagcagcttctgctgctccccttcctcctcgcccgtctcctccgacgccggcgccgagacgcgcccttcgtccacggcgtcgtcatccgacgagtggttccgctgcgcgcgccacgccaccgtcgcgtgggtccttgagacgcgggcttacttcggcttctcccaccgcgcggcgtacctggccgtctcctacatggaccgcttctgcctccgccggtgcatggacgtgtcagtgatgccctgggcggcgcggctgctggcggtggcgtgcctgtccctggcggcgaagatggaggagtaccgcgcgccggcgctgtccgagttccgcgcccacgacgactacgacttcagcagcgtctgcatccggcgcgtggagctgctggtgctgtcaacgctggggtggcgcatgggcggtgtcacgccgctggattacctcccctgcctctccttcaggctacgccgaggcggtggcggcgggctcatcgccgccaaggccgccgcacttatcttctccgccgcggaagctgccagcgtgctcgactacaggccgtccaccgtggccgtcgccgccgtcctggcggcggcccacggcgccatgacaaaggaagcgctggagtgcaatatgagcagcctcactccgtcctgcctgctcgacaaggacgacgtgcacgcctgctacagcacgatgctgagcgagagctcctcgcctacgccgagcaagctggcggacaagagaccgccgccatccagctccggctcgacgatgtacgagtcggtcgacgcggcctcctcgttcgcggccacggcgggccggagcaagagggcgcggctggagatgccggccattggcccatgagaagcaccgccgggacacgatcgtttatttttttgccacttgtcctgtgctgtgcggctgtggcggcctgccggggctaatcttcttcgccaactgtagttttttttttcttcttccagctttgacttttcagttgtttgattgatcacgcggcgcgcgcgcgcagcacgctctgctggagaaacggtgacgcgcacgggcagtgccccggttgtggagatggagggtttggttgcctgtgctttgtttgcatactatagtttgatcctaatgatctaatccacgtacgatgaggtgaatgagaatgtaagttacacctcaatccacctaaaaaaaaaaaaaaaaaaaaaaaaaaaaaagggcggccgc

SEQ ID NO: 84 - DNA, 2003 bp, Zea mays
  CDS (107)..(1633)
gaattcggctcgagctcgccgctgccgcatcctcaccctcgtccgctcctccgctgccccaaaccctagcctgaggaggggtcctcctccgctaccgagacccacgatgtcgaccatcgctgcctcccgccgctcgtcctcctcgtcctcttccgcgaccgccaagcgccccgcgattgcggacggccccgggggacccaaggcgaccgccgcacaggccaagaagcgcgtggcgctcggcaacatcaccaacgttgccgcgcggggagggagggcttccgttggcggcagccttgggaacgtcatggcgcccaccagcagcgcgaagttgaatccaacggtacccttgaagaagccgtctttggcaacaagtgctcggagtgtgagttcttccatccggggttctgctgacaaaccggcttccatcaagccagctccaccagtagcacgccatggcagcgcaacacaaaggcataacaatgttcctcctcctaaagtgcctaccattgccgatgtgccaagtcgtgctcctgccttggtgtcctgcaccggcttggtgtctcctggacgctcaggagattctgtttcatccgatgagacgatgtcgacttgcgactccatgaaaagcccagactttgagtacgtagacaatcaggacacctcgatgctggcttcgttgcagcgacggacaagtgaacatctgcgaatatcagaggatagagatgttgaagaaaataagcggaagaaaaatgccgtggccccaatggaaattgaccgcatctgtgatgttgacagtgaatatgaggatccacagctgtgcgctactctggcttctgacatttacatgcacttgcgagaggctgagacgaagaaaagaccgtcaactgatttcatggaaacgattcaaaaagatgtcaacccaagcatgagagcaattttgatagactggctcgtggaagttgctgaagaatatcgtcttgttcctgatactttgtacctgacagtcaactacattgaccgttatctttctggcaacgaaatcagccgccaacggctgcaattacttggtgttgcatgcatgcttatagctgcaaaatacgaggagatatgtgcaccacaagtagaagaattctgctacataacagacaatacatatttcagagatgaggttctagatatggaagcttctgtactgaattacttgaagtttgaaatgacagcacctacagcaaagtgctttttgaggagatttgctcgtgctgcacaagcgtgtgatgaggatcctgctttgcatctggagttccttgccaattacatcgctgagctatcactactggagtacagtctactctcttaccctccatcactaatagctgcatcggctattttcttggcgagatttatactacagccaacaaagtatccttggaattccacactcgctcattacacacagtacaaaccgtccaaactgagcgaatgtgtaaaggcattgcatcgcctttgcagcgttggttctggtagcaaccttccagcaatcagagaaaagtacagtcaacataagtacaaatttgttgcaaagaagcagtgtccaccgcagatccctactgaattctttcgggacacgacatgctagactagaaacccagaagtgattccagttgcttactggattcttcttgatgtgtcttgaatgcccagtgtagcacagcacaactatgcaagtgctgataacccccaggttgtttcaggtgattacaggggtgtaatcaatgtttgtggtcatgttaggtcattggtgtggtttttcttttcctgcttccagtctttctgtatgtagatcagtgttttcaggcgcttgtaaatccgagttctgtagtagagcacaatatcttgtaagttaactgaagaaatttggtgatcaaccaagttacctacaacttatgttgagctggtgatcaggtttttgcgctagttgaaaaaaaaaaaaaaagggcggccgc

SEQ ID NO: 85 - DNA, 1920 bp, Zea mays
  CDS (206)..(1252)
gaattcccgggtcgacccacgcgtccgacgtcggcctcttccacggccgccgccgtcgtcgccgccgccgccacctcgccgccgaccaccataccatcagatatttcagagctcgcgcccctcacgcatggttcttggcttcttgcttcttgctcgacgtgcgccgtaactaatcgactataagcgtggtgacacgtctgacgagatgatgccggtggcggcggtggatgactggtcggagcgcggtttctcgctgacctgcgaggaagactgcgccgacctcggcaacggcgtcgtagacgacgacgagttcctcccgctctacaatgccggcgaagaggaggaagaggagtatttggagcagctggtgtttaaggagaccagcctctgctcctcctccgactcagccgcggactgcgacggcgacggcgaaggagacgaagaatacccctcgctcgcctctgaggagtggtttcggcaagctcgcctcgccgccgtcaagtggattcttgaaacccgcgggtgcttcggcttcggccaccggacggcgtacctcgccatcgcctacttcgatagcttcctcctccggcgacgcgtcgatagggaggcgatgccgtgggcggcgcagctgctgtccgtggcgtgcgtgtccgtggccgccaagatggaggagtgccaggtgccggcgctgtcggagttccacgccggcggctacgatttcgactcggcgtccatccggcggatggagctgctggtgctgtccacgctcggatggcgcatgggcgccgtcacgcccttggacttcctcccctgcttctcctcccgggtccacccgcacggcggcgccggcgccggcggccacgtcgcccacaaggccatcggtttcatctttgccacggctgaagctggtagcgtgcttgatcacaggccgtccactgtggctgcagctgcaatcttggctgcaacctatggacctctactgaccaaagaagcactcgattccaagatgagctacctttctccatcttgtcttattgagaaggaacatgtacatgcctgctacagtatgatggttggggacaataacaggagaggtagcaagagatcattgccatgttcagtctccaacgagattgccactagtacatatcattctgttcttgttgatgatgttacggacaccgccgccgcctttgccacggcggtatcggccaggaataagcggatcaggctggagctgacgggcatcagttgagaaagctagcaccaccggggacacagtttttagccagatgtctaggggggcttggtttgatcttccctttcattttcttcccttctttttgaacttatatgtttgcgaaaaagaagatatttttttaggttctttgagccattgccatgggttggcattggctgttgtcagatttgattggtttggtttgtgagaggtggaagagatgaacaaagcagagggctgagctttcctatggagaggagagcttaggttaataagcccaatgccagcgcccaaacagggcacacttcacattcagtgaactttacttcaaaggttgatgcaatgttgcattgcatgtggtgagagatgctgctgcagagaagatgcaaaacaagtggtaacaacactgagaggttgagggttttgccattgtttatagaacgagtgagcgagagagggagatgtttccctttttcacctgtgcaagtggatgtgagagtggtgtttcactctgcacttgcgagggttacatcgatttgtaacaaaccctgtgtacttgtgtaaccccctcttgttcctgaggaatggaatcagattgcgttttgcgtcaaaaaaaaaaaaaaaaaaaaaaaaaaaaaaaaaaaaaaaaaaaaaaaaaaaaaaaaaaaaagggcggccgc

SEQ ID NO: 86 - DNA, 1750 bp, Zea mays
  CDS (114)..(1385)
gaattcccgggtcgacccacgcgtccgtagctcctggctcgcggctcagcttgccactaccagcaagcgctcgtcacccgtcggttctccccgagtagctcgtcgcgtcggcaatggagaatctgagatctcaaaactgccaccaaggtgttgccatggagggagtcaagtttgcgccggagaaggccaacaccaaccggagagccctcagcgacatcaagaacataataggaggcccacaccagcacttggcggtcagcaagagggctctgtcagaaaaaccagctgctgctgctgctgcaaatgctaaagatcaagctggctttgttggacaccgtccagtcaccaggaaattcgctgcaacattggcaacccaacctacagttgcccttctggacccaattggaagtgaaagactgaaaagaaacgctgatacggcatttcacacacctgcagatatggaaagcacaaaaatgacagatgacagtcccttgcctatggtgtcggagatggatgaaatgatgagtcctgaactgaaagagatcgagatggaagatattgaggaggcagcacctgatattgacagtggtgatgcaggaaattctctggctgtggctgactatgtagatgaaatttacagattttacaggaaaactgagggtgcaagctgcgtccctacaaattatatgtcaagccaaactgatataaatgagaagatgcgtggcattctaattgactggctcatagaggtacactacaaactagagctgttggaggagacccttttcctaaccgtgaacatcatagacagattcttggcacgtgaaaatgtggtgcggaagaagcttcagttagctggtgtaactgctatgttgctcgcgtgcaagtatgaagaagtgagcgtacctgtggtcgaggatctgatcttgatcggtgatcgtgcatacacaagggctgacattcttgagatggagaggaggatagtgaacacacttaatttcaatatgtcggtgccgactccatactgtttcatgagaaggtttctaaaggcagcacaatcagagaagaagctcgaactcctgtctttcttcatgatcgagttgagtcttgtcgaatatgagatgctccagttctgcccgtctatgctagcagccgctgccatctacaccgctcaatgcaccataaatgggttcaagtcctggaacaaatgctgtgaactgcacacaagatattcagaagaacatctaatggtttgctctaggatgatggttgaactgcaccaaagagcagctcatgggaaacttacaggggtccatagaaagtacaacacttctagatatagctatgctgcgaaatcggaacccgcaactttcttgctggatgcctgaacctaagcttgaactatacacactcttaactacttccatggaaagagtggaagggaggctgcttcgactaaactacagaagtgggatctatctgaatatatgcaacggctgttgcagcaaatatttggtggggctgggttggtgtgttgtttgttagttcaataacttaacattaatgaaacagtgtttgtgttgtttaggttttttttccaattatatcgattggaatttcatttgttgtatcctggccatcattctttactcatgtcatgtgacacctctgcgttttgaaaaataaacattgattatgtggatctgctgaaaaaaaaaaaaaaaaaaaaaaaaaaaaaaagggcggccgc

SEQ ID NO: 87 - DNA, 1073 bp, Zea mays
  CDS (134)..(904)
ccacgcgtccgcggacgcgtgggttctgctttaccactcaatctggttgagagtcgccggcgccggcgattcctcctccaccgattcgcccggcgggagtctccgcagggctcaccgggaccgcgggtccacgatggccgccaacttctggacgtcgtcgcactgcaagcagctgctggaccccgaggacgtggacctggtgccggcggcggaccgggagcgaggcatcacgccggaagagttccgcctcatcaagatccatatgtcgttccatatctggaggctagcacagcaggttaaagttaggcaaagagttgtagctacagcaatagcttacttcaggcgtgtgtatacaaggaagagcatgtcagactatgatcctcgtttggttgcacctacttgtttgtatttggcatctaaggtggaggagagtacagtgcaagcccgacttcttgtattttatataaaaaagatgtgtggttccgatgataagtatcggtttgaaattaaggatattcttgaaatggaaatgaagctcctggaagctctcgactattatttggttgttttccatccatatcgtcctctcttacagttgttgcaggatgctggcataacagacctgacacaatttgcctggggccttgttaatgatacatacaagatggaccttatcctcatataccctccctacatgattgcactggcctgcatatacatagcgagtgttttgaaagataaggacaccacagcatggtttgaagagctccgtgttgacatgaacatagttaagaatatctctatggaaatattagacttctatgacacctacaagattgatcctcaaaggggcatccctgaggataagataagccccgtgatgaacaagttgccggcaaaggcttaactcagatttggcgagcttaggagttgtaaactagtagtaaactacatcatacttccaccatgtgtgtactcagcctgcactgtcgcttgtgacgtgttgatgaactacttgatagattcaatgcaagaaccccatggaattgtttgtgtaaaaaaaaaaaaaaaag

SEQ ID NO: 88 - DNA, 1236 bp, Zea mays
  CDS (94)..(909)
ccacgcgtccggctaggcagctaacagacgaagaagaagcaagccaagcagaattgagagagaggcgaggacgtggcgacgacggcagccgcgatggcgacgacgacggacctggggttcgaggcgacggagctccgcctgggcctgcccggcgggggaggtggaggggagccggcgctgggcggcgaggggaggagctcttcctccgcctccggcaagaggggcttcgccgagaccatcgacctgaagctgaagctggagccagcggccgtcgtggaggcggaggaggaggaggaggaccacggcgttgctgttgcccttgagaaggaggaggaggccgggaagatgaagcggtccccgagccagagcagcgtcgccgccgccgccgccgccgtgctggctgaccccgccgagaagccgcgcgccgccaaggctcaggtggtgggatggccaccggtccggtcgttccggaagaacatcatgtccgtgcagtccgacaagggcgccgccgccgccaacggcgacaagtcctcgccggcggcaggcggcggtgccgcgttcgtgaaggtgagcttggacggcgcgccctacctgcgcaaagtggacctcaagatgtacaggagctaccagcagctgtccaaggcgctcgagaacatgttcagctccttcaccatcggaagctgtgggtctcaagggatgaacggcatgaacgagagcaagctggtggatctgctcaacggctccgagtacgtgccgacctacgaggacaaggacggggactggatgctcgtcggcgatgtgccgtgggagatgttcgtcgaatcatgcaagcgccttcggatcatgaaaggatcagaagccattggcctggcgccaagggccatggagaaatgcaagaacagaagctgaggagaagacggacggacggaagcttgcatctcagcaccaccaggggtggatggatgcaagaagaacaaatctccatggcttttgcagctctgctcgtctctgtatcatactcgtcgtccctgcccttcaggcctctgtatctccctgatcaatgaagtcgttttggtgtgtcaactgttctctccgtgcccagcttgtcagtgaaagagtcagtcagtgtccatcaagtctcatcttgtcctatacagaagagagaagccatgcatgaacatgtacctgtcctataacaatgtctttttttgctaccaaaaaaaaaaaaaaaaaaag

SEQ ID NO: 89 - DNA, 1610 bp, Zea mays
  CDS (196)..(1230)
caaaaattcaaaccgcatcaagcttcccaagaccccaaacgaacgccggcgcttcacacatcgcccgacccgaaccaaacccttcaaaccccagcgaaaagcgaaggcaatcggaggaacgaatccgcgcgaccaacacgttggcagcagcattaggatccggatccgaagaccgccagaccggagccggaggcgatgaagagaaaggaaaactccgagcactcggcgccgcctctcaacaggccgcgcgggaagcgcaaggccctggccgagctgcccaagtccaacggactgaacatgaaccacgactcggcgccgcggccgtcgaagccgagaacgcggtcggcggcgcgagctgaggccgaggcggaggcggcgatgaaacggcggaaggccggagacgccgcgcgctggccgatggacacgaggcagcctgacgctgaagcggcggttgcgccatacgtcggggacatcgaccggtacctccggtccctggaggttgaaccgttgaggaggccaagccatagctattttcaggatatccagaaaaacatctgccccaaaatgagggctatccttgtggactggttggtggaggtggctgaagaattcaagcttcacgcagaaacactccaccttgcggtttcctacgtggaccgctttctcacaatgaatgtcgttgctcggaacaagctgcaactactgggtgtcactgcattgctcgttgctgctaagtatgaagaaattgagtcttctaagatgaaggtggtcaagatggagactgacttactaaaatctcttagctttcagattgggggtcccacagtgacaacatttctacggcaatttatagcttcgtgtcgtggaggcaatagtgcaagcagaggaaaacttgagtttgtgtgcagctaccttgcggaattgagcttgctggattatgactgcataagctatctaccctcagtagttgctgctgcctgcttgtttgtagccagattcataatccacccaaagactcgtccttggaacttgtcacttgaacaaagcacgggttatagagtctttgatctgcagaaatccatttatgtcatacatgaattgcagttgacaataaggtgcccaaatcaggtagccatcagggagaagtacaaggaccccaagtttgggtgcgtgtcgacaatggtttcaccacgagaaatccctacgtctttccttgaaggttgccataagtgaagtccggacttggacttggagaagggtttttgcagtaatgctgctggcgagtggcgatgcagaaaatagcttgatggtaggataatttaagggtaggtcggaaaatataccatggccagcgttgtagatcgttggtacggtactggtctcacagttggtagaatatgcaattgaaggctttttgtacaggagttaggctagtccgtgacacacacgtgtgcatcctctatggtctgtctttgcgcacattatgccgagcgccgaccatctcgtgctgttggcctgtctcaattaccaccagacatttgacacgtggaatctttttaagattcaatttttaaaaattgtattaaaaaaaaaaaaaaaagggcggccgc

SEQ ID NO: 90 - DNA, 1837 bp, Zea mays
  CDS (188)..(1306)
tgctcttttgagcctcactcctcagtcttcacgccgccggggcagtgctaagatccaggacacgcgctgtcccgctagcaccacgcctccccttgtcatcgtcctcctcccacgtgctgctgtgggggtgcagacgggagacacatccggacctgattgatttcttcgttttgttctgctggtttacatggctgcaagaaagaaaaagcctttgcttattgcttgccaagcaaccagtgccagaataacaagatctcaggctgctgcaaatagtacaagatctgggctggctccttctgtaccagtacctctgaaaacggagcataaccatccagcgaaaaaaaagatgaaaagggaagcttcagatgaaaatgcttctgctgatgctggagcttcagctcctctgcctaaaaggcgtacagttctcaagaatgtaactaacataagctgtgctaaaatttccaaaaggtgcactgctgtgactgggctgaagttgggtccctcccagaaggctgggcagagcataaacaagcaatgcacaaacaagatctccatgcttctccctctggctgttggagggagttcacttgtggatgattctaataatgctgaagaaacacaaatggtagaccttttggcacagaaagagaagcagattgttttgcttaaggaggctcagccattacagaatactgaacaaaacaaaggcggtgcttgtgatgaggcatctgttgaggaaagaaatgccatgaatgtacacgaaactgctgccttaaaggctggggtctctaatggtttaaacattgtagatattgacaaaaataatggtgatcctcaaatgtgtgttacctacgttgcagagatatacagaaatctaatggcctcagaggtttcggacgaatataagcttgtggcagatacactttaccttacagtatatcttattgaccaatttctttctcagaactgtatccaaacgcacaagctgcaacttcttgggataactagtatgctgattgcctcgaaatatgaagagtattctgctcctagtgctgaagaattttgtaacataacggctggtacatatgcaaaggctgaggttctggaaatggagcaacaagtgcttaatgatctgggctttcatttatctgttccaacaacaaacacatttctcaggagattccttagagcagcacaggcttctcgtacagtaagatcagtacccaaaccacattgcaacgagtcctttcagtctatatgtattgtcctcaacactaagttggcaagctacatttccaggctcatctgaccactttgaattatctggcgagttatcttgccgagttgactttaatcagttacgatttcatgaaatttcttccctcagaggtggcagcatcttcgattttccttgcaaaatggacacttgaccaatctgaccatccttggaaccctactcttgagcactacacgtcttacaaaagcttcgatattagaacttgcgtgcgggctctacaggaactgcagcacaacaccagtaattgccccctcaacgccatccgtgagaagtatgggcagcagaagttcgagtgcgttgccaacctcaggtcaccggagctgctgcggtcgctcttcagttgatgtgctcccctgcactctgctgattcactcgccatttgctgcaacgatcctgacactgtataaaatatttcttcagtttctgttccatttccaaactttcttcagtttgaacatgcattctgtgacttgggtcaccgacaaaagaggcgcgacacactaatatatcaatttgtaactcaaaaaaaaaaaaaaaagg

SEQ ID NO: 91 - DNA, 1829 bp, Glycine max
  CDS (222)..(1277)
gaaacagagactgagagaaacaaaactgattgcgtggctctatagtggttttgttcttatttccacaaattgtcatttcttccttttaacaagttcgtaaaagaaactcactcacctacacatacagacagaccccatcaataatctgaacataaagtttcgttttttgtgaagattttggaggaagagggtggtggttgagtttaattcaaggtcttgcaatggcacccagttttgactttgcttctagcctcctttgcacagaggacagcaccgttttcgacgagagtcataataatgggggtacgatgatgacggcgatgggggtgtacgaggacacgaggagtcctaggaggcgccactttgacgaagaaccagatgagttgccattgctaagtgatgagagcttggtgatgatggtggaaaaagagtgccaacactggtctggtctgcgttacttgaataagtttcaaactggggatttggacttcggtgccagaatggaggccattgattggattcacaaggtccgatcgcattttggatttggtcctctctgtggatatctatctataaattacttggaccgattcctctttgcatatgaattaccgaagggaagagtttggacaatgcaattgttggctgtggcgtgtttatctctagcagccaaattagatgagacagaagttccactctctcttgatttgcaggtgggtgaatcgaagtttttatttgaggctaaaaccatacagagaatggagcttcttgtactaagcacattgaagtggagaatgcaagcaattactcctttcaccttccttgattactttctttgtaagatcaacgatgatcaaagtccattaaggtcttcaattatgcgatccatccaacttatatcgagcactgcaagagggattgacttcttggaatttaaaccatcagagattgcagcagcagtggctatgtatgtcatgggggaaacccaaacagttgacactgggaaagcaatttctgttctgattcaacacgtagaaaaggagagactattgaagtgtgttcaaatgatccaagagttatcatgcaacagtggctctgccaaggattcaagtgcttctgtcacttgcttaccccagagcccaattggtgtgttggatgctttgtgcttcaactacaaaagtgatgacacaaatgctagttcatgtgttaattcttcacacaatagtcctgttgccaaaaggaggaagttaaacaaaacctgtggagctgagcaattgtagtgatgttggagtgggaattttacaatcatccataggatgcttttccaaaaaaatgggcatcatgtgtgttttatggaaggtgctcccctcaaagcaataccaaaatgaggcaggaagacatagctagaaatcttttatttttttaatttctcaaaaagaaaaaagaaaaaaagaccttagtgtaaaaaatacaaaaaactatattaaggtgaggtggatcatgagtggaagatgggtgatcaagcgaacagtgcaatacattgcattctattggcatgaagtgagtaatcaccagctgttaaatattttagatctattaacagcagctagagaacaaaggatctgaagaagagggataaggattattagagtattgtatgtgtaggtaaagttgggggggagtttttcatttgttcaattttttacttttaaaatgggagagagaaaaatagactgaagaaaaaaaagagatagctatatatatgcgggaaatattttatttatgttattatttttattctgttagttatttttacttaatcagatttt

SEQ ID NO: 92 - DNA, 1807 bp, Oryza sativa
  CDS (13)..(324), (623)..(709), (813)..(911), (1003)..(1204), (1314)..(1438), (1529)..(1774)
gggttgattgatatgggtgttctttgcttcggcgcttccaacatcctcctctgcgcggaggacagcagcagcgtgcttggcctgggcggctttggcggcggcggcggcgaggtggcggcggagctggggtgcggcggcggtggcggctttgatttctttggcttcggtggtggtgctgtgttccccatcgactccgatgagttcgtggcgttgttggtggagaaggagatggatcatcagcctcagcgggggtatctggagaagctggagctcggtggattggagtgttcttggaggaaagatgccattgattggatttgcaaggtgaatatgaatcaaaagtgtaggaaaaataaataaagctctaggatttttttttgctttatttgttactattgatggattaattgggtcttctaggtaggttgttgcatgcttgcgttacatctttgactctagcgtcgatcttgctttggctctgtgcatttgcctttgctgctaaacttgacaaagcaccagattgcagataacaatggggctttgccttttatatggacaaatttgtttttaagtagaaactgacgaaggtgctaatcttgtcttctctcatgtgcgcttgcaggtccattcctactacaactttggaccactcagcctttacctcgcagtgaactacctggataggttcctctcctcgtttaatctccctgtaagaatctgggacgtgtatgtacattgccactacttaattactgtatagtgaatcccggtagtgatcattgcgatgcttttgtttgttcttgttgttgtagcatgacgaatcttggatgcaacagttgctgtcagttagttgtctatctcttgctacgaagatggaggagaccgtggtccctcttcccatggaccttcaggtgaatgaatgaagagttacagttgaaatcgataattgttcagtgatcgcgcgatgatcttgtgctaaaatgggcttttgttgcatgataggtttttgatgcggaatatgtgtttgaagcaaggcatattaagaggatggagcttattgtgatgaaaaccctgaaatggaggctgcaagctgtgaccccattctctttcatcggctacttcctggacaagttcaatgaagggaagccgccgagctacacgctggcatcatggtgctctgatctcacagtgggcactctgaaaggtttgatcatattgcccgatgatttaatcgagaagatctacctgcattgccaatggcaacatctgatgaagttgtacttactagaaatttatgtgcaatgtttttacagactctaggttcttgtcattcagaccttctgagattgcggccgcagtggtgttagctgtgcttgctgagaatcagtttcttgtcttcaacagtgcccttggagaatctgaaatccctgtaaataaggtgagccttttcttgcattttaggaatggcatactgatctgccattgtattttcaatgtttctgaatgtgtcatgtttgtgcatccgcaggagatggttatgagatgctatgagctgatggtagagaaggcattggtgaagaagataaggaacagcaatgcaagctcttcagttccacacagcccgatcaccgtgttggacgcggcgtgcttcagttttaggagtgatgacacaacactaggatcatcacagtcaaacagcaacaacaaagattacaacagccaggactctgctcctgcttccaagaggaggagattaaacacaacaccaatctgataactgtacatacataacttggcattgctttgc

SEQ ID NO: 93 - DNA, 5000 bp, Oryza sativa
  CDS (312)..(500), (1123)..(1154), (1384)..(1553), (2048)..(2163), (2724)..(2825), (2946)..(3002), (3331)..(3474),(3930)..(4000), (4118)..(4223)
cattttggtgttaaggaaaagttctcaactggagctaccaaaggcagacttataccgagttcatccatggatgggcccatacacacagaaggcccaaaaagcaatacgtctgtacgctggctcggcccattagactaaccaccagacagaccaagtaaaccacagccttcgctacgaaggcaggcaaatccggtccaaaacccaaacccaacccaacgaccaaaccaccgaccggccgttccactgcgccattccttccttccccccacctcctcgtcgacgcggagatcgctcgctcgccggcgacggcgatggcggcatcggcggcggctgcggcggcggtgagccaggcgctgagggaccgcgacgtcctcgacgccgtcggcacctccgccgccgcgctttcgctcgcgggctcttccttcatcgtgctctgctacctcctcttccgcgagctccgcaagttctccttcaagctcgtctacttcctcgcggtctcggtgagcggctcagatctggaactacttggttttggggggttctgggttcgggaggctagcctcgtgatctgcgtaactgcgttgggttgcgatttggaattggggagcgcaaagtggggatctgagggcagtgcggtgttcatttcgcctccgattgagaaatattgggggttcacgccgtcagtttaaccaacggatgctctgtttttgctgcttatgcgtgcgagctgaagcagttctcgacaattttttttttgtaagatgtttgctatctgatcggcacttgaagtagcatagggcatgctccattttttttttagtgaaccgtgtgaggatgtttatgtcatagacccttacttcaatgtggcaagtgatgtccctataagtatccatgtaggcaattgctgggagatcacatttcgtgctactgtcttcttggattggaagtacagttggtttgttatctaattatcatgttggtttgttaatattattaattgctgcaagacaagctgatgtctctaatctcaatttcttcaagacatttggaaatttgtttgagagaaatgatatcacatttctattcaaggtgtttttctgacagcttctgtctaaattgcaggatatgttttgcagcttattcactattatggggtatgcttctgactgtgttattcaaattgtatttgataatgcacgtagttacttcctgacttaaataactgcaactaatgtaggagaaagtgtattactgtgaaggaaaaaacatattgttctttattttgttatttttggaactgttactcatgattacccctttttttgctgactttctattatgcgctagtgaaatattcttacacacatgcttttcatattgcaggggcccatcaaatgcattctactgttttgctcatgactacagtgcacacttcttctgtgtggcttcttttctatggacaaccactatagcgttcactcttcatcgcaccgttgtcaaacataaaacggatgttgaggagtttggatcaattttccacctgtatgtgtggggtatgcaattcttttgaccacttctctgcctttcttggagcttgtgcgtgccaaattagctggtgcaatattattaagaagttagaaatgcttgttgatttggtatagtgcttctttttcatttgaagtattgacaattttatagctgtttcatctatttgaagtgtatgtgattgataagagggaacaagcgggagcattttgatttcttatatctaagcattatgtagatttgatgcacatacttttgtttctccttttctgttattgttgtctgcattgtttgtcatctaagaaccaagtatgcaagttccagtttctcatgcatttttcattcctgtctgctaatgtatatactgaatggtagacaacttaagacatttgttgacttgacataattgcgaacatgtgttgtaactcatcctattaatcttgttgccctgcttgaatttacagttcttgtgacaataattttccttttatatgtttctcaggaacttcactagctacaactgtattacgttcaattggaagtgattatggaaggccaggcacctggtgttggatccaacaaggaagcatgggaaaggcatgtgaccttttgtgttttgtcatgaatcagttaacttggttctaacactgctaacacctatctacagcttacatttgaaccttatccatggtagtcagagtggcccaaattggtgctaatgacgttcctatatgtttttgctttcatttagtatttgagctgttatcaaatgatccaaaacaaactccactcaacagaataagtactacctttgtctcaaaaagacttcatttctagctatgaacctaggcaagtattgtctatattcatagtcagaaatgaagtctttgtgggatggaggtagtaacatttatttatttggaattgcttacgtaccttgcacaagacagatggtatcataaagtttagtgagtctctgagagtatacgcatgctttctcttagtttgtatgtttgactttttgtgcattggcttctttcttttccatatctttactgcaatctatgtcttctgttaatttgccatcttgatcctagctagaccactcattcaaaataaaaatattgtcactttgtcagaattttagcaattgttcattatatgtcttttatatgcaggtcttgcacttggtaaccttttatcttccattgtggggtgccattctctacaatgggtatacatactttcaggttaatcgcatgataaacaacgcgacaagggtatgcatacagttttctattttatattgatgataaataaggcttgtattgaatccttgtaaattctgctctttttgcttatatgttctgattttcataagataatggatgaatttgtagatggctgttggcataagtgatcgatcaattcaatctgacgtgagggcagacaagaaggtataaatttcctacacatctcttctcattatgtgtactgaaatattttcccctaatgtgctactgtattcttcctactatcatgaattcagagagtaactcatttgatcctattattttttttatacctccagtcttgagatgaactggagtataataccttatgttatcatgtttggagcaaaaatgatgtgtaaattctaggagtacttatattatcatgttacctggatgtctggatcagcctcgcaccactgtctactgtctggtagcagataggaatgtttatttgagcagatacagcttattgacttgttttcttttgcaggcgtttaatcggtggggttattaccctctcattctaataggttcatgggctttcgcaacaatcaatcgtgtgcatgactttgctaatccaggccacaagatattttggctctctattcttgatgttgggtttgccggacttatggtgagtattttcatcctagatgctagttacccagttctgaagagttttcataacatattgaaactactttgataatgtgggttgagccaaccttttaagtttagggctagagaaagaggcttagaggactccacgtatcttgttgtcagtcctgttgataattttttataaatgggagcgctggagttccaaccctactctttcttgaaacaggcctatgaaattggttgtatttcatacttagccttcagtatccaaagaattggctctatataatgcatagatgagtcatggtctcgtggagtcctcttgaagttctgtttgtagaagtgtattgttgttttgtttccttgtgaggcttacctcagcttgagcttatctcacaaaacttctctggcgttacatcatctgtgaacacattttccatggattctaatgcttcatggtatctttaggggctttttaattccatcgcttatgggctcaactcgtcagtgcgcagagcgattgctgaaagacttgacatgtgagttattttctagactttacaatcatctgttcctcctgtatcacctcatttccgtttatcatttactatattggtttatgcactatataacattttgtttcctgaattgtccaggtatctacctgagagatttaaaaggagcctccctactctgacacgatttaaaagtcagcaagaaaatgaacttacttctcttattgtcgatgcgagtaacacataggaatttttctagcacactaagtttgttcatatcttgtgggttcttcaatccagaaagggtgtatgacattactgtagagccagatgtttagcattaaccatttgttagcatgtggaatagttcccctgcggtcctttgttgattgccttgaacacgagcagtgtaatatattgaagttgcattgtccggagtacataagagattaggagatagccagagttgtagatactactatgacgttgatctgtatccctttttttgtggatgtatcagtgtaccaccctctccatgttttgctttcatatgtttgtctcaaaatactggccacaggccacatacggtacgacttactaatgtttcggttctcctgagtcctaacagttgacagtgtcaaaacagtttttcccattgatgattattttcaccttagtgaaagcgtagttcttgtaaactgcctcgtggccttgtccatgggaaaggaaaagcactaggctattgctttgagatggtgttggctcgagctctcgtccatagtggaaaaggagaagcggcaaaaggtgaatacatggggaaaggaaggaggctggcaattgctttgagatggtgttggggataggattcaacatgtttgaaggaagaattgaatagggcttgccttgcttaggagttacggtgttggggataggattcaacatattcgaaggaagaattgaatagggcttggcttgttcaggagttactcgaatatttctcggtcttgcacactctcgtcaacag

SEQ ID NO: 94 - DNA, 1627 bp, Zea mays
  CDS (181)..(1257)
ccgaggcatccttctcctttccctctccttccccaaacccttttcctctttccctcgccccaagaacttcatctcatctccaggcgccccttttgcgcttgcgcaggaggagctcacggggacagtgggcggagagctcgatcgctgcaccactacttcactggaggtccgcccactcccatggaggagatcacccaacactttggagttggcgcaagcagccacggccatggccacggccagcaccaccatcatcaccaccaccaccacccgtgggcatcctccctcagcgccgtcgtagcgccgctgccgccgcaaccgccaagcgcaggcctgccgctgaccctgaacacggtggcggccactgggaacagcggcggtagcggcaacccggtgctgcagcttgccaacggtggcggcctcctcgacgcatgcgtcaaggcgaaggagccctcgtcgtcgtctccctacgcaggcgacgtcgaggccatcaaggccaagatcatctcgcacccacactactactcgctcctcactgcctacctcgagtgcaacaaggtgggggcaccaccggaggtgtcggcgaggctgacggagatagcgcaggaggtggaggcgcggcagcgcacggcgctcggcggcctggccgctgcgacggagccggagctggaccagttcatggaggcgtaccacgagatgctggtgaagttcagggaggagctgacgaggccgctgcaggaggcgatggagttcatgcgaagggtggagtcgcagctgaactcgctttccatctccggaaggtcgctgcgcaacatcctttcatctggctcttctgaggaggatcaagaaggtagcggaggagagaccgagctccctgaagttgatgcacatggtgtggaccaagagctgaagcaccatctcctgaagaaatacagtggctatctaagctcgctcaagcaagaactgtcaaagaagaagaagaaagggaagctccccaaggaggctcgccagcagctccttagctggtgggatcagcactacaaatggccttacccctcagagactcagaaggtggcactggctgagtctaccgggcttgacctgaagcagatcaacaactggttcatcaaccagcggaagcggcactggaagccatccgaggagatgcaccacctgatgatggatgggtaccacaccaccaatgccttctacatggacggccacttcatcaacgacggcgggctgtaccggctcggctagccaccggtatctcgcttccatttcacaccccacggcctagctataaagactaatggttccaggtgtctgaagtactgaagacaggggggctagctatctaatgtttgtgccgcacgcatgagctgtaaggaggccatgcttaattattctgttgccgttgctactctatctatatgcgcctatgcctccgtgcatgaactatgctttaggtggttgctgctccacactgtggtggtgtgcttttgcttttgtgtggtcgtattgtatgcgtaacctgacagatggatccctgattgctacatgtttgaataatttgcatgatctagctagtttctgcctaatctaatggtacggctcatgtcttgtc

SEQ ID NO: 95 - DNA, 1164 bp, Zea mays
  CDS (277)..(1002)
ctctctgctccgggttcagagcagagctcagcgccctgtctccctccctccctccattcctcctcctccgctctctctctgcaggcctgcactgtgaggagactgtgacccggggacggagagctcctttcttctctctcatcgctccaccccttatttaccggtcggttgttcctgggccgtcccgtcccgtcccgtcgtctcgcctgggttctcgcttgcttctcaccatcactaccaccgtccacaccatcgcgagggcctggagggaagaggatgggacagggaggagaagtgaaggcggcgccggccgtgagggtgctggtggtggacgactcccccgtcgaccgcaaggtcgtggagctgctgctccggaaccacaaccaccagggcggcgccgcgccattccacgttaccgccgtcgacagcggcaagaaggcaatggagcatctccggctgatggagcaaggcggccagctggattcatgtgccgctgatgctaatcggataaccattgacatcgtgctcacggactactgcatgccggagatgactggctacgacctgctcaaggccatcaaggcgctgagctcccctaacccgatcccggtggtggtgatgtcgtcggagaacgagccccagaggatcagcagatgcctaaccgccggtgccgaggatttcatcctcaagccactcaagaccaaggacgtgcagcgcctgcgcaactgctccagcgccgctagacccagggacgacgcggcccaccagtgcgagagcttgaggaggagcagcagaaagctgcggtcggatcaggtcgccgcgcctggccacagatcgcaaccgacgacgggattaaccatggtgctgcatgcctccagcattgagctctcgcactacttccagttcctcctcaagttcgtgctgctcgcgtacgcggtgctgtgcctgaccgagctcctccacagatggtccaatggctccgtcctctccctgtggtctgcatgaggtcgactggaaccgcgatgcggtattattagtgtaaccactaaggctccaggctttcagttcaattcccccctgtaatccagtcctggcatgaggagccaccagttcttgctcgccgctccctatatttccatttcacttaaaaaaaaaaaaaaaaaa

SEQ ID NO: 96 - DNA, 2594 bp, Zea mays
  CDS (188)..(2245)
cccacgcgtccgccctgcttcgctgttccctttccccgcccctacctggggcatctgcctctgaatcgcggcggctcccgaggcgccgcctggcgagcgtctaggcgccggtctacggcgacgatggaggtgtgatttggacgggagagagcgtggtggtgaggtctcggttttctcgatataggagatggcggcggcagaggcgcggggaggggagttccccgtgggcatgaaggtgctggttgtggacgacgacccgacgtgcctcgttgtgctcaagaggatgctccttgagtgccgatatgacgtgacaacatgtcctcaggctacaagagcactaactatgttgcgagagaataggcgtggttttgatgttataataagtgatgtccacatgccggatatggacggattcaggctacttgaacttgtaggccttgagatggaccttccagttatcatgatgtctgctgattcaagaacggatattgtaatgaacggaattaagcatggagcatgtgactatttaataaaacctgtcagaatggaggagctgaaaaacatctggcaacatgttattaggaaaaaatttaatgaaaacaaggaccatgagcattctggtagcctagatgacaccgatcgtaacagaccaaccaataatgataatgaatacgcttcctccgcgaatgatggaggtgatggcagctggaaatctcagagaaagaaaagagagaaagaagatgatgaaactgacctcgaaaatggtgatccttcttctacatcaaagaaaccaagagttgtttggtcagttgagcttcatcaacaatttgtgaatgcagtcaatcacctcgggatagacaaagctgtcccaaagaaaattttggaattgatgaatgtcccaggcttaaccagggaaaatgttgccagccatttgcagaaattcagactctacctgaagagaattgctcagcatcatgcaggaatacctcatccatttgttgcgcctgtatctagtgctaacgttgctccgttaggaggactggaattccaagctttggctgcttctggtcagatccctcctcaagctctggctgctttgcaggatgaactccttggtcgacctacaagcagtttggcgttgcctggaagggaccagtcatctttgcgagtggctgcaatcaaaggaaacaagcaccatgaagaaagagaaatagcatttggtcaacccatatacaagtgtcagaataatgcatatggtgcattccctcaaaacagcccagcagttggaggattgcaaccttttgcagcttggcccaataacaaagttggtatgactgattcaacaagcacattgggaaatgtgggcaattctcaaaatagcaatatgctattgcatgaattgcagcaacagccagacaccttgctgttaggaacccttcacaatattgatgccaaaccttctggtgtagttatgccatctcagtcgttaaatacattcccggctagtgagggtatctcacctaatcaaaatcccttgattataccatctcaacccccaagttttgtgtcatcaattcctccatccatgaaacatgaatctcttcttggattaccttcaacgtcaaccagtctgttgggcgggcttgatatggttaatcaagcttcaacaagtcaggctttgattagtagccatggaacaaatcttcctggtctcatgaaccgtagctcaaatgcaatcccttcaccaggaattagtaattttcaaagtggaaatattcattatgttgttaatcagaacgctatgggagttagctctaagccaccaggtgttctaaagaccgagagcactgactcactgagttgtagttatggctatattggtggtagcaccagtgtggactctggcttgttctcttctcagtccaaaaatccacagtatggtctactgcagaatcaaaatgatgttaacggcagctggtcgccttcacaagattttgatagttttggaaattctcttgggcaaggccaccctggtaccacttcatctaacttccagagttccgcccttgggaagttgcctgaccaaggacgagggagaaatcatgggtttgtcgggaaaggcacttgcattccaagccgctttgcagtggatgaggttgaatctccaactaacaacttgagccacagcattggaaacagtggagacatagtgaaccacgacatatttggatttagtggacatatgtgaaactttcttgaatttcgttgatcagtgagcactggaaacaaatctagtggtttgatgaatggttgctagtaatttcgtttcttttttttttcttctgtaattggtttataaagggaataatctatgtggcagcatgtggaatcttactttatagaagtttgttcagttcaaaggacttaaaattggtcagtcccttgtcatatagcttcttttctttgttctctttttctgtaattaccaattgtagcattatttttatgaccgtcgtaattcagcctagtcgatttattcccggccaaaaaaaaaaaaaaaaaaaaaaaaaaaaaaaaaaaaaaaaaaaaaaaaa

SEQ ID NO: 97 - DNA, 2542 bp, Zea mays
  CDS (112)..(2238)
gggaatgccgccttagagaatggccaccatcaggctgaagctgacgcagatgaatggagggaaaaggaagaggacttggccaacaacgggcacagtgcgccaccgccaggcatgcagcaggtggatgagcataaggaggaacaaagacaaagcattcactgggagaggttcctacctgtgaagacactgagagtcttgctggtggagaatgatgactctactcgtcaggtggtcagtgccctgctccgtaagtgctgctatgaagttattcctgctgaaaatggtttgcatgcatggcgatatcttgaagatctgcagaacaacatcgaccttgtattgactgaggttttcatgccttgtctatctggtatcggtctgcttagcaaaatcacaagtcacaaaatttgcaaagacattcctgtgattatgatgtctacgaatgattctatgagtatggtgtttaagtgtttgtcgaagggagcagttgatttcttggtaaaaccactacgtaagaatgagcttaagaacctttggcagcatgtttggaggcgatgccacagttccagtggaagtgaaagtggcatccagacacagaagtgtgccaaactaaatactggcgacgagtatgagaacggcagtgacagcaatcatgatgatgaagaaaatgatgacggcgacgatgacgacttcagtgttggactcaatgctagggatggaagtgacaatggcagtggtactcaaagctcatggacaaagcgtgctgtggagattgacagcccacaacctatatctcccgatcaactagttgatccacctgatagtacatgtgcacaagtaattcaccctagatcagagatatgcagtaacaagtggttaccgacagcaaacaaaaggaatgtcaagaaacagaaggagaataaagatgaatctatgggaagatacttaggaataggtgctcctaggaactcaagtgcagaatatcaatcatctctcaatgatgtatctgttaatccaatagaaaaaggacatgagaatcacatgtccaaatgcaaatctaaaaaggaaacaatggcagaagatgattgtacaaacatgcctagtgcaacaaatgctgaaactgctgatttgattagctcaatagccagaaacacagaaggccaacaagcagtacaagccgttgacgcaccagatggcccttccaaaatggctaatggaaatgataagaatcatgattctcatatcgaagtgacaccccatgagttgggtttgaagagatcgagaacaaatggagctacagcggaaatccatgatgagcgaaatattctgaaaagatcagatcagtcagccttcaccaggtaccatacatctgtggcttccaatcaaggtggagcaagatatggggaaagctcttcaccacaagataacagttctgaggccatgaaaacggactctacatgcaagatgaagtcaaattcagatgctgctccaataaagcagggctccaatggcagtagcaataacgatgtgggatccagtacaaagaatgttgctgcaaggccttcgggtgacagggagagagtagcgtcaccattagccatcaaatctacccagcatgcctcagcatttcatactatacagaatcaaacgtcaccagctaatctgattggggaagacaaagctgatgaaggaatttccaatacagtgaaaatgagccacccaacagaggttccacaaggctgcgtccagcatcatcatcatgtgcattattacctccatgttatgacacagaaacagccatcaacagaccgtggatcatcagatgttcactgtggttcgtcaaatgtgtttgatcctcctgttgaaggacatgctgcaaactacagtgtgaatgggggtgtctcagttggtcataatgggtgcaatgggcagaatggaagtagcgctgtccccaatattgcaagaccaaacatagagagtattaatggtaccatgagccaaaatattgccggaggtggcattgtaagtgggagtgggagtggcaatgacatgtatcagaatcggttcctgcaacgagaagctgcattgaacaaattcagactgaagcggaaagatcggaactttggtaaaaaggttcgctaccaaagcaggaagaggcttgctgagcagcggccacgggtccgaggacagtttgtgcgacaatctgagcaagaagatcaaacagcgcaaggttcagaaagatgacacgtaatttctaatacaacgtatcatcttcttcggcagatctgagaattaggcggttcttcctattgcgcatcttcgtcgacagatctgagaattaagtggtccttcccattgctgatagtagcccactgattcccaacgttagagtacacaataaataagactctagttgtcaatttctgtggttgactgcagatgatcaccctagcgctatggagtcaacaatgtaatatttatatactatgttcgtgccttggcgccttggcggtttgcaatcttcagtttcctttctgagaaaaaa

SEQ ID NO: 98 - DNA, 2382 bp, Zea mays
  CDS (84)..(1976)
cccacgcgtccggcgagaatagggagagatcagacaagctgttgtcggaatccactccggcgaggaggagtgctgaggtcgaaatggggggaggagcggatgaggtggtgaaggtcgtggattcggaggacggcgagggggaggaggaagaggcagaggccgcggcggcggaggggtcgagcaaggagacgccgatgctgccaaggatgccggtgcgcgtgctgctcgccgagggcgacgactccacgcgccacgtcatctccgcgctgctccgcaagtgcggctaccgagttgctgcagcctctgatggtgtgaaggcgtgggacatattaaaggaaaaatctttcaacatagaccttgttttaactgaagttgaactgcctttgatgtctgggttcctcttgttatccacgatcatggagcatgatgcatccaagaacatccctgttataatgatgtcttcacacgactctgtaagcatggttttcaaatgcatgctaaagggtgcagcagatttccttgttaagccgctaagaaagaacgaattaaggaacttgtggcagcacgtttggagaaaacaactggcaaacggcgggcccgatgtgcagcacatacaagaagagaatctcgcagaaagaatggaacagaagactggcgtgacaaaagctgataatttgaacagtgatggtccccataaaaatagagaatgcagtgaacaagaaagtgatgctcaaagttcttgcacaaggtcagagttggaggctgaaagtaagcaaactaacaacattttggagtatatgcaatcaactgaaaggcatttgtttattcgtagccacaaggatttagagctaaatggagagaccaaaacacgaactaagggtaataacttgattccaacaagagaagacgatttattgccaaagaaaagaacatgtttgaatgacaatgattctgagagaacttccagagatatggagctagtccacattatggacaatcagcagaagcatgacacacagagggatgtggatactatgagaacaacatccaggggaaatgatgagaagaactccatcccagcacaccagttggaactttctcttagaagaactgactatggaaaattagagaaccacgagaaaaatgatagaagaacactgaaccattcaacttcatctgcattttacttgtataattgcaggactgcgtccagcttaggaaatgctggtgatggtcaattatgcagcacctcagaaacactagtggatgttgaaaatagaaatggagatttggcagctctgtctgaagacacgactgaaacaaatcgtcctcctatcagagttgtaccatttcctgtccctgttcaatgcttcacatttgatgggcagccgttctggaatggtacaccggtggcatctccattctacccacagtcagctccccccatttggaatagcaaaacaccaacgtggcaagaatcaaccccacaggcaacttcactgccgcaaaaatcgcaacagaatgaaccagttgaaatggatgctaaaccagttgaaaatgcagaggaacaatttgtcgtaggtcctcccagtgccagtgggaagcagctgcatgttgaaattcctaaagatggtctacggcacatttctcctgtgaccggtgaaagtggaatcagtacggtgctagacagcaccagaaatactctgagcagcagtggctgtgatagcacttccaaccggatcaccgcctctactgaaccatcatccaatgtatacaggggcgttcctgaaaccgcaagagccgaaggtttacgacacctgagccagcgtgaggctgcactgaacaagttccggctaaagaggaaggacaggtgctttgagaagaaggttcggtaccagagccggaaattactcgcagagcagcgtccacgggtcaagggccagtttgtccgtcaagatcatagcatccaaggaagctagggtccagttactgagctggaactcttccccattatctaaaaaaaagtcactgtaagtgactccactgcggggtatcctgatgtcaggttttttcgaagagttggaagcaatcacaccgagttacggtttgctgtgtatgtttgctaaagcttgtaatataagtatgtataggctgactcttctttccttaggttaggcacaggacctggcacgttctagacggtttgtcgttagacgttagaaaatacaggcatacttgtgtcctccagtagcacgtcctccagtagcacgtgtgctttaagccttgtattatgtaattagccaaggtgctgtttggttcacgaaatgtaacgtaaagggtaatggtaatggtttacactaaaaaaaaaaaaaaaaaaaaaaa

SEQ ID NO: 99 - DNA, 2232 bp, Zea mays
  CDS (39)..(1931)
ccgctgctgttggattcgccgagccggagccgccggagatgaccgtcgacgagctgaagctgcaggcgagggccagcggcggccacggcgccaaggaccagttccccgtcggcatgcgcgtgctcgccgtcgacgacgacccgacctgcctcaagatcctcgagaacctcttgctccgctgccagtaccatgtgacaacaacgggacaggcagccacggccttgaagctgctgagggagaagaaggaccagtttgaccttgtgatcagcgacgtccacatgccggacatggacggcttcaagctcctcgagcttgtgggcctcgagatggacctcccggtcattatgctgtctgcaaatggggagacacagacagtcatgaaggggattacccatggagcatgtgactacctgctgaagccagtgcgtattgagcagctgaggactatatggcagcatgtggttaggcggaggagttgtgacgccaagaacagtggcaatgacaacgatgattcgggtaaaaagttgcaggtggtgagcgctgaaggtgacaatggcggtgttaatcgcaacaagagaatttcacgcaagggtagggatgataatggtgatgacggtgatgattctgatgacaacagtaatgagaatggagactcgtcgagccagaagaagccaagggttgtgtggtctgttgaattgcaccgaaagtttgtggctgctgtcaaccagcttggcattgacaaggctgttccaaagaaaatattggatcttatgaatgttgagaacatcacaagggagaacgttgcaagtcatctgcagaagtatcggctgtatctgaaaagactcagcgcagatgcaagcaggcaggctaacctaactgctgcatttggaggaagaaaccctgcttatgtgaacatgggactagacgccttcaggcagtacaatgcatatgggagataccggccagttccaaccactaaccattcacagccaaacaacctccttgcaaggatgaactctcctgcatttggtatgcatggtctgctgccttcgcagccacttcagattggacacaaccagaacaatctgagcacttccctagggaatgtcggggggatgaacaacggcaacctgatcaggggtgcgcatatgccactgcaggatactagcaaatgctttcctactggcccttctggtaattcgttcgcgaacatatcaaacagcacacaactggttacgacaaacaacttgccattacagtctcttgagccaagcaaccaacaacaccttggtcggctgcattcctctgcagaccctttcaactcatttgttggtgagcccccccagtttgcagatcttggaaggtgcaacaccacctggccaaccgcggtctcatcatccaatgttcaggagattggccagaaggacaggatcgtgaataggcccaagcttgagcctctctcaagctttacagaagcatccagtcagatccctttgctgggaagtgaaatgcagagccaccaagtagcatcactagccagcaacggtcttccgatgccgttcactcaggaagcggtgcccttcgcttatggaagcagcacgaactcgagagagatgctgaataacaaccttgcgcttagtaattcaggcgtcaactctacattgccgaaccttcgcatagacggttctgttgttccagggcagacactgggtggtagcaattcaggtggttgtgttgtcccccctctgcaagatggcaggattgatcaccaagctgtcagcagtcatctaaactacaacaacgaactcatggggacaggtaggctgcaaaggggacttagtggtggtctggatgacattgtcgtggacatgtttaggccggaccgcgcagacgatggcgtctccttcattgatggggactgggaactggtctagcaagtttcagttctctacatcaagtctgccttcgtgtgagattttccgcatttgtggttgtggaggggttcggcgcttgattggtccaaagttgtttatagtagcaagattgcatcacaaatgccctttgcatttggtttttcagtttagcgaccaggttccagtgtcacgtccgaatatcaactatgtggtatttgctaccttaactcgtatggctatgttttcaagtcaggtgttaactgtggctatcgtgatatatacagcatggttatgagccaaaaaaaaaaaaaaaaaaaaa

SEQ ID NO: 100 - DNA, 2079 bp, Zea mays
  CDS (61)..(1812)
ccttcgccctcccccgcctgcgagcgcgaggcgcggaggggctagcgcgctagcggcgccatggccctgaccgacgccaccgcgttcccctacggcctgcgggtcctcgtcgtcgacgacgaccccacctggctcaagatcctcgagaagatgctccgcaagtgttcatacgaagtcaccacatgcggtttagccagtgttgctatccaaattctccgggagaggagaaacaagtttgacattgtaatcagtgatgtcaacatgcctgacatggatggtttcaagcttctcgaactcattgggcttgagatggatctacctgttataatgatgtccatagacggagagacaagtagggtgatgaaaggtgtccagcatggtgcatgtgactacctcctcaagcctgttcggatgaaggaactccgaaacatttggcaacatgtgtataggaaaaaaatgcatgaggtgaaagagattgaaggtaatgacagctatgatgatctccaaatgtttagaaatggtgtagagggattcgacgagagggacctatttatgagagctgactctgatactatgaggaagagaaaagacgtgaataaggaccatgcagatcaggactcaagtgatggagctactgttaagaaggctagagttgtctggtctgttgaccttcaccagaaatttgtaaatgctgtcaaccaaattggatttgacaaagtcgggccgaagaaaatactggatcttatgaatgttcctggcctgacaagagagaatgtggccagtcatcttcagaaataccgcctctacttgagtaggttgcaaaagcagaacgaggaaaggataatgggtgctgctaggcaagatttcaatcaaaagggaccatcggatcatcttaacctccgaagttccttccaagagcaaccaggcaacctttccaatggatgtcagcatagttctcagaaggtcgaagctcagaccaacattctcgatcctcatctggacgacacgaagacttcaatgcccttgaaggtgccagataaaaatggaatttcagcaagtgatgctgttgaccctcacaatatcaccactgcttcacctttaagtggggtgttctcttttgaaagaatgccagtgaatcaggacaggaagctatcagaaaccatgatcttggaatgtgagtcctggagtggaagtgtgccaccaaagcagttcatgcagtatccaaagcataaccatgagcgctgcgaccttctaggagactattcttgcttgcctaaaccggacttggagcacccaattgcccctggtcatctgtatgccccaccgccagtaatttcgatgagttacaatgtggagaaagatgtcagagacttctcagatgtaaaaccagatcttcttggctgtatgaagtccttatcaccagcactgacatgtacagttgagtcggtttctgctcaacttagtgacagtgttgtgacctcaactaacagtgaccggaagttttccagcgtggaggggttgtccagcattaaagattgtgactttgatcaggaaaggaacggagctattttgtttacttcagaagaggcaagtatattatgcggcactgattttacttgtctacctgaagacctgtccggctatcaacttcaaggtgtctccttcgggaataaaggattgaacagcatcgatttatatcagtgcaatgatacaatgttaatacctggactgcagaataattggtatgatgatgatgtagagtttagcagtgaaaccgtggagttcccattgctagacggaggcctgtttgcataaatgcctcatctggccctatctttcaaccatgcccttatgtcagcagggatgatgttcattggtatgttcccctatagcgcctcctgtagggctatatttaacctaacttgatcctgtggtggaaggatttaatttgtagtctcgccacttttgataattgtctgtattatagactgtgccatggcacaatgactgcaatatatactcttcacggtgatcaaaattacatatgaagactgtcaaaaaaaaaaaaaaaaaaaaaaa

SEQ ID NO: 101 - DNA, 1708 bp, Zea mays
  CDS (391)..(1116)
caactcatcgggcgcggagaccaccgcggggggaaaagcgagggaggggggagaggactgaagagaaatcatggagccgatttgctgtggagattcgggcgcgtgatccggtcggatcttgctttcccggggggcgatcgaggccacgccgctgctgccgcggtgccctccctctgcctctgggctctgcgtgtgacgtgccgtgccatggcgctcgccctcgcctatatccccagcctccctcgccccgccgctggccgccgcattcagtaaaaagccacctaccctaccctcctgcgctggtactacttactacctagccaggccaaggagcccaacgagggggaacgctgcggtaggcgcgcgctgctcgtcccaccccacgccgccatgacggtgccagatgccgagtcgcgcttccatgtcctcgcggtggacgacagcctcgtcgacaggaaactcatcgagatgctgctcaagacctcgtcctaccaagtgaccacggtggattccgggagcaaggcgctggagctgctggggctgagggacgcgtcgtcgccgtctccgtcctcgcctgaccaccaggagatcgacgtgaatctcatcatcactgactactgcatgccaggcatgacaggatacgatctgctcaagagagtgaaggggtcctcctcgctcaaggacattcctgtggtgatcatgtcgtctgagaatgtgcctgcccggatcagcaggtgcttgcaagacggcgcggaggagttcttcctgaagcccgtgaagctggccgacatgaagaagctcaagtcgcacctgctgaaacggaagcagcccaaggaggcgcaggcgcaggcgcaggcgcaggcgcagcagggacaggcggtggagctggagcctgagcagcagctggacccgcgcacgcagccggcgcacgacgcggaggaaaccgcggcagagccgccgccggccgcatccaacggaaccaccgatggcggcaacaagaggaaggcggcagccatggaggaggaggggatgctggccgtgatgacggtggcggcgccggagagcagcaccaagccgaggctgtccaccaccaccagcagcctggcggtggaaacctgagctgagaatcggacggcgaccggatcacatactactacctacgtacattaatccaccattgcgggcagtcgagaggcaaccaaccaaccaagaaccaaccgaccaaacccaggccaccgccgagaaagagctcgtcctccttttctttcgctggttcttttggttctcggagctaattaatggaatgaaggtgtgagctcctggggatggaggggcggttacgggctctaagtgaagaacaattacgacgtaccttacctagcggctgctgcttcggccggcaaattttgttgtgctcgtggtcatggacacccttgtgttcgttaggagggggtcggggtggaacggtgaaaaggaagctgtagatagaaaaggcaggcgtctcatgctcttgttgtctagtctaatttttaattttactcggcttattaatcacggtactgactagctgccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 102 - DNA, 1395 bp, Zea mays
  CDS (335)..(1066)
cctgacaccatactatacctccccctccccggccctgtcctactagccgtcagaggtttgccgcctcctcgctcctcgtcttcatcactctctctctctctctctctctcttccttcgtcctcgacctgtggccacctgtggcgtcacgctttataagagcacgcggccggcaaccatctcccttgccacccacaagtagagaagaatcttttgttgctgacgcctgagacgctggcactgccgccgcgccgtctggagagaaagagcagagggacactgaagcagaggagccgaggggtagcgacgagagacgagcgagagcggacgacggagatggaagcaggaggagcaggagcggagggggtgatgagggtgctgctggtggacgactcccccgtcgaccgccgcgtggcgcagctgctcctcagcagcaactcctgcgccggctcattccacgtcatcgccgtggacagcgccaagaaggcgatggagttcctcggcctcaaggacggcggcaaggagcaggccatcgacatggtgctcacggactactgcatgccagagatgaccggatacgacctgctcaaggccatcaaggcactgaacccgctgaagccgatccctgtcatcgtcatgtcgtcagaagacgagccccagaggatcagccgatgcctgaacgccggcgccgaggacttcatcgtgaagcccctgcagagcaaggacgtgcagcgcctccggaactgctccacggtcgggaggcccagcaacaagggcggcgccacgttgccgtgcgaggagaacgccgtggccaagtggagtaacaacaagctgccgccctccgccggcgccggcgccggcgccagcgccacgtcgccgtcgggacggcgggcgaacctcgccggagtcgccatgcgccaggtgctgcactcgtcgagcgtggagatctcgcagtacctgccgctcctgctcaagctcgtcgtgctggcgtacgccgcgctgtgcctgggcgagctcctgcacagatggtcgtcgggcggcagctgctcgctctccccgtggtgcgcctgatcaggaaggagcaagcagcgcaaaaagccagcaacggtgcaagagccccccctgggcaccgacgacaggagactgctgctgcaccaagcattatttcaggctccaatagccctagtcttttaatttaggtagagattgtctctgctctgagatcctaaccggggtttcgaccgatgatgagtccccccgtggcttttgttcgttgatttgaggggccgtagacgtaggaaggaggaggaactgaacgaaccccttgtatcctctgctctgtatagaatgaatgaatgaatgaatgaatcagaatgcaacgcgtcaaaaaaaaaaaa

SEQ ID NO: 103 - DNA, 1214 bp, Zea mays
  CDS (55)..(759)
cggacgcgtgggtcctccaccaccattcatcagaaagcgaagcacaagcctctgatgccaagccaaagcacacacacctcctccagcctttcttcctctacagccccaattcttccctgcagctctgctgctgccttgtttcgatcggtcatggcggcggtggccacagagactccgttccatgtcctggcggtggacgacagcctcccggacaggaagctcatcgagaggctcctcaagacctcttccttccaagtgaccactgtcgactccgggagcaaggcgctgcagttcctgggcctccatgaccaggatagcacggttcctcctgtccacacgcaccagctggatgtggctgccaatcaggatgtggctgtgaacctgatcatcacagactactgcatgcctggcatgacaggatatgacctgctcaagaagatcaaggagtcgtcgtctctcagagatatcccggtggtgatcatgtcctctgagaacattccttcaaggatcaataggtgcctggaggaaggagctgacgagttcttcctaaaacctgtgcggctatcagacatgaacaagctcaagccccacatactgaaaagcagatgcaaccaggaacagcaccagcaaagtgacagtcacagtggcgaacgcaggaaccccacaatcagcagcagcgatagcataaacaaccgcaagagaaagggtgcaggcaccgaagaaatcttgccccagctggcaaacagatcaaggcacagttaactgagaactgactagtacagctaaaaccttttctttttcactttactttggcctactgatttgtaacgtagatgttagccctggatttgcaaaacggaacggaatctgtaaactgatactgcttgagtcgaatcgatcgaagtgattctgcaccagatctccctatttcatttatcagaatcgaaagccagctgacagagtcacagtaacagcccgttggacatagcagcaggtgccgaagccaagaacatctgaaactgaccgtcggataacctacgatgggagtagccttttactgcttctaagctttagcctggatacaagttgtcactacagtagtcagtagggcagtaacttggtgcatctccaagagttttcaaaacacactgtcaatctagaaatttttggtgaaaaaaaaaaaaaaaaaaaaaaaaaaaaaaaaaaaaaaaaaa

SEQ ID NO: 104 - DNA, 975 bp, Zea mays
  CDS (154)..(624)
gactagttctagatcgccgcaactgcccgtctgctcctgcttttcatccagtcgcaaaacaaagagaagagatctccgcgtccgcaaccgcatcgcttccctcccggcagaagaagaagattcggttgggttgtttgtctcttgcaaaccgcaatggctgctgctgccactgctactccggccgtggcgccggaggccggcgaccggaaggcggtggcaccgccggtcgacgcggtggatctggagctggagctggaggagaagcacgtgctggcggtggacgacagctccgtggaccgcgcggtgatcgccaagatcctacgcagctccaaatacagagtgacgaccgtggactcggcgacgcgcgcgctggagctgctggcgctggggctggtccccgacgtgaacatgatcatcacggactactggatgcccgggatgaccgggtacgagctgctgaagcacgtgaaggagtcgtcggcgctgcgggccatcccggtggtgatcatgtcgtcggagaacgtgcccacccgcatcagccggtgcctggaggagggcgccgaggacttcctcctcaagcccgtccgccccgccgacgtctcccgcctctgcagccggatccggtgaccgcccgcgcaaggatggaggatctggttgcgcgctctgacttaattagaggagttgttaggatccaattttttgtgtgttcgttcgttcgttcgttcttttctttctttcttcttggacatagatctgctgccgccgctgctgccgtcgactgaaacaagaagctaacttagttttagggtccaggttgttgttgttgttgttaggaaggcgagtcgttgggggcattcacggatgttcttcctcgtttcccctccctccgtgcctgaggctgcaaaaatatgccccccagacatgaaaaaaaaacaagacctgttaacagttccaaaaaaaaaaaaaaaaaaaaaa

SEQ ID NO: 105 - DNA, 2229 bp, Zea mays
  CDS (374)..(722), (791)..(2019)
caacagagaagagcggacgccaccggacgccaccgccgccaatcaatagattaggcgcggataatggtgctggccggaccgcgacgggcggaggagggcgccgcggcccccgcccgccgccgctgacagagtatacctgcttaaccagccgtctgcaggcacggcgcacgcgcggtggtacctcgcgaggggctcgggttgactgggcgctactcgtggccgcggggatggaggaggaggcgtctgcagatccaccgaccgcttcgtcctgcaccggcgtctctggttccggccgctgctgaatccgacgcttcggttcgcgtccccagtccccttggcggaggcgtggatcgtgtgtttggggggtttgggtatggtgggcggcggtgagggggatcgcgtgggcggcggcgtaggggttgggggaggccagcagttcgtggaccgcagcaaggtgaggattcttctctgcgacggcgacgccagcagctcccgggaggtgctgcggctcctctgcaactgctcgtaccatgtaacttgcgccaagtctccgcggcaggtgatcaatattctcaactacgagggcggcgagatcgacatcatcctggctgaggttgatctgccggtctccaagtgcttcaagatgctcaagtacattgccaggaacaaggacctgcgccacatccccatcatcagtaggcagccttcctattctgagccttgtgcggttgtgcctattactgtgatgtgctttctgtgaccgtcctccctgtcttatggaactgtgcagtgatgtccaacagagacgaggtgtctgttgttgtcaagtgcttgaggcttggtgcggccgagtacctggtgaagccgctgcgcacgaatgagctgctgaacctttggacccatgtgtggcggcggagacggatgcttggtttgcccgagaaaaacttcttcaatgacaacttcgagttggtgctctcagaacctagtgatgcaaataccaatagcgccaccctcctctcagatgagacagacgacaggcctaaagaaaacacaaatcaagaaacgggcacctcaaatcagcttgaatacgagtctaatccttccgttgctgagcgcgaccagagagacaagatcggtgctccaggctctgccctagatgccagtcaatcatcgactccgggaagaatgttttcacgtcctataaaaactaacctgaaggttgctgagtcgtctgcatttctagcatatgttaagtcaagcaccccagccaccagttcatttgatagcggactacaaagaggtgacagccggttagattctttggataaccatggtaattgctctagtgcaacagatagaagtgacaccggtactgatgtaaatattcggaataaagaagcttttgagatgcctgtgcagtatcctatggtatgcttttcttcctctagcatgcatatggagcgaagcaatgaaggccataatgacacttcaggaactccacctgcataccatttcccattttattatccagggatggtagaacacaacatggcactttcatcagtgcaaaattttcaagcaaacataaacagtgctcaagcacatacaccaccagcgatgcttcatcagtacaatgttttctcccaatgccatagtttacccatgatatcaccatttcagtttaatacttctggcatgagtatgcactcaagtcatttaccgacgcaaaatgtgtggtcatcggcatcgagcacaccaacgcctgacgaaacatgcaatcgctccgagagaagggctgcagcacttgctaaattcaggcagaaaaggaaagagcgctgttttgacaagaaggtgaggtatgtgaacaggaagaaacttgctgagacgaggctaagggtgcgaggtcaatttgttaggcatgcaagcaatatggatatcataagcactggagatgacatatctgaagacgaagatgacgatccaacctccagggaggtagatatgatttcttctccagagtagtggagaggtcctcttgtgtgaaaaattagagtgcagatggttactgctcactttgttacaactcagtaggactagacaatacattcttctactggcaacaaggcaatacaccctttttgctcacacacagtataaacttttgtccccaaatatctggctgttactccggttgctttaatcgagaaatcatctttttgataaaaaaaa

SEQ ID NO: 106 - DNA, 1184 bp, Zea mays
  CDS (74)..(1036)
ccacgcgtccgcggacgcgtgggcggacgcgtgggttttcacttgacatcccccgtcccatagatcgccggcgatggctccggccgtttccgcggcggcgtcggcggcgatgaggcaggcactgcgggaccggcagatcctcgatgccgtgggcactggcgctgcggcgctctcgctggcaggctcttccttcatcgtgatctgctacctcctcttccgcgagctccgcaagttctccttcaagctcgtcttctacctagccgtctcggatatgttttgcagcttattcactatattgggggggccatcgaatgcattttactgctttgcacatgactacagtgcccatttcttctgtgtggcttcttttctatggacaaccaccatatcattcactctgcatcgcacagttgtaaaacacaaaactgatgttgaagaatttggatctattttccacttatatgtgtggggaacttcactatctaccactgtattacgttcgataggaagtgactatggaagaccaggcacctggtgctggattcagcagggaagcatggcaaaggtcctacatttaataaccttttatcttccactttggggtgccattttgtacaatgggtttacatactatgaagtaaaccgcatgctgaataatgcaacacagatggctgctggcataagtgatcgatcaaatcagtctgacattagggcagacaggaaggcatttaaccgatggggttattaccctctaattctaatcggttcatgggcttttgcaactatcaatcgtctttatgactttgccaatccagggcacaggatagtctggctctcctttcttgatgttgggttcgctggacttatgggcctattcaattccattgcttatgggctaaactcttctgtgcgccgagctatttcagagagaatcgacacgttcctacctgagagaataaaaaggagcctccctgctttgtcaaggctgaggagtcaacaggaaaatgaactcacttctcttatcgttgagggtaactgatatgtaatggattttccatgcacacgaagctttttttttttgtttatctgttcgttcatcaatctccaacaagggaatgcaacatcactgtaggagcagtgggttagtaacacgtcgaattggttcaaaaaaaaaaaaaaaaaag

SEQ ID NO: 107 - DNA, 917 bp, Zea mays
  CDS (103)..(561)
ggctcgagaccagttgatacatgtcttgtgacttgtgaagtgtgttcctatctgcatcaccttccttcgccttgcaaccctttggctagttcattcatacgaatggattattctaatttgcgtcgccaagctgcatccatgaaaaagactctctttgatcaggggtacctagatgagcaattttgccaggtggaagacttgcaggatgaagctagtcctaatttcgcggaagaggttgtcactttgtttttcaaggactcggccaggctaatatcaaatgctgaacaggctctggaaaaataccccaaagatttcaatagatgggatgcatacatgcagcagctaaaaggcagctgttccagcattggtgcttcaaggatgaagagtgagtgcgtgtcattccgggattactgcggacagggaaatgttgaaggttgtatgagatcgttccagaaagtgaagagggagcacggtgccctgaggcagaaactagaggcctatttccagctgctacgacaagctggtcctgctggagctgccaccaggcctggatgtaagaactaggagttgcaggaaaacggagtatgacccaagaagatacctcactacaactgactggcccagtggccctgctgcgcagcaattaggggtcagcatacgaagaaaacaagagatgatatgcatggatatgcacaaaactgtaataagagattgttttttcaagaacaaaaaaaaaatcagaggagaggaagggatgggaaccttgtgtagtgagtttacaagctttactgaaagatggtattattgtctcatgtgtaatatattccttccattttaaaataaaaaaaaaaaaaaaaaaaaaaaaaaaaaaaaaaaaaaaaaaaaaaaaaaaaaaaaaaaaaaaaaaaaaaaaaaag

SEQ ID NO: 108 - DNA, 833 bp, Zea mays
  CDS (57)..(512)
caaccagttgcatatgcattttgtgcctactctacctttaaggcattcatttataaatggagtattctaatttgcagcagcaggcagcgtccttgaaaaagaacctctttgatcagggatacttggatgagcaattttgtcagattgaggacttgcaggatgaagcaagccctaattttacagaagaagttgtttccctgttcttcaagaactcaaccaggctaatgacaaatattgagcaagctatggacaggaatcccagagatttcagtaaatgggatgtaaacatgcagcaattaaaaggaacctgttctagcatcggtgcttgcaggatgaagaacgagtgcacctcattcagaaatagatgtggagacgagaacgttgaaggttgtatgaggtccttccagaacctgaagagggagcatggagtcctcaggcagaagctggaatcctacttccagctgctgcgacaagccggtcctgccgtgactgcaaccaggcctagaggcatgtaaggaacggctgttggcgtgcagggagcagtgcaagggacagacagcgtcatagcgatgctccactacgccattgttgaggctagctgtaacgatgggccacgaataagaagtttgcctatggcctgtgggggagttccctgcgggttttaaagtgtaacacccttcataatcgatgccttaagctggtgctgccgagtgccgactagctaggccggcatgtaagagcagcctagactgatgttgatgtggtctggcagacgtcctgtgctgtgcctgcctctgtatttcggtcaaataaataaactagatggagtttgc

SEQ ID NO: 109 - DNA, 799 bp, Glycine max
  CDS (63)..(527)
cccacgcgtccgcttatgttgttttgtgtgacagacaacagaggaacactcccaaacaaaccatggacgtgggtcagatgcagagacagtggatcgactacaccaaatccctcttcctcgagggcttcctggatggtcagtttctgcaacttcagcagcttcaagatgagaacaaccctgactttgtggtcgaagttgtctctctcttctttgaagattctgaaaggcttctcaaagatctcacctttgccctagatcagaatggcgttgacttcaaaaaagttgatgctcatgtgcaccagttaaagggtagcagttcaagcataggtgcacaaagggtgaaaaatgcctgcattgctttccgcaacttctgtgaggagcagaacacagatgcgtgcgtcagatgtctgcaacaagtgaaacaagagtactgccttgtcaagaataagcttgaaacaatgttcaggcttgagcaacagattgtggcagctggtgggtcaatccctacggaactgagtttcagtggatgatgggtgggtttgtagagatgcttgtattatgatcctcttctttgttaaagattatcctttatcttatttagtccatggtgaatgtatgggtttttatgaagatagaagttttccatccaatgtacctttttcttcaccaaaaagctcttcataatttgtaatcttttgcatgctttactgaaggatgatagcagcaccattaattgaactttcctcttttatctctcttccaaacgaggaagaaaaaaaaaaaaaaacaaaaaaaaaaa

SEQ ID NO: 110 - DNA, 1003 bp, Saccharomyces cerevisiae
  CDS (320)..(823)
tggtaaatagaaacggaactttacatattgaataccggagatataattcgtttatgccacataatcatcaatacatccgtaacccgcccgaaacggaaaaactgaagaaaaattacataaaaagtttaatatttttatcaaatttaattgaacctatatttaggaacattattgtttttaatttctaaaccggttgggttggtcgatagttgtgctctggatcattgataaaccactgacgtgtaatagttttatttctttgaaaaattcaaaagaaataacaacactcgttctcggaaacaagaaaatacacacaataatgtctactattccctcagaaatcatcaattggaccatcttaaatgaaattatatctatggatgacgatgattccgatttttctaaaggtctaattattcaatttatcgaccaggcacaaacaacttttgctcaaatgcaacgacagctggacggtgaaaaaaatcttaccgaattagacaatctgggccattttttaaagggttcttctgctgcattaggcttacaaagaattgcctgggtttgtgaaagaattcaaaacttgggaagaaaaatggaacatttcttccccaacaagaccgaattggtcaacactctgagcgataaatcgattattaatggaatcaatattgatgaagatgacgaggaaataaagatacaagtggacgataaagacgaaaattccatatatctcatcttgatagcaaaagctttgaaccagtctaggttggagttcaaactggcgagaattgagttatctaaatattacaacacaaacctataatcgtcatcattttattcacacctccggataatccattcttccccggaaaaacacatgtacaatatatattatatatatatatatatgtatatcaaatcatacaacttacataaaaacaacaaacctgaatatttttccttttcaaaaagtaattctacccctagattttgcattgctcct

SEQ ID NO: 111 - DNA, 2234 bp, Oryza sativa
  CDS (66)..(1976)
tcatatgtatgtttgtacttctgtagggagtgtggtgaggactgatgaacttgtaaacattgggtatggatggatgtgactgcatcgagccactatggccaactgatgagctcctcatcaagtatcagtacatctcggacttcttcatagccctcgcatatttctcgatcccgttggaactaatttatttcgtgaagaagtcatccttcttcccatacagatgggttttgatccagtttggtgcatttatagtcctatgtggagcgactcatctcataaacctgtggactttcaccacacacacaaagactgttgctatggtcatgacagtcgcaaaggtttcaacggctgttgtgtcctgtgcgacagctttgatgcttgtacatattatccctgacttgctgagcgtgaaaacaagggaattgtttctgaagaataaagctgaacagcttgatagggagatgggcttgattaggacacaggaagagactgggaggcatgttaggatgcttacccatgaaatcagaagcactcttgatagacatacgattttgaagactacacttgttgagctaggagggaccttgggcctggaagaatgtgccctatggatgccatcaagaagcggttcaagtcttcagctttctcatactctccgccaccagattactgttgggtcaactgtatcaattaatcttcctgttgtcaatcaagtgttcagtagcaacagagcaattataataccccacacatctcctttggcacggatccgacctcttgcagggagatatgttccaccagaagtggctgcagtgcgagttcctcttctacatctttcaaactttcaaataaatgattggccagagctttcagcaaagagctatgcaatcatggttctgatgcttccatctgatagcgcaagaaaatggcatgtgcatgagttggagcttgttgaggtcgtggctgatcaggttgcagttgcactttctcatgcagctattcttgaagagtccatgcgtgcgcgtgatctgctaatggagcaaaatgttgctctggatttagctcgacgtgaggctgaaatggctatccgtgctcgtaatgatttcctggctgttatgaatcatgaaatgagaacaccaatgaatgcaataatagccctttcgtccttacttttggaaaccgaacttactcctgagcagcgcttgatggtggaaacagtcttgaaaagcagcaatcttttagcaacactcatcaatgatgtgttagatctttccaaacttgaggatggtagccttgaattggagattaaagcattcaatcttcatgctgttttcaaggaggtaatgagtttcatcaagccaatcgcagccatcaagagactgtctgtgtcagttatgttggcaccagacttgccattatgtgccatcggtgatgaaaagaggctaatgcaaactattttgaatatctctggcaatgctgttaagtttacaaaggagggccacatcacacttgtagcttctgttgtgaaggctgactctttaagagaattcagaaccccagattttcacccaactgcaagcgatgacaatttttatttgaaagttcagattaaagatacgggctgtggcattagccctcaggatctacctcaggtatttacaaagtttcctcaatctcagcctggaggaaacagaggatacagtggtagtggtcttggccttgccatttgcaagaggtttgttactttgatgggagggcacatctggttggatagcgaaggaacaggaagaggctgcacagtaacgtttgtcatccagcttggcatatgcgataatacgaatgcatatcagcagaagctgattcctctagtctggccgagcagtggggatgctgattttgttggtccggtgccaaatgctcctaatgaagagaaaggtcaggcttctctgaaatctcggtatcagagaagtatatgagctactgtaaattgatcgacggcattgtatcaagtagggcctggttagtttgtctctaattttgtgcctagccttgtgatagctggaatatatttgtacaaataatgtacagcagatgggactgcataatgcagctatgcacctgggtacaactctaacttgcgtagtgtcctgtcagcgaaatgtgattctgggctgttcgtgtgaccttctgataaaaaaaaaaaaaaaaaaaaaaaaaaaaaaaaaaaaaaaaaa

SEQ ID NO: 112 - DNA, 2701 bp, Oryza sativa
  CDS (9)..(917), (1160)..(1528), (1646)..(1912), (2188)..(2312), (2425)..(2662)
ataagtagatggatggatcatgtgattgcattgagccgctctggcaggcggatgatctccttgtaaagtatcagtacatatctgacttctttattgcgctcgcttacttctcgatccctttggagctcatatatttcgttaagaagtcagcattcttcccttaccgatgggtgcttatacaattcggcgcattcattgttctttgtggggcaacccacctgataaatttgtggacttttgccatatataccaagactatagctgtggtactgacagtggcgaaagcagcgacagcggttgtttcgtgcatcacagctttgatgcttgtgcatataattcctgatttgttgaatgtgaagttgagagagagatttctgaaggataaggctgatgagcttgatagagagatggggattataagaacacaagaggagacaggaagacatgtccacatgctgacccatgagataagaagcacacttgacaggcacaccattctgcgaactacgctcgtcgagctgggaaggactcttgttttagcggagtgtgccctgtggatgccaacacgctctggatcggcccttcagctctctcatacgatatataacagcgcagcaattggatcagttgttcctatcaaccttcccattgtcagtaaggtttttaatagtaaccgtgtagtaaaaattccgcatacctccccgttagcttcgataacggctgacaaaagcaggtatgtgccaccagaggttgtggctatccgtgttccactgctgcaccttacgaatttccaaataaatgattggcctgagctatctgcaaaaagctttgcagtaatggttttgatgctccctccagacagtgcaagagaatggcggccgcatgaacgggagcttgttgaagtcgttgctgatcaggtagttatcagtttcatttatgtgcattcctctatatatgtaatcaaaatcaaaggtgtgattttctgatacccgatatcttgaatctggtgatatcaggtttagtctgatattgtttggtagagaactagagaatcaattaaatagagaaatttaaccatttatgttggtgtgacctgtgaactaagttttcttgaaaattgtgaaaatcctaaacccatggcctcatttttctcattcaggtagcggtcgcattgtctcatgctgccattttggaagagtccatgcgggcccgtgatctactaatggagcaaaacattgctcttgatgcagcacgtcgggaggcagaaatggctatttgtgcccgtaatgattttcttgctgtaatgaaccatgaaatgcggactcctatgcgagcaatcgtttctttgtcctctctccttttagaaacaaatcttagtgctgaacaacgcctaatggttgagactatactaaagagtagcgatcttctggcaactcttacgaatgatgttttggacgtttcaaagcttgagaatgggagtcttgagctggaaattgcaccttttaatttgcattccacctttacagatgtgagtcccctctctgtgatttaggatttgctgttatgttgcctggaaagtaagaaatggagatctttgctatttttcattaagattaactcggtagttcatcttgtattcttgtaggtggttaatttgattaagccagtagcagcgtgcaagaggctctcggttatggtcactttggcaccagagttacctctacatgctattggtgatcaaaagcgattgatgcaaataatcctaaatgttgccgggaactccattaagttcacaaaggagggtcatgtttcgattacagcttctatggccagaccagatgctttgagaggtccacatgaacctgactaccatccagttgtctctgatggattcttttacctggctgttcaggtttgctcatgaacattttctatgttcgctacttcctcttatctccagtctattaagattatagttatacatggttgaactttatctgttacttgttattatgcttcacaagttcacctgtgtgttgtagcgcatctaatgtccaacaaaccactgatttagttctcgcaatctgtataagttgccttgttttgtgttagagggatattaagataggataccacgtactaaacatttagttgttttatgacttgatcttttttctatttctgtaggtaaaagacacaggctgcggaatcagccctcaggatatgccccacacattcagaaagtttgcacaccctgaaaacgcaggcaaatggaacagtggcagtggattggggctggccctttccagaaggtatcccaagaaaacattgttttcacatatgcatcatttttccctggatcattttacatatgcatcatttatccctgtgctaacatatgttaactatctcttgccatatcagatttgtcagtctaatggaaggtaacatctggctcgagagcgaaggcgtcgggaagggctgtaccgcgatgttctttgtgaaacttggcatgcctgagaaaccaaatgcaaacctccgaagaatggcgccgcaccctctacagccaaaccaaggagctggaggccctgatgccctcagtatatccataatggacagcaacccgagggttcctcgggttcgctaccaatcaagcgtatgagaagcaccgatgatgccatcgccatgccaaggcagagca

SEQ ID NO: 113 - DNA, 1063 bp, Oryza sativa
  CDS (76)..(879)
cgcaaccgagtcgagactagacaaggggagcagccgccgcgatccaagtcctcctccgccgccgccgacgccgccatggatccgaagctggtggaggtgacgcagctcttctcccgcttcaaggcagccttcgccaggaacgacttcgacacctgcgtagacctgctgtcgcagctcaaggtccgcctcaccaagttccccagccttcctccatcatttcagcagacaccgaatgcagtggaagagctgaaaattgcgagggacatctatgagcatgcagttgttctgagtgtgaaaattgaagaccaagatgcatttgaaagggacttttgtcaactcaaaccttattacatggatacatgcggcataattccaccatcaccacaggagtatccaatcttgggtcttaatcttctaaggctgttagttcagaacagaattgcagagttccacactgagctggaacttctgccggtcacagcacttgaaaatccttgcatcaagcatgcggtggagcttgagcagtcatttatggagggtgcttacaaccgagtgttgagcgctcgccaggctgtgccccacgaaacatatgtgtacttcatggatcttcttgccaaaacagtcagagatgaactggctggttgcagtgagaagggttatgattatatgtcaatagctgaagcaagacaagtgctgatgttcagctctgacaaagaattgcaccagtacatcgcagaggagcaccctgaatgggaggtaaaggatggttccgtcttcttccagaaggcgaaggagacccagccctgcaaggagataccatctttgcaggttatcaaccaaacgctcagctatgctagagagctggagcggattgtatgatttgttaatgaatatcatttgagatcatttgggacggcatgttcatgctatgtacacatcaggtgtcacggttgagatgcgcatgttgcagctttgaacgtttgagatgcccatgttaccttatgatactttttttaaaaatttcatttaatgggcaaaaaaaaaaaaaaaaaaaaaaaaaaaa

SEQ ID NO: 114 - DNA, 1025 bp, Saccharomyces cerevisiae
  CDS (101)..(922)
ttatttgccacccattgaaattgtagcttgtattaatagggaaaagccggaagtataaccggtggaaagtactattgaagtgagataagaagccatcgtaatgccctcgttagccgaattgaccaagtcgttaagcatagcctttgaaaacggcgattatgccgcgtgtgagaagctcttgccccctatcaagatcgaacttatcaagaataaccttttaatacctgacttatccattcaaaatgacatctatttgaatgatttgatgattactaaaaggatcctggaagtaggtgcccttgctagcatccaaactttcaattttgacagcttcgagaattacttcaaccaattgaagccttactactttagcaacaatcataaattatctgaatctgacaagaaatcgaagctgataagtctgtatttgttgaacttattgtctcagaataacacaaccaagtttcactcggaattgcagtatctagataaacatatcaagaacttggaagacgattcacttttgtcttaccctatcaaactagacagatggctcatggaagggtcgtaccagaaagcatgggatcttctgcaatctgggtcgcagaatatatcagaattcgactcttttaccgatatcctaaaatcagctataagagacgaaattgctaaaaataccgagctatcctacgactttctccctctctccaacataaaggctttgctctttttcaacaacgaaaaagaaactgaaaaatttgcactagagagaaactggcctattgtcaactcgaaagtttacttcaataaccaatcaaaggagaaagctgattacgaagatgaaatgatgcatgaagaagaccaaaagacaaacattatcgaaaaagcaatggattatgccataagtattgaaaatattgtgtaatatttgtatatataatatgtgcacaaaattactacaaaataaacaactttttctctcccggagaacaaagtaagtggaaaaaattatactaataacaatc

SEQ ID NO: 115 - DNA, 1199 bp, Zea mays
  CDS (83)..(883)
cgttcccaccgcaagcaaagcattttcagccgccccaccgcagcagcagagaagaggccgccgccgccgcgaccaagagccgatggatccgaagatgacagaggtgacccagatgttcgcccgcttcaaggcggcctacacccgcaacgacctcgacgcctgcgtcaccctcctctcacagctcaaggtccatctcaccaaattccccagccttccgccctcatttgagcagacacctaaagccgtggaggagctcaaacttgcaagggacatttatgagcatgctgttgttttgagtgtgaaacttgaggaccaagatgcatttgaacgtgatttctgtcagctaaagccttattacatggatacatgtggcataattcccccctcaccagaggagtacccaattttgggactcaatcttctgaggctgttggttcagaatagaattgctgagttccatactgagctggagcttttacctgtcaaggcacttgagcacccttgcatcaagcatgctgtagagcttgagcaatccttcatggagggtgcctacaaccgagtgttaagcgctcggcaagctgtgccacatgagacctatgtttacttcatggaccttctcgccaagacagttagagatgagatcgctgggtgcagcgaaaaggggtatgattccctatctgtaagtgatgcaaaacaaatgcttatgttcagttctgaccaagatctgcacgagtacatcacagaggagcacccggaatgggagcttaagaacggtgccgtcttcttccagaaggcaaaggagtcacagccctacaaggagatcccatccttgcagctcatcaaccagacgctcagctatgcgagggagctggagcgtattgtatgatttaatttcacagtaatccctggttgatgtttatttctgtggtcacttggcatggcatgtactgtcctttacatttgagatcagctctgatcgcagctcatgtcagctctgatcaatctctgaagggcttgatctctgcggcattgtttcaccacattaactgcattgcttgaaagatgcctgtcatccattgctgctgttaacttttgatgggcttaatattgaattattacatcgaaaaaaaaaaaaaaaaaaaaaaaaaaaaaaaaaaaaaaaaaaaaaaaaaaaaaaaaaaaaaaaaaaaaaaaaaaaa

SEQ ID NO: 116 - DNA, 1142 bp, Glycine max
  CDS (113)..(913)
ccacgcgtccgatcgctgtggtttttctttttctctgttgaggttgtcattgggagcactcaacctaaactattcaagttgtgaaagcacatcacaagaaaattcgcaagcgatggatccgaagctaaaagaggtttctcagctcttcgatcgctttaaggcttcgtttatcaggaacgactttgatacctgttccaatctcctttctcagctaaaggtgttacttacaggtttcagaagccttccaccgttgtttgcagatacacctaatgcagttcatgaattaacaatagcaagggatatatacgagcatgctgttgtccttagtgtgaaaaatgaggatcaagatgcttttgaaagggatttcttccagttgaagccttattatacagatgcctgcaatcgacttccaccatctcctcaggagtacccaattctgggtctcaacctgttgagattacttgtgcagaataggattgctgaattccatactgagttggaattgctttcatctgctgctcttgagaatccttgcattaagcatgctgtggagttggaacaatcttttatggaaggggcttacaatcgtgtcttgagtgcacgacagacagtgccacatgatacatacgtttattttatggatcttttggcaaagactgtcagagatgaaatagctggttgcagtgagaaggcctatgactatctttcaattaaggatgctaagcaaatgttgctgttctcctctgaccaggaactccttgaatatattaaagaggagcatcctgagtgggagattaagaatggtagtgtctttttccaaaaggcaaaagaatctgcaccttgcaaagaaataccctctctgcagctcatcaaccagacgcttagttatgctagggagttggagaggattgtctgagaagaaatgcaatggcggcttctgttcccaaaatttctaggtgtctggataatagttgctaatactgtcttttgaaattgttcatttctgattcaatgtgaaactataaaattgttcacctctgtattttgatcatttaggtggcagtatggttactttttttttttaacttgtgctctgggttttccaaaaaaaaaaaaaaaaaaaaaaaaaaaaaaaaaaaaag

SEQ ID NO: 117 - DNA, 3041 bp, Zea mays
  CDS (77)..(3001)
gggcactgggcgggggaataaggaggaagagaaagaggaggaggagcggcagtagatttgggccgcacaggcagggatggggggcaagtaccgcgcggcgaggacgaagaggtggtggagggggctggcagcggccgggtgggtgctaaccgcggtggtctgctccgcggtgatgcactggaccctgcgccgggacagcatggaccgcgccgaggagcgcctcgtcagcatgtgcgaggagagggccaggatgctgcaggagcagttcggggtcaccgtcaaccacgtccacgccatcgccattctcatctccaccttcaacttcgagaagtcccctccagccatcgaccaggacacctttgcaaaatacacggcaaggacatcatttgagcgaccgctgctcaatggggtggcattcgcacagcgtgtattccatcatgagagggaaatgtttgaaagccagcagggatgggttatgaatacgatgcagcgggagcctgcacctccgcaggttgaatacgccccagtgattttctctcaggatacggtttcctaccttgcacgcattgacatgatgtctggggaggaggaccgagaaaacattttccgggccaggactactggcaaagctgtgttaacaaacccatttcggttgcttggatcaaaccacttgggagtagttctcacgtttgctgtgtaccgccctgatctccctgctgatgcatcagttgagcaacgtgtggaagcaactatcggatatctcggtggagcctttgatgtggagtcacttgtggagaatttgttgagcaaacttgctggcaatcaggatattgtggtaaatgtctatgatgtcacaaatgcttcagatgctatggttttgtatggaccttcaagtttggacgagcaagtgcctttcttgcatgttagcatgttggattttggagatccatttaggaagcatgaaatgagatgcaggtatagacaaaagcttcctatgccgtggtctgccataaccaatcctttgggcacatttgtcatatggatgcttcttgggtatagcattgctgctgcatattctcgatatgacaaagttactgaagattgcagaaagatggaagagctaaaaacgcaggcagaagctgctgatgttgcaaaatctcagttcctggcaactgcgtcacatgagatcagaacacctatgaatggcgtccttggaatgctggatatgcttttaggaacagatctaactatgacacagaaggattatgctcaaactgctcaaatgtgtggcagagcattgattacactgataaatgatgtccttgatcgagcaaagattgaggctggaaagttagagcttgaagcggtgccttttgacctgcgttctctcatggatgatgttgtttccttgttttcttcaaagtcacgggagaagtgcattgagcttgccgtatttgtatgtgacaatgttccgaaggttgttattggagatccttggaggtttcgacagatactgacaaatttggtcgggaatgcagtcaaattcacagaacgaggtcatgtatttgtgcgggtgtgtttggctgaaaactcaaatatggaagccaatcaggtcctacatggagccatgaatggcaaaggtggtagagttgagtcaacagctaatggtgccttcaatactttgagtgggtttgaagcagcagacagacgaaatagttggcaatattttaaactgctcctctctgataaggagtcgcttttggatgatcttgagagcgaaaactctaatcaaagtgattcagatcgtgtcacactagcaataagtattgaggacacaggtgtcgggataccactgcaagcacaagatcgtgtttttacaccgtttatgcaggctgacagttcaacttcaaggaattatggcggtactggcatcggtttaagcatcagcaagtgtctagctgaacttatgggtgggcagataagtttcaccagccatccttctgttggaagcacgttcactttctcagccacactgaagcactcacacaaagatatttcgggtgattcaagtaggagcttgacagaggcactaccaaccgcttttaagggaatgaaggccatcttggtagatgggagacctgtacgtagtgctgttacaagatatcacctcaagaggttgggaatacttcttcaagttgtgaacaatatgaacgcagtagtaaaagctttcccaggacaaaatggagcagccggttctagggaaaaggcatcaattctttttattgagagtgacttctggaggcctgagacagatgttcagttattgaaccatctacgtgagcagaagaacggtcagttgtctgatgggcacaaggtagttcttttggtcacctctgaagccgacaaggacaaatatggatccatatttgatattgtgatgtgtaagcctataagggcaagcacaattgcttcatctattcaacaactgctcaaagtagagatagccgaaagaaaagataatcaaaaccggccgtcgttccttcgaagcttgctggttgggaagaatatattggtcgtagacgataataaagtcaacctcagagttgctgcggctgcactcaagaagtatggtgctaatgttagctgtgttgaaagcggcaaggatgctatcagtctacttcaacccccgcatcgcttcgatgcatgttttatggatgttcagatgccagagatggacgggtttgaggcaaccggacaaataaggcaaatggagttgaaagcgaacgaggaaaggaagaacaagttggcttcgatcgaaggctcgacaactgccgagtaccatctgcctgttctggcaatgacagccgatgttatccaggcaacttacgaagagtgcataaaatcgggaatggatggatacgtatctaaacccttcgacgaggagcagctataccaagcagtctccagattggtagtgggaacgacagattcggctgtttgatgttcaaaatacgatggaccggacttctcattcatcaatc

SEQ ID NO: 118 - DNA, 3694 bp, Arabidopsis thaliana
  CDS (69)..(3311)
  unsure (1)..(3694): unsure at all n locations
aaaaaatctcactaaaacaaaagaagaagaaagaagaaagaaaatggaatacctacatttttgaagtgatgagaagagattttgtgtataataataatgcaatgttcaatcctctcacaactcattacagctcagatatgaactgggcactcaacaatcatcaagaagaagaagaagagccacgaagaattgaaatttctgattccgagtcactagaaaacttgaaaagcagcgatttttatcaactgggtggtggtggtgctctgaattcgtcagaaaagccgagaaagatcgatttttggcgttcggggttgatgggttttgcgaagatgcagcagcagcaacagcttcagcattcagtggcggtgaagatgaacaataataataataacgatctaatgggtaataaaaaagggtcaactttcatacaagaacatcgagcattgttaccaaaagctttgattctgtggatcatcattgttgggtttataagcagtgggatttatcagtggatggatgatgctaataagattagaagggaagaggttttggtcagcatgtgtgatcaaagagctagaatgttgcaggatcaatttagtgttagtgttaatcatgttcatgctttggctattctcgtctccacttttcattaccacaagaacccttctgcaattgatcaggagacatttgcggagtacacggcaagaacagcatttgagagaccgttgctaagtggagtggcttatgctgaaaaagttgtgaattttgagagggagatgtttgagcggcagcacaattgggttataaagacaatggatagaggagagccttcaccggttagggatgagtatgctcctgttatattctctcaagatagtgtctcttaccttgagtcactcgatatgatgtcaggcgaggaggatcgtgagaatattttgcgagctagagaaaccggaaaagctgtcttgactagcccttttaggttgttggaaactcaccatctcggagttgtgttgacattccctgtctacaagtcttctcttcctgaaaatccgactgtcgaagagcgtattgcagccactgcagggtaccttggtggtgcgtttgatgtggagtctctagtcgagaatttacttggtcagcttgctggtaaccaagcaatagttgtgcatgtgtatgatatcaccaatgcatcagatccacttgtcatgtatggtaatcaagatgaagaagccgacagatctctctctcatgagagcaagctcgattttggagaccccttcaggaaacataagatgatatgcaggtaccaccaaaaggcaccaataccattgaatgtgctcacaactgtgccattgttctttgcgattggtttcttggtgggttatatactgtatggtgcagctatgcacatagtaaaagtcgaagatgatttccatgaaatgcaagagcttaaagtgcgagcagaagctgctgatgtcgctaaatcgcagtttcttgctaccgtgtctcacgagatcaggacaccaatgaatggcattctcggaatgcttgctatgctcctagatacagaactaagctcgacacagagagattacgctcaaaccgctcaagtatgtggtaaagctttgattgcattgataaatgaggttcttgatcgcgccaagattgaagctggaaagctggagttggaatcagtaccatttgatatccgttcaatattggatgatgtcctttctctattctctgaggagtcaaggaacaaaggcattgagctcgcggttttcgtttcagacaaagtaccagagatagtcaaaggagattcagggagatttagacagataatcataaaccttgttggaaattcggttaaattcacagagaaaggacatatctttgttaaagtccatcttgcggaacaatcaaaagatgaatctgaaccgaaaaatgcattgaatggtggagtgtctgaagaaatgatcgttgtttccaaacagtcaagttacaacacattgagcggttacgaagctgctgatggtcggaatagctgggattcattcaagcatttggtctctgaggagcagtcattatcggagtttgatatttctagcaatgttaggcttatggtttcaatcgaagacacgggtattggaatccctttagttgcacaaggccgtgtgtttatgccgtttatgcaagcagatagctcgacttcaagaaactatggaggtactggtattggtttgagtataagcaagtgtcttgttgaacttatgcgtggtcagataaatttcataagccggcctcatattggaagcacgttctggttcacggctgttttagagaaatgcgataaatgcagtgcgattaaccatatgaagaaacctaatgtggaacacttgccttctacttttaaaggaatgaaagctatagttgttgatgctaagcctgttagagctgctgtgactagataccatatgaaaagactcggaatcaatgttgatgtcgtgacaagtctcaaaaccgctgttgttgcagctgctgcgtttgaaagaaacggttctcctctcccaacaaaaccgcaacttgatatgatcttagtagagaaagattcatggatttcaactgaagataatgactcagagattcgtttattgaattcaagaaccaacggaaacgttcatcacaagtctccgaaactagctctattcgcaacaaacatcacaaattcggagttcgacagagctaaatccgcaggatttgcagatacggtaataatgaaaccgttaagagcaagcatgattggggcgtgtctgcaacaagttctcgagctgagaaaaacaagacaacaacatccagaaggatcatcacccgcaactctcaagagcttgcttacagggaagaagattcttgtggttgatgataatatagttaacaggagagtagctgcaggagctctcaagaaatttggagcagaagtggtttgtgcagagagtggtcaagttgctttgggtttgcttcagattccacacactttcgatgcttgcttcatggatattcaaatgccacagatggacggatttgaagcaactcgtcagataagaatgatggagaaggaagctaaagagaagacgaatctcgaatggcatttaccgattctagcgatgactgcggatgtgatacacgcgacctacgaggaatgtctgaaaagtgggatggatggttacgtctccaaaccttttgaagaagagaatctctataaatccgttgccaaatcattcaaacctaatcctatctcaccttcgtcgtaatccaatcttccggcgagtttttttctctccgcagccggaagaatggactgcttctgctgattgattgggataaatatgcattttggtttctgtacatatagtaggttcacaatctagagattttgaaggttttttttaatttctcacttaagtaatgtagcttgccatgactagtgtatgttgttaaacgacgacgtctaagatggttcagtgttgatcttagcgtaagtattaatcccatgggaatcggttgtactgtatcagatttggttagtcgtttaancattgtaatgttctaataatcactttttcatatatancctcatgttataacatgagacgagaccattttgattaaaaaaaaaaaaaaaaaaaaaaaaaaa

SEQ ID NO: 119 - DNA, 3531 bp, Arabidopsis thaliana
  CDS (1)..(3531)
atgtctataacttgtgagctcttgaatcttacttcaaagaaagctaagaagtcgtcgagcagtgacaagaaatggctaaagaagcctctcttcttcctgattttgtgtggctctttggtaattgttttggttatgttcttacggttaggtagaagtcagaaggaggagacagattcttgtaatggagaagagaaagtgttgtatagacatcaaaatgtcacaagaagtgagattcatgatttggtctctttgttctctgattcagatcaggtaacatcctttgaatgtcataaggaatcaagccctggaatgtggacaaactatggtattacatgttccctgagtgtgcgttctgataaacaagagactagagggcttccctggaatcttggcttaggacattctatctcatcaacatcttgtatgtgtggtaatcttgaaccgattttacagcaacctgaaaaccttgaggaagaaaaccatgaagaagggctggagcagggtttgtcatcgtatttaagaaatgcatggtggtgtctaatccttggtgtgttagtgtgccataagatttatgtatctcattctaaagcacgaggtgagaggaaagagaaagtacatctgcaagaggctttagctccaaagaagcagcaacaacgtgctcagacttcttctagaggggctggaagatggaggaagaatatccttctccttggtattttaggaggagtttccttctctgtttggtggttttgggacactaatgaggagatcataatgaaaaggagggagactttggcaaacatgtgtgacgaacgagcacgtgttttacaagatcagttcaatgttagcttgaaccatgttcatgccttgtctattcttgtatctacatttcatcatggtaaaatcccatctgccattgatcagagaacatttgaagaatatactgagagaacaaactttgagaggccacttactagtggtgtagcgtatgctttgaaagtcccacactcagaaagagagaaatttgaaaaggagcatggatgggcaataaagaaaatggaaactgaggaccagacagttgtacaagattgtgttcctgaaaactttgatcccgcaccgattcaagacgaatacgcgccagttatatttgctcaagaaactgtttcccatattgtatcggtcgacatgatgtctggagaagaagaccgtgaaaacatcttacgggcaagggcatcaggaaaaggagtgttaacatctccatttaagcttcttaagtcaaatcatcttggtgttgtgttgacctttgctgtctatgacacgagcctaccgcctgatgctacagaagaacagcgtgttgaagcaactattgggtaccttggtgcatcatatgatatgccatcgctggtggagaaacttcttcaccaacttgccagcaaacagacaattgctgtggatgtttacgacacaactaacacttcaggtctaataaaaatgtatggctcagaaattggggatataagtgagcagcatataagtagccttgattttggtgatccatcaaggaaccatgagatgcattgcaggtttaagcataaacttcccattccctggacagcgataacaccgtcgatcttagttctggttattacttttcttgttggttatattttatatgaagccatcaaccgaattgcgacagttgaagaggattgtcagaagatgagggaactcaaagctcgtgctgaggccgctgacattgcaaagtcacagttcctagcaactgtttctcatgagatacggactccgatgaatggagttttaggaatgctgaaaatgctgatggacaccgatcttgatgcgaagcagatggactatgcgcaaactgctcatggcagtgggaaggatcttacatcactaataaatgaggttcttgatcaggcaaagattgaatccggaaggctcgagcttgaaaatgtgccttttgatatgcgttttattcttgataatgtttcatctctcctctctggcaaggcaaatgaaaaaggaattgagttggccgtttatgtttctagtcaagttcctgatgttgtagtcggtgatccgagtcggttccggcagatcattacaaacctggttggaaactcaatcaaattcacacaggaaaggggacacatatttatctcagtgcaccttgcagatgaggtaaaggagcctcttactattgaagacgcagtgctaaaacagcgactagctttaggatgcagcgagtccggtgagacagttagcgggtttcctgcggtaaatgcatggggaagctggaagaatttcaagacatgttacagtactgagagtcagaattctgatcaaatcaaattgctagttacagtggaggacactggagttggcatacctgtggatgcacaaggccgaatcttcacaccttttatgcaagccgacagttccacatcgcggacttatggtggaactggcataggtttgagtataagcaaacgtttggttgaactcatgcaaggagagatggggtttgtgagtgagcccgggataggcagtactttttcatttactggagttttcgggaaagcagaaacaaatacgtcgattactaagctggaacgattcgatctagctattcaggagtttacaggattgagagcattagttattgataacagaaacattagagcagaggtcaccaggtacgaacttcggagactgggaatatctgcagacattgtttcaagtctgagaatggcatgcacttgttgtatcagcaaattagaaaatttggctatgattctaatagacaaagacgcctggaacaaggaagaattttcagtacttgacgagttgtttacccgaagcaaagtaacctttacaagagtcccaaagatttttcttttggcaacttctgcaactcttactgagcgcagtgagatgaagtctactggtctcatcgatgaggtggtgataaagcctcttcggatgagtgtcttaatatgttgcttgcaagaaacccttgtcaatggcaagaagaggcaaccgaacagacagcgaagaaatcttggacacttgctaagagaaaaacagattctggttgtggatgataatcttgtgaacagacgagttgcagaaggtgcacttaagaaatatggagctattgttacatgcgttgagagtggcaaagctgcattggcaatgcttaagccgcctcataacttcgatgcttgcttcatggatctccagatgcctgaaatggatggatttgaagcgacaaggagagtccgtgagctggagagggaaatcaataagaaaatagcttctggagaagtttcagctgaaatgttctgtaaatttagtagttggcacgtcccgatattagcaatgacagcagatgttattcaggctactcatgaagaatgcatgaaatgtggaatggatggttatgtatcaaaaccgtttgaagaggaagtgctctacacagcggtagcaagattctttgaaccttgttaa

SEQ ID NO: 120 - DNA, 3111 bp, Arabidopsis thaliana
  CDS (1)..(3111)
atgagtctgttccatgtgctagggtttggtgtcaagattgggcatctcttctggatgctatgctgctggtttgtttcttggttcgttgataatgggatcgaggacaagtctggtcttttagttggctctgtcggtgatcttgagaagactaagatgactacgttgaagaagaagaacaagatgtggttctggaataagatctctagcagcggactcaagatcccgagtttctcttatcagtttcttggctctgttaaattcaacaaggcgtggtggaggaagcttgtggtggtttgggttgtcttctgggtcttggtctctatttggacgttttggtactttagctcgcaagctatggagaagaggaaagagacgctagctagtatgtgtgatgagagagctcgtatgctgcaggatcagttcaacgttagcatgaatcatgttcaagccatgtctatcttgatctcaaccttccaccatggcaagattccttctgctatcgatcagagaacattctcagagtacactgatagaacttcctttgagaggcctcttactagcggggtagcttatgctatgagggtgctccattcagagagggaagagttcgagaggcaacaaggttggactattaggaagatgtattctcttgaacaaaacccagttcacaaggatgactatgacctggaagctttggaaccatcccctgtccaagaagagtacgctccagtcatctttgctcaggacactgtttctcacgttgtttctctcgatatgctgtctgggaaagaagatcgtgaaaacgttttgcgggccaggagttcaggtaaaggggttttgacagctcctttcccattgataaagacaaatagacttggggtgatcctgacatttgcagtgtacaagagagatctcccctccaatgcaacgccaaaagagagaattgaggctactaacgggtatctcgggggagtgtttgacattgagtccctggtagaaaacttgcttcaacagctggctagcaagcaaacgattcttgtcaatgtgtacgatatcaccaatcactctcaaccgattagcatgtatggtacaaatgtgtcggctgatgggttggaacgtgttagtccactaatctttggcgatccattgagaaagcatgagatgcgttgcagatttaagcagaaaccaccatggccagtgctatcaatggtgacatcattcggtatccttgtgattgcgttacttgttgcacatataatccacgcaaccgttagtcgaatacacaaagttgaagaagattgtgataaaatgaagcagctcaagaaaaaggctgaagcagcagatgttgcaaagtcacagttccttgccactgtttcacatgaaatcagaactccaatgaatggtgttctaggaatgttgcatatgcttatggacacagagttagatgttacgcaacaggattatgttaggaccgcacaggcaagtggaaaagctttagtctcgctaataaatgaggttttggaccaagcaaagattgaatctggaaagcttgaacttgaggaggtgcggtttgatttgagaggaatattagatgatgtcctgtcactcttctctagcaagtcccaacaaaagggggtggagttggcagtatacatatctgatcgtgttccagatatgttaattggtgatcctgggaggtttcgacaaatactcacaaatcttatgggtaattccattaagttcactgagaaaggacacatctttgtaactgttcatttggtggatgagctatttgaatctatcgatggagagacagcatcatctccggaaagtacactgagtgggcttccagttgcagaccggcagaggagctgggaaaactttaaagctttcagctccaacgggcatcggagctttgaaccatctccccctgatataaacctaatcgtctcagttgaggatactggcgtagggatccctgtagaagcgcagtcccgtatttttacgcctttcatgcaagtcggaccatccatatccaggacgcatggaggcacaggaattggacttagcataagcaaatgtctagttggactgatgaagggagaaattggattctcgagtactcccaaggttgggtccacattcacatttactgctgtattttccaatgggatgcaaccagctgaaagaaagaatgacaacaaccagcccatattctcggaattccggggcatgaaagctgtggttgtggaccataggcctgcaagggcaaaagtctcgtggtaccattttcagcgtcttggaattcgagtcgaagtagttccacgtgttgaacaggctctacattatctgaagattggtactaccactgtgaatatgatactcatagagcaagaaatatggaatagggaagcagatgatttcattaaaaagctacagaaagaccctcttttcctttctcctaagttgattttgttagcaaactcagtagaatcgtcaatatcagaggctttatgcaccggtatagatcctccaatagtgatagtgaaaccattgagggcgagtatgctagcagcaactttgcagaggggattgggtattggaatcagagaaccacctcaacacaagggacctcctgctttgattctcaggaatcttctccttggtagaaaaattttaatcgtggatgataacaacgtaaacctcagagtggcagcgggagctctgaaaaagtacggagctgatgtggtctgcgctgagagtgggataaaggcaatctcattgcttaagccacctcacgagtttgatgcttgcttcatggacattcagatgccagaaatggatggatttgaagctacaaggagaatacgagatatggaagaggagatgaacaagagaataaagaatggggaggctttgatagtagagaacggtaacaaaacaagctggcatcttccggtattagcaatgacggcagatgtgatccaagcaacgcatgaggaatgtctgaagtgtggaatggatgggtatgtatcaaaaccatttgaagcagagcagctgtacagggaagtttctcgctttttcaattcgccttcagatacagaatcataa

SEQ ID NO: 121 - DNA, 3442 bp, Zea mays
  CDS (201)..(3239)
  unsure (1)..(3442): unsure at all n locations
actcgtcgacgcgacgctgctcgcaagagaaaaaaagctcccaaatacctccaccaccaccaccaccaaagctgcgacgaacacgaacggcacaagcacaagagaaagagagagagagagagagagagagagagagagaggggagggagagaggccttctcttctctgctgcggcggcggcgcatgtgaattggggtgggatgggtgtgggaggaggcggaggaggaggaggaggggaggcggcggcggcggtggcggtggagggggatgaggcggggaaggggaggaggtggtggagggtgaaggtgaagctgagcacggtggcggtggtggcgtgggtgctggcgtcggcggcgctctgggcggggctgcactggcgcttccgccgcgcggcgctgcacaaggccgaggaggccctcgtctgcatgtgcgaggagcgcgcccgcatgctgcaggaccagttcgccgtctccgtcaaccacgtccacgccctcgccatcctcgtcgccaccttccactacgacaagcaccctcccgccctcgaccaggacacgttcgccgtgtacgccgcgaggacgtccttcgagcggccgctgctgagcggcgtggcgtacgcgcagcgggtggtgcacgccgacagggagagcttcgagcggcagcaggggtggatcatcaagaccatgaagcacgagccgtccccggcgcaggacgagtacgccccggtgatctactcccaggagaccatctcctacatcgagggcctcgacgtcatgtccggcgaggaggacagggagaacatcttgagggcgagggcgacagggaaggccgtcctcacgaggccgttccggctgatgtcgaatcacttgggtgttgtcttgacgtttcctgtctacctcgtcgatctcccaaatgataccgcggtggaggatcgtgttgctgctactgcaggataccttggaggagcatttgatgtggagtcactagtagaaaatttgttgagacagttagctggtaaccaggaattggtggtcaatgtttatgatgtcacaaaccactcaaaccctcttgtgatgtatggatctgaggttcctcttggtattccctcaccatcacacacctatacgttggattttggtgatccattgagaaagcatcagatggtttgcagatacagaaacaagcttcatgtttcatggtctgcaattactacaccatcaggggtctttgttatatgtatgctggtgggctacataatatatgctgcttggagtcgctacgataatgttaaggaagattgccggaaaatggaagcgctgaaaaaacgggcagaagcggctgatattgctaaatctcagttccttgcaactgtttctcatgagatcagaacacccatgaatggcgtgctgggaatgcttgatatgttattagacacagagctgaagtcaacccagagggattatgcacaaacagcccaagtctgtggaaaggcattaatatccctgattaacgaagtgcttgacagggccaaaatcgaggctggcaagatagatctcgagtcagtaccatttgacctgaggtccatccttgatgatgtcatctcgttattttcttcaaaatcaagagagaaaggaattgagcttgctgtatatgtttctgaaagagttcctgaaatcctgttgggcgaccctggaaggtttcgtcagataattacaaacttggtgggaaactcgatcaagataacaatatttaccttgtcgcagttcacagaacgggggcacatttttgtacaagttcacctggcagatcactcaaatcttgcaacagaagcaaaaattgaaccagtagtcaatgggatgaatggacataaagacgaggctattgctatacccaccagtgggtctcataacactttaagtggttttgaagcagctgatagccgaaataactgggaaaacttcaagcttttgctctcttacgagaaaaatgaaatgccatatgaaagtgattctgataaagtaactcttgttgttagtgtggaagatactgggataggcataccactgcatgcccaaggccgggtcttcacgcctttcatgcaagctgacagctcaacttctaggaactatggtggaactggcattggattgagcatcagcaaatgtcttgttgaaataatgggtggtcagataaactttgtcagccgacctcttgttgggagcacattcacattcactgctgttctgagaaggtgtgacaaaaatgctattagtgacagtaagactgttgctttgcacccattaccgtccagttttaaaggcttatctgcgctattggttgataaaagacctgtaagagcaactgtgactaagtatcatttgcaaaggcttggaatcacttctgaagttgttggtaccattgatccgacatttggtgtgttgtctgggagaaatggcagttctctaaccagcattggtaagaagcagccatgcatgttgctaatcgagagtgattcctggggaccacagatggatgtctccttacatgctagacttcaggagatgaaacagagtgatcgcatacatgtattgcccaaggttttccttctttctgctgcagaatcagacaaagtaaagaagatacatgcagttgattctgtgataccaaagcctctgaaagcaagtgcacttgcggcctgtctgttccaagcacttggtatcacacagccgagccatgagaaacgtgacgattcaggttctcttcatgggcgtgatggttcaggttctcttcatgggttgcttcttggcaagaacatattggtagttgatgacaacaaggtaaacctcagagtggccgctggtacattgaagaaatatggggcaaaggtggagtgtgtggagagtggaaaagatgctctttcccttctacaagtgccgcacaagtttgatctgtgtctcatggacattcagatgccgnagatggatggatttgaggcaactcggcaaatacgagcaatggaagggaaggcaaatgagcaggcagacgacagcgaatcgggttcagaaatcgcagcaaagacggccaaatggcacttgccaatcctggcaatgaccgctgatgtcatccaggccacccacgaggaatgcacaaagtgcgggatggatggctacgtctcgaagccctttgaggagaagcagctcttccaggcagtacagaagttcttgggcccatgcgtttccagctgacaccaaccgatgcattctgctgtacaccaagagagtaaagaatgagcactgactgtgaactgaggcggctaaaattcttctccattttgttgctcttcaacagaggatgcgatctgaatgagagcctgcactcaaggcgacattgcacagaaaggatcggagccttcattgtgtacatgtatttttatcggcagagacca

SEQ ID NO: 122 - DNA, 1794 bp, Zea mays
  CDS (122)..(1594)
ggcagccagcaggggaggaggacacgaatcgtagtcggcctcccgcccgccccggcaattgttgttgctgctgcgcgcagggcggttctggattgcggtctgccccacccacgaacaatccatggctccatctccgcctcggcgtgctgcgctcctcctcaccactgtgcttctgctggcggcggccgggtccacccccggcgccacggctgctggcatcttccaggtgcgccgcaagttcaccgccggggtgggagggggtgctggcgccaacatcagcgcccttcgcgcccacgacggcacccgtcacggccgcctcctcgcagccgccgacctccctcttggcggcctcggcctccccactgacactggcctctattacacggagatcaagctcgggacgccacccaagcactactacgtccaggtcgacaccggcagcgacatcctctgggtcaactgcatcacctgcgagcaatgcccccacaagagcgggctcgggttagacttgacgctttacgaccccaaggcatcctcgaccgggagcatggtgatgtgcgatcaggcattctgtgcagccacctttggcggaaagctgccgaagtgcggcgccaatgtgccctgcgaatatagtgtcacctacggtgatggtagctcgacgataggttcctttgtcaccgatgcgctgcagtttgatcaggtgactagggatgggcagacacagccggctaatgccagcgtcattttcgggtgtggtgctcaacaaggtggggatttgggaagttcaaaccaagcccttgatggaattcttggttttggtgaggcaaatacatcaatgctatcacaactaactaccgctggtaaagtgaagaagatatttgcccattgtttggataccataaaaggaggtggaattttttctattggagatgtggtgcagccaaaagtaaaaacaacgccattggtagccgacaagccacactacaatgtgaaccttaagacaatcgatgttggtggcactactctacaactcccagctcatatttttgaaccaggagaaaaaaagggtaccataatcgacagtggtaccaccttgacataccttccagaattggttttcaaagaagtaatgctcgcggtatttaacaagcatcaggatataaccttccatgatgttcaaggttttttgtgtttccaatatcctggaagtgtagatgatggattcccaaccatcacattccattttgaggatgatcttgcactacatgtgtatccccacgagtactttttcgcaaatgggaatgacgtatactgcgtgggattccaaaatggtgcatcacagtcaaaggatggaaaggacattgtgcttatgggagatcttgtcctttccaacaagttggttatctatgacttggaaaatcgagtcattgggtggactgactacaactgttcgtcgagcattaaaattaaggacgacaaaacgggcgcaacatctactgtcaattcacatgacttgtcctcaggatggaagttccactggcacatgtccccggttctattgttggtaacaacggtgtgcagttatttaatatgctaactccactgtaaaggaaatccatctggttcgtatatcctttccacgaaaaggatcggagagatgtagggctttctttaggttgtgttctcccaccacggaaaacaatggaaacagaaaacactgtaatgctttactgagccattgtttaactaggtaatgctgaggtgaggtaatgttctgtcatttctttgggaaaa

SEQ ID NO: 123 - DNA, 1937 bp, Zea mays
  CDS (76)..(1605)
gctcctctcccaccaccgcccccgccgtcgcctgctgttccatgaaggactaatccgtcggtccacttctcagctatggcgcagctcgcggtgcggtcgctgctgctgtccctgctcctggtctcgccagttgtggcttcacctggtattgtgaagctcaactcgtcgtcgaccctcttcggcatcgagttcccgccgttcaacaccgccgtcgccgcgaccggctgcgacagcaagctggttgcagccgacgaggcgggggatgagcagaagcagccggcgagctcgtccccgtcgctgcagctgcgcatgaagcaccggtccgcggaggggggcaggacacggaaagagtcgttcttagataaggccgagaaggatgccgtccgcatcgagacgatgcaccggagggcggcgcgctccggcgtggcccggatgccggcgtcttcgtctccgcggcgggcgctgtcggagcggatggttgcgacggtggagtccggcgtggcggtcgggtccggcgagtacctgatcgacgtctacgtcggcacgccaccgcggcgtttccggatgatcatggacaccggcagcgacctcaactggctgcagtgcgcgccgtgcctggactgcttcgagcagcgtggcccggtgttcgaccccgccgcgtcctcctcctaccgcaacgtcacctgcggcgaccagcgctgcggcctcgtggcgccgcccgaggcgccgagggcgtgccgccgccccgcggaggactcctgtccgtactactactggtacggggaccagtccaacactaccggcgacctggccctggagtccttcacggtcaacctcacggccccgggcgcgtcccgccgtgtggacggcgtagtgttcgggtgcgggcaccgaaaccgcggcctcttccacggcgcggcggggctgctggggctcggccggggcccgctgtcgttcgcgtcccagctccgcgccgtgtacgggcacaccttctcgtactgcctggtggagcacggcagcgacgccggcagcaaggtggtgttcggggaggactacttggtgctggcgcatccgcagctcaagtacacggcgttcgcgcccacgtcgtcgccggcggacacattctattacgtgaagctcaagggcgtgctggtgggcggcgacctgctgaacatcagctcggacacgtgggacgtgggcaaggacgggtccggcggcacgatcatcgactccggcacgacgctgagctacttcgtggagccggcgtaccaggtgatccggcaagcgttcgtcgatctcatgagcaggctgtaccctctgatcccggacttcccggtgctgaacccgtgctacaacgtctctggcgtggagcgaccggaggtgccggagctgtcgctgctgttcgccgacggtgccgtgtgggacttccccgcggagaactacttcgtccggctggacccggacggcatcatgtgcctggcggtccggggcaccccgcgcaccggcatgtccatcatcggtaacttccagcagcagaacttccacgtcgtgtacgacctgcagaacaaccggctgggcttcgcgccgcggcggtgcgccgaggtgtagtgtatagccgccggcgaggcctcctgagactgagaggacgaacaattcgaactcagtcctcgcttgattgattggattgggaggcaaattgggtgtagaaatttttggttgggaaggacggtggcacgtacgcaagctctaatacatagttttttttgttgcatttatctccaaggagagaaggttagggatattttattaaggaccgtgcaggtgggttgtaacgggaaaatactgattttgttcccatgtacaatacccgtttcttcactcaaattttagaaattgtaagttgtagattaagaatgagagtgcacacaaaaaaaaaa

SEQ ID NO: 124 - DNA, 1830 bp, Zea mays
  CDS (195)..(1628)
attcggctcgagcgccaaacggaccaagaatttccacgcagatttcaacagagatgatgggctcgcccgccggtgctggtgcactcgcccatgtctcgcgcgtcgcaccgccgaggacggcgccccgattcgtcctccttatttaggcaccgtcttttgtcccccccatccgttccgagccgaaccaaggcgccatgagctccccggccgtgcgccgcgtcgtactcctctcgtcactcctctgcgccggagcgctcggtttcttgccctgctcccatgccgccgcggtggcgcccggctacgtcgccgtctccgccgccagcttcgtgccgtcctcaacgtgcagctcccccgaccgagttccgccgcaccggcggaacggcacgtccgccgtgctgcggctgacgcacaggcacgggccgtgcgccccctcgcgggcgtcctcgctagcggccccgtcggtggctgacacgctgcgcgcggaccagcgccgggcggagtacatactgaggagggtgtcggggcgcgcgcctcagctgtgggactccaaggcggcggcggcggtggcgacggtgccggcgagctgggggtacgacatcggcacgctcaactacgtggtgacggcgagcctcggcacgccgggcgtggcgcagaccatggaggtggacaccggcagcgacctgtcgtgggtgcagtgcaagccgtgcgccgcggcgccgtcgtgctacagccagaaggacccgctcttcgaccccgcccagtcgtcgtcctacgccgccgtgccgtgcgggggccccgtgtgcgcggggctgggcatctacgccgcgtccgcctgctcggcggcgcagtgcgggtacgtggtcagctacggcgacgggtccaacaccacgggcgtgtacagctccgacacgctgaccctgtcggcgagcagcgcggtgcagggcttcttcttcggctgcgggcacgcgcagagcgggctgttcaacggcgtcgacgggctcctgggcctcggccgcgagcagccgtcgctcgtggagcagacggcgggcacctacggcggggtcttctcctactgcctcccgacgaagccgtccaccgcggggtacctcacgctgggcgtgggcgggccgtcgggcgccgcgccgggcttctccacgacgcagctgctgccgtcgccgaacgcgccgacctactacgtcgtcatgctgacggggatcagcgtcggcgggcagcagctcagcgtgcccgcgtcggcgttcgcgggcgggacggtggtggacaccggcacggtcgtcacccgcttgcccccgaccgcgtacgcggcgctgcggtccgcgttccgcagcggcatggcctcgtacgggtacccgacagcgccgtcgaacgggatcctggacacctgctacaacttcgccgggtacggcaccgtgacgctcccgaacgtggcgctcaccttcggcagcggcgcgaccgtcacgctgggcgccgacgggatcctgtcgttcgggtgcctcgcgttcgcacccagcggcagtgacggtggcatggccatcctcggcaacgtgcagcagcgctcgttcgaggtgcgcatcgacggcacctccgttggcttcaaacccagctcctgctaactcatggattaacagtcggcgacttgggatcactactagtagtagtatatgcacgtacgtagacgagagtgcagagatacatacaaagttactgtacatgatgatagtaaagataaacttgcaggagagcgtataccatacacagcacacagcagtagcggtggaagttctttcgttggtggaaaaaaaaaaaaaaagg

SEQ ID NO: 125 - DNA, 1716 bp, Zea mays
  CDS (42)..(1424)
ctgacatctcagttgctgaacgcctgaaccgcaagtcatccatgacctcttctattccgaagctgcttctcctcctcttctttctcagccatcgctctcccattgctcgcgcaggcgatgatggcagctacaaggttctgtccatgggctctccgagaactgactccgtctgttcccagtccaaagcggttccttcgtcgtccgccggtgccgccacggtgcccttgcatcaccgtcacggcccatgctcgccgttgccgaccaagaagatgccgacgttggaggagacgctccaccgcgatcagctccgagctgcctacatccagcggaagttctcaggcggcggtggcgctggtggtgacgtccagcgatcggacgccaccgtgccgacggccctgggcacctccctgaacacgctggagtacctgatcaccgtaggcctgggctcgccggccacgtcccagaccatgctcatcgacaccggcagcgacgtgtcgtgggtgcagtgcaagccgtgctcgcagtgccactcccaggcggacccactcttcgaccccagctcgtcgagcacgtactccccgttctcctgcggctccgccgactgcgcgcagctcggccaggaaggcaacggctgctcctccagctcccagtgccagtacattgtcacgtacggcgacggctccagcaccacggggacctacagctccgacacgctcgccctgggctccagcgccgtcaggagcttccagttcgggtgcagcaacgtggagtcgggcttcaacgaccagaccgacgggctcatggggctcggcggcggcgcgcagtcgctggtgtcacagacggcggggacgctcggcagggccttctcgtactgcctcccgccgacaccgagctcctccgggttcctcacgctcggcgctgctggcggtagcggaacctcgggcttcgtcaagacgccgatgctcaggagcagccaggtccccacgttctacggcgtgcgcctccaggccatcagggtgggcgggaggcagctcagcatacccgcctcggtcttctccgctgggacggtcatggactcgggcacggtcatcacgcggctgccgccgaccgcctactcggcgctgtcgtcggcgttcaaggccgggatgaagcagtacccgccggcgcagccgagcggcatcctcgacacctgctttgacttcagcggccagtccagcgtcagcataccgtccgtcgcgctagtcttctccgggggcgccgttgtcagcctcgacgccagcggcatcatcctcagcaactgcctcgccttcgcgggcaacagcgacgacagctccttgggcatcatcggcaacgtgcagcagcggacgttcgaggtgctgtacgacgttggccggggcgtcgtggggttcagggctggggcgtgctgatcgatcgtgatcggcgcaaggacattgacaataccggccgggagtacgtactgtgctcgtttgggttgcgagtgcaacgtaaatggaagaagtgcaaaacatatacatactacttcgattttaattatctttgcgatagcatgcaataacgtcatgcatgcaagtgtgcaaactactaaaagctaaaagataatcttaatgtcacctgattgatgactataaaagattaatgatatattattgtattgcgcttggtgcgatgattaattaaaaaaaaaaaaaaaaaaaa

SEQ ID NO: 126 - DNA, 1735 bp, Oryza sativa
  CDS (37)..(1443)
tattgaagaagcttccagctgagctgggggatcaaaatggaggtgcttcttccccttctccttgcctgctctctcctcttcaccattgcaacccctatcagagacatcaccgacgtttgtgcctcacagatcagtgatttccagcacctgaacagctccggactgcacctgacgctgcaccacccgcagagcccctgctcgccggcgccgctcccctccgacctccccttctccgccgtcgtcacccacgacgacgcccgcatcgcccacctcgcctcgcgcctcgccaacaaccacccgacatcgccgtcgtcatcgtctctcctccacggccaccgcaagaagaaggccggcggcgtcggcggctcgcaggcgtcgtcgtcgtccgtgccgctgacgccgggcgcgtcggtggccgtcggcaactacgtgacccgcctgggcctcggcacgccggcgacctcctacgtgatggtggtcgacacggggtcgtcgctcacctggctgcagtgctccccgtgctcggtgtcgtgccaccggcaggccggcccggtgttcgacccgcgcgcgtcgggcacgtacgccgccgtgcagtgctcctcgtcggagtgcggcgagctccaggccgccacgctcaacccctccgcctgctccgtctccaacgtctgcatctaccaggccagctacggcgacagctcctactccgtcggctacctcagcaaggacaccgtctccttcggctccggcagcttcccgggcttctactacggctgcggccaagacaacgagggcctcttcggccgctccgcggggctcatcggcctcgccaagaacaagctctcgctgctctaccagctcgccccgagcctcggctacgccttctcctactgcctcccgacctcgtcggcggcggcgggctacctctccatcggctcgtacaaccccggccagtactcgtacacgcccatggcgtccagctccctcgacgcctcgctctacttcgtcaccctgtcggggatctcggtcgccggggcgccgctcgccgtgccgccgtcggagtaccgcagcctgccgacgatcatcgactccggcacggtgatcacgcggctgccgccgaacgtgtacacggcgctgagcagggccgtggccgcggccatggccagcgccgcgccgcgggcgccgacctactccatcctggacacctgcttccggggctccgccgcggggctgcgcgtcccgcgcgtggacatggcgttcgccggcggcgcgacgctggcgctgtcccccgggaacgtgctcatcgacgtcgacgactccacgacgtgcctggcgttcgcgccgaccggcggcacggcgatcatcgggaacacgcagcagcagacgttcagcgtggtgtacgacgtcgcgcagtccaggatcggcttcgccgccggcggctgcagctgaggacccaaactgcagctggccgactcaagctaggtaaaagagcaatgctgcttcttctgctgctgccgccgcctcctatctctgctcaggcacagaagtgacaacttcttaactgcaaattcattcatcacatgtaaatgcatatacatgtgccaggaagttacgagtgtggctctaggacctagttttacatgtcataaacaaatatagatgtacaaataaatacagggtaactactttaggtgaagataatacttatcaatgtgaaagattattatgttaaaaaaaa

SEQ ID NO: 127 - DNA, 1558 bp, Glycine max
  CDS (80)..(1117)
attcggctcgagccctaatccaccctttctgaacaaaaataaaaaaataaaaaaaaacccatcgatttcttggacctccatgacttctttgtctacccatcacacctatagccgaaagcaaaaatctctcggcctcctctgcaccaattttctgagtttgtacaacaaagaaggtgtgcgcctggtcggtctcgatgacgcagcttcgcggttaggtgtagaaagacgtcggatctacgacatcgttaatgttttagagagtgtcggtgtgctaaccagaaaagctaagaatcagtatacttggaaaggattttgtgcaattcctgctgccttacaagaacttaaggatgaaggtttgaaggagaatcctggatcatttgatgactccaatgacaatgcaaaagtgtctgatgatgaggaggaggaagaagaaacatttcctaatattaacattgggagtcagagtgagaaggaaaatcctgattacactgctactgtcaaatcctccaagaatgaaaacagaagggaaaaatctctggcattgcttactcagaattttgtcaagctttttgtctgctctaattttgaaatgatctcccttgacgaagctgcaaagttgttgcttggaaatgccaacaatagaacaaaagtcagacgtctatatgatattgcgaatgtgttatcctccatgaacctaatcgagaagacccatacaacaaacacaagaaaaccagcattcaggtggttgggtgtgaggggaaaaacatggggtggatcagttgacttggctcaaaattcaaatgtcaaagagtcacggaaaaggatgtttggaactgacattggaaacataagttttaaaaggaacaaagttgatttgtccatggatggccagaattctaaaatgcaaaatcaacacgaaaatattagtccacgagctcagttagagaaaatcatcataaaaaaagatgctaagcagacttcagagagctatcagtttggcccttttgctccagcttatgtgcccaaagttggaacctctgaaaataatagtgtgaaaaaggtgcatgactgggacagcctcgcacaggagcatcgtcctcaatatcaaaaccaaggttagagctttaaaagatctattttcccactacatggaagcatggaaatcttggtactctgaagctgctgggaaaaagtcaacgaaaactttataattgacttgtccaaagtcagtccagataattgtagcttttctagaaaataaatgatccattactgagtgtatgttccacatatgttggcatattctcaaaatgaaatgatccattactgaatgcatgttctccatgcgttactgtattctcaaaagaaaatgatccattgttgaatccatgttctccaggggttagcgtacagctaccctgtgctgatttattaaccgtcacatgtcatgttaaagatcagttaacagttcttatagattatttatcatgttttttataaaaaaaaaaaaaaaaaaaaaaaaaaaaaaaaaaaaaaaaaaaaaaaaaaaaaaaaaagg

SEQ ID NO: 128 - DNA, 3996 bp, Zea mays
  CDS (243)..(3371)
cgtagcactgccctcttcctctctgtcctctcccctgctgccgccccctttcccaaatctggccgcacgacgcaccagccaccaaccgcacacaccccaaacttgaaggcacaacccgagcgctcgcccgcctcgcctctgcgccgcgtccggccgccggtagcgggccggtcacttaccgggagggagaggtgctttggttcctggatgagctgtgaaggaactgggagcaagaagaattgatgtttactccgcagggcaaaggatggaccggctggtcgacgccaactccggccaaccagcggagcggtggtggggctcctgctgcgtcggcgccccttggaaagggcaaaggaagggtcgccgagctcgagcaggagttgcatgaatatcagtacaatatggggcttcttttgattgaaaagaaagaatgggcagcaaaatttgaagaaatcagtgaagtgctgacacagaaagaggagatactgaagagggagcaggcggcacatctgaatgctatatcagagtatgaaaggcgggaggagaacatgcggaaagcactaggtgttgagaagcaatgtgtcgctgatcttgaaaaagccttgcgtgatatacgagcagagatagctgaggttaaatttacatctgagaaaaagataacagatgctcagtctcttgaggctagtttggaggaaaaatccttggagatcgagggaaaacttcatgctgcagatgccaaacttgcagaggcaaaccgcaagaagtctcaagctgaccgtgatttagaagaggcggaagctcgtcaacgtagactggagaaggagaaactgtattttgagacagagcggaaggcccgagaaaagcaacttaaggagcaggaggaatcactgcaggaatgggagaaaaagctgaaggaaagtcagaatagacttaatgagttgcagagatctataaatgagcgagaggagagagcaaataagaatgatcaacttttcaagataaaacaggacgaactggaggaggcacgaaggacagtggaggccgctaaagttactctgaaagtcaaagaggatgatattaacaaaagactaaatgaattacatttacaggaaaaggatgctgactcaaagcgcagtgcattggaagagcaggggaaaaaattggatgagagagaggcaaaggtcactaatagagaaaaggaggggctccagaagcttcttgaggatcatcaggtggagcttgaatccaaaagacgggattttgaattagaattagagagggaaaggaaatcttttgatcaaaatatgacacagaagcaagcggatttattgaaaagggagaaagatgttaaatctttggaggctaaactttctaaaagtgagcaggcattgaatgataagaagaaatcaatggaaaacttgcagaatgatcttgatgccaaatctaaggctctgaagagttgggatgaatcattgaaaaatgacgagaaaaggttactgaaagaaaagcagcaaatggatcatgaaagagaacaattggagacatacaaattggagcttgaaaagatcaaatcagcattagaagctgagaaggaaaaaatatcagaagagcagaataatctgaaactcacagcgcaagagaggcaggagcatagcttgttgatagcaaaacttaagaaggagattgaggaatacagaatgcgaagcaactccctatctgaggaaatggaggatttaaggaagcaacggcagaaatttgaagaagagtgggaacaactagacgaaaagagagccctccttgtagaggaggacaaaaggttgaacattgagaggatgaatttagaacggtggcgtgacaacgaagaaaaaaggttaaatgatatgaaactcaaaatggatgaagaatacaagcagcagctggagagtcttgagcgcaaggaaaaggctttgagtgatgatatgaagcacaagcaaatggaaaatgatgaatttctgaagggagaacgtgctgatgttcaacgtaaattgcaactcaaacggcatgaattggagatggagatggagcaaaaacaagccacgaaggagaaggaactggaagaaaaggaaaatgagttaaataagaaaatagattttgtggaaaataaactccgacatgcaattgagttgaatgagtccaagattgagaagttattattggagaaaagggaggtgcagatggaaagagaattactgctggaggaaagaaagaaaacggagactgacaaggcagatattagaagggatattgagagtctgcactcattgagcaagagtttgaaggaacgtcgagaggcatataacagggacaggagcagactcatcgaactatttgaaaagtacaaggcgtgcaaaaactgtgggatttctatttttgagggattggattctctgctgcttaaagacagtgctgaaattgagcatccaagtttggctgttgagggagatgatcatgccttgaccaccgatacatcaggtccagatacaggaacccttgttaattcaggtggtcgtttttctttgttacagaagtgttcaaggcttttcaagttctcccctagaaaaaagggtgagcagtcatcagaacaaccatcagagaggaatatatcttttggtgcaagactcgaggaagcaacacagagcgatggagattatgtgccaactcctgtctatgagatagcccacgattctttcaatgcagaggatgagctcccttctgacggtgaaaccagggagaatgaagagtctgaaaggcatgacatagctgataatgcccagatggagtcttctgttggtgtagcagataacagtatagatattctcggtactaagtcatttgatggtgctaacgacatggcagttgaagcaactattgtctctgttgatcaaaatggcgaggactctgtagttcctgctgaagcaggtgtagagcctgaaacatcagagcaaggtcggcgccagcaaaaccagagaggcagaagaaaaggtggtatgaaaagaacacggtctgttaatgctgtagttgaagatgctaagatgatacttggcgaggtttttgaggagaagactgatgatcagggagatacagtcaaggtgggtgctacacgaaagcggcggtttgctggagctacaataagtgaacaagatgaagaagggagcgaagcacattcagaaagtgtttcacttggagggcagcgccgtaagaggcggcaaactgctggggcagtgacagatgccccaggagaaagacgttacaatttgagacacagtagagctgcaaatgctggcgctgcaacagcccaagcagacaaaaaaaaaatcttcaaaagcaagaaataaacatacagtagaagcttctgctgatgacaccgaaggaacatcaaaggttgttgaggaacctgcccctgagagcaagagggtatctgaatctgcagactacgatgcatcccagttgcatgagttttcccaggttgaagttggtgatgcccatgctgtagacggtgagggtgctggtgaggaagatggtgatattttggatggccaagatgcactgcctgatgtgccaatgacaccttctggaagcgagtttggagcggaacaggaagatgaggacgatgatgattcagagaggcgaaaccaatcaatcagcaagaagctatggtcattcttcactacatgacttgctgaagaggtcgtcatgtaggttatttctagcttttgtggtttcgattcatgataccccattcttggaactgtaggtcgtgtgcttttggtgattatgtactagatctcccacttgattgtgcttctctcccgtgtaattgaaatatatttgtagtggacatagtttgatggcactcacagaagtagctgatgagatgtacaatggcgatgatggtatgccctgtaaggctgtaacaccagtagcttggtttgtaaaaaaaaaaaaaaaaaaaaaaaa

SEQ ID NO: 129 - DNA, 1984 bp, Oryza sativa
  CDS (93)..(1403)
ctggatctatggagtacatcgagacagtcccactaaaccagtaaggatgggaatatggtgtttgtttgttctttatatgttgtctagcatccatggattctgttgttaggacccacattggtcatatgcttaagatgatacatttttgttctatgtttctcattacttttagcgactataaaatacaagctattctctcttcacagcaaaaaagaaaagcaccagaagaaagtgatgttgctgagtctagcgactgtatgattactagccctggatttgctgtcagtccaatgctcactccagtctctgggaaagctgttaagacttccaagtcaaagactaagaacaacaaagctgggcctcagacacctacatcaaatgttggttcaccacttaatcccccaactcctgttggtacatgccgttatgacagttcgttagggcttctcacaaagaagttcataaatttgctgaagcaggctccggatggcattctagatttgaataatgctgcagaaacactagaggttcaaaaacggcgtatatatgatattaccaatgtacttgaaggaatagggttgattgaaaagacactcaagaacagaatccgttggaagggcttggatgattcaggagtggaattagataatggtctttcagctttgcaggcagaagttgaaaatcttagtctgaaggagcaagcattagatgagcgcataagtgatatgcgtgaaaaactaagaggtttaactgaagatgaaaacaatcaaagatggctctatgtgacagaagatgatatcaagggattaccctgctttcagaatgaaacactaattgcaataaaagctcctcatggcactacacttgaagtcccagatcctgacgaggctggtgattatctccagagaagatatagaatcgtattaagaagtacaatgggcccaatagatgtctacttagttagtcaatttgatgagaaatttgaggacttgggtgggggtgcaacaccatcagggcatgcaaatgtaccaaaacatcaacctactgaagtcttcaatacaacaaatgctggggttgggcaatgtagcaactcagttgctgtggacaataatattcagcacagccagacgattcctcaggatcctagtgcttcacatgattttggaggaatgacaaggattatcccttcagatattgatactgatgctgattactggctcatatcagaaggggatgtcagcattactgatatgtggaaaacagcaccagatgtgcagtgggatgagagcctggatacggatgtcttcctatctgaagacgttagaacgccaagttcacacaatcagcagccatctgcagtgggcgggccacagatgcaggtctcagacatgcataaaccctaggatcacaggggttacagaagtgaaaagatgacatctggaattcctggagcggtgtttgtagtgaaaagtgaaagcatgacagcaaatgctcattgccaaattgtaaagagccgggtggtcttcatcagaatatctgcatcttctcgagacaccaagtccgtgcgagagatcaggatgacaccattccggattcacatctgctgtggaggctggtggcgtcaactaacttaccagcctgctgtttcagcaccctgcttcagtcgaacgggagtaaatcttgctgctgctttcgctgtgaagcctgctgcggtgctcattaaggcactgatatattttttgcattcaaaactaactagtcatcagcaaggaaacggtgggctttgctgtgctctgtcgagtattctttgaaaattctttgtacattgggaggtataagggcatgcagggctcgagttattggtttgacgggagcaatgagctgagttaatgatgtaaccgagccgtctttgtaaattgttccatgctcttcctcaaatacaatggatagactttcattttgaaaaaaaaaaaaaaaaaaaaaa

SEQ ID NO: 130 - DNA, 2156 bp, Saccharomyces cerevisiae
  CDS (569)..(1042)
cccgggaattttagattcaggtaggaaattgattacataaatactgttaccctgaatcatattcgacgatgtcgtctcacacggaaatataattcatttcttggttttccaaaaaaattttcattttttttcacttttttgtttcgtcctcctttttttttttttttattttttttcctgtgttcaccttttttttttttttttcagtttacaactttctgcattcttttctgtgttttttttttttcgtttttccattgttcgttcgttgcctgtttttttgccctattgttctcgagcctaaaaattttttcctttcctgctttcctttcttcgttcaaagtttcctattccattgttctcttcggtaaactcattgttgtcggaactcagatatattcaggtcaatttactgtacttcaattgacttttttcttgaaatttcaacttgccttttcaacttgttcttcttttttaatcttattctacactttagttcccttaccttgttcctaattattgtctagcaaaaagaaaacatacacctatttcattcacacactaaaacatgtctgacgaagaacacacctttgaaaatgctgacgctggtgcctccgccacctacccaatgcaatgttctgccttgagaaagaatggtttcgttgtcatcaaaggtagaccatgtaagattgtcgacatgtccacttccaagaccggtaagcacggtcacgccaaggtccatttggttacccttgatatcttcactggtaagaagttggaagatttgtctccatccactcacaacttggaagttccatttgtcaagagaagcgaataccaattgttggatattgatgatggctacttgtccttgatgaccatggacggtgaaaccaaagacgatgtcaaggcaccagaaggtgaattgggtgacagcatgcaagctgctttcgatgaaggtaaggatttgatggtcactatcatttctgccatgggtgaagaagctgccatctccttcaaggaagctccaagatctgattagatattttagatttctatagcttacaaaatacgcgatgtttttttgatctagaaatcttatttatacattttatataatattataataatcataatcataattattcatcctaactaacttcgttctgtttcagctacgaagttgccttcattatcggtacgttcgtgttaattggtgtttgataccatagtcacttatgacgacttacagaacttttttttttgacggatattttcccctcaatatgccgaggatgataactttataaattgccttctttcggttccttttttctttttaatttagctgacgggaacatgtgtatataccccagaagaatttaaacagaaatttttttgagctattttacgaaaatattaaaaactagggctacagatatcagagaaaaaattacttatatgatgacaataacttaatatcacagtcactatcgttctcgcctttatatgcgcaatgacagcattcgacttttccttagaagggatccgatcaacgaaacttcaaaaagagtagaagtcgaaatattttttgcacgacgagggtgacaaaccgtgctatgtccacaaatgaggccctgctttcccaagataaattgcgtaaacatataattgttacaaggatccgatcaacgaaacttcaaaaagagtagaagtcgaaatattttttgcacgacgagggtgacaaaccgtgctatgtccacaaatgaggccctgctttcccaagataaattgcgtaaacatataattgttacaaatccaaggctctgtgatttcttcaccaagtgtagttgtgatgtatagtgtgtaggataggtaatgaccggtaaatcaagctggtaaaaagtcctaataacaagcccgaatctggaataatggtaatattcccatgccaggtggacagtgttgtccttacacaaactcaagagattaaaggcaacttggccgagtggttaaggcgaaagattagaaatcttttgggctttgcccgcgcaggttcgagtcctgcagttgtcgttattttttatttccctttcttttcgtacatacacaatgcacagtcttcaaagtaaaataccaacgtatgtatcaagatc

SEQ ID NO: 131 - DNA, 1764 bp, Saccharomyces cerevisiae
  CDS (173)..(1336)
ggaagaactgaaaaaaaggtgggaaaaaaaaataaaaagtaaagtgaaaaattaaatgtaatgtatatttccattttgacgcaaagtacttccctctatcagttttgtatctaactgaagagtaaagtcgtgttttgcttagttaacttatatacaagtcaaagcaaaaaagatgtccgatatcaacgaaaaactcccagagttactacaagatgctgtcttgaaagcatctgttcctattccagatgacttcgttaaggttcaaggtattgattactcaaagcctgaagccactaacatgagagcaactgatttaattgaagctatgaagaccatgggtttccaagctagttctgttggcactgcctgtgagattattgatagtatgagatcatggagaggtaagcatattgacgaattggatgaccatgaaaagaaaggttgcttcgatgaggaagggtaccaaaagactactatcttcatgggttatacttctaacttgatcagttccggtgtacgtgaaactttacgttatttggtgcaacacaaaatggttgatgctgtcgttacttctgctggtggtgtggaagaagatttgatcaaatgtcttgctccaacttacttgggtgaatttgctttgaaaggtaaatctttgcgtgaccaaggtatgaatcgtattggtaacttgcttgttccaaatgataactactgtaagtttgaagaatggattgtcccaattttggataagatgttggaagaacaagatgaatacgtaaagaagcatggtgctgactgtttagaggctaaccaagacgtggattcaccaatctggaccccatctaagatgatagatcgttttggtaaggaaatcaacgacgaatcctccgtattgtactgggcccacaagaataaaattccaatcttttgtccatctttgactgatggttcaatcggtgacatgttgtttttccatacttttaaagcatctccaaaacaactaagagttgacattgtaggagatatccgcaaaatcaattcaatgtccatggccgcttacagagccggtatgatcatcttgggtggtggtttgatcaagcaccacattgccaatgcttgtttgatgagaaatggtgctgattatgccgtttacattaacactggtcaagaatacgatggttccgatgcaggtgcaagacctgacgaagctgtgtcttggggtaagatcaaggctgaagccaaatccgtcaaactttttgctgatgtcaccactgttcttccattgattgttgctgctacctttgccagtggtaaaccaatcaaaaaagttaagaattgatgagagaattttgagatgaaaaaaaaaaatgaatctgtactatttctttttttagtgccaaaattttgttttaatatagagataaataaaaaatgaacatattactataatatcaacaaaatatgatgtaatgtctgcaataaagatgagtcaattgcatttctataccgtacctaaaccgtgtgtacatagccatgaaattatgtaagtttatacacataaattgcgtcgagtctgctgtgtaatttataaatgtgtcacagcagcttttgtatttctattagttgccgttacctctcattttttcggcggtaagaatgtcactgccctatggattccattacatttttctcaatcagttcacctacggtttgaataaaccatactagcttcgtaagcacttactatacgttgttgagtaatgccta

SEQ ID NO: 132 - DNA, 2307 bp, Saccharomyces cerevisiae
  CDS (987)..(1880)
gaattcgtatctcattctccagtgaagtatcacaaattttaccgtggaaattcgttcctcaacaacgtgaggtttacgttctgcctggtgaaacagccctcgctttttataaagccaagaattacagcgataaagatattattggtatggctacttatagcatagcgcctggtgaagcagctcaatactttaataaaatccaatgtttttgctttgaagaacaaaagctagctgccggtgaagaaatagatatgcctgtcttcttttttatcgatccagattttgctagcgatccagcgatgcgaaatatcgatgatattattttacattacacattcttcagagctcattatggtgatggtacagctgtaagtgactctaaaaaggagcctgagatgaatgcagatgaaaaagcagcgtcattggctaatgctgctattttatccccagaagttatagacacaaggaaagacaactcaaattaattgtaaatacaaagtcattcaatgtacataaatactgttatgcttttgaattaagtaaaacaccatgacttcatattgagatgttttaagcatataatcacggcaccgaacttcttgtaatcatcaaatctttgttttctagccgtcatagaaatgaagaaatgaagattcttgttcatgtgatacagcttttctagacagctaacttgtacatccagacatcctaaaacacccataaagcaaaaaaaattattgaaatattctcttttttttcttttttttttttctggtggctttcaatgcggaatcgctaacatccgaaaatttcagaggcttcacttagcgtcgcagatcccgtagtcgccagatgctttgaaaaaaaaaaaaataaatagaaaagtttgtagacatatccgatgtagtatatttcagaggccaacctttacttttgttttctcctacacttcaaaataaaagacaccgtcacaaatctcagcaacaatggctttccaaaaagacgctaagtcctctgcttactcctctcgtttccaaactcctttcagaagaagaagagaaggtaagactgattactaccaaagaaagagattggtcacccaacacaaggccaagtacaacactccaaagtacagattggttgttagattcactaacaaggatatcatctgtcaaatcatctcttctaccatcactggtgatgtcgtcttagctgctgcctactcccacgaattgccaagatacggtattacccacggtttgaccaactgggctgctgcttacgctactggtttgttgatcgccagaagaaccttgcaaaggttgggtttggacgaaacttacaagggtgttgaagaagttgaaggtgaatacgaattgaccgaagctgttgaagatggtccacgtccattcaaggtcttcttggatattggtttgcaaagaaccaccactggtgccagagttttcggtgctctaaagggtgcttctgacggtggtttgtacgttcctcactccgaaaacagattcccaggttgggacttcgaaaccgaagaaattgacccagaattattgagatcttacatctttggtggccacgtttcccaatacatggaagaattagctgacgatgatgaagaaagattctctgaattattcaagggttacctagctgacgacattgatgctgactctttggaagacatctacacttctgctcacgaagctatcagagctgacccagctttcaagccaactgaaaagaaattcaccaaggaacaatacgctgctgaatccaagaagtacagacaaaccaaattgtccaaggaagaaagagctgctcgtgttgctgccaagatcgctgctttggctggtcaacaataaattatggatatataacgtcattttgagatattttaaataaagctatcttcacataacctttgtattcatttttagttaactcatttacatcatccacttactacatttgtattttttttacgatttgcgtaccgcctcattactaccctttttttgcactgcagtaatagtacactcaaatcatgatgaaaagagaaaagaaaaaaatgccacaaaaagtagttgattttataaaagttatcatccaattttaggtaattttattctctttatgtaacgaacatatgaagatttcttctctagaatggcattctaactaagtccgtgccataaaatcatcactaacaaatataagatcacgctatactatcaatgaagaaacaaatattaatagttgctgcacaaagtattttatgtctactgtttt

SEQ ID NO: 133 - DNA, 2995 bp, Saccharomyces cerevisiae
  CDS (576)..(1976)
gaattcgtccccgaacgcaactgcgaaattgaagggtaccgttgcttattttgtaattacataactgagacagtagagaattgatacatggataactgaatctctttcaactaataagagacattatcacgaaacaattgtacatttctctccttgtctgtgctaaataaactacaaataaaaattcattttctttcattttcattcgacacgccgcggcatcttcgttttcttcaccgattaattttaatctgcgccgtgcagatattttcgcccatttcgaagtgaaatcattctaataacttctcctgcgcaatagattggtcatcctgatttttattctgaaatcgaaaatgaaaagcatttattgcactgaaatagcggaacctgcttctaataagcttaaaattcaatcataatagtgtagttaatagaaaggacagaagaacttttcgttccttggtttatcatccaggtttcagcacggcttttgtttcaagtttaagtaggtaagattttttgattgttctacaactttttcatagtaatcaaaacctttgaatttcaaacttactatgtctagtactcaagtaggaaatgctctatctagttccactactactttagtggacttgtctaattctacggttacccaaaagaagcaatattataaagatggcgagacgctgcacaatcttttgcttgaactaaagaataaccaagatttggaacttttaccgcatgaacaagcgcatcctaaaatatttcaagcgctcaaggctcgtattggtagaattaataatgaaacgtgcgaccccggtgaggagaactcgtttttcatatgcgatttgggagaagtcaagagattattcaacaactgggtgaaggagcttcctagaattaagccattttatgccgtcaaatgtaatcctgataccaaggttttgtcattattagcagagttgggcgttaatttcgattgcgcttccaaagtggaaattgacagagtattatcgatgaacatctcgccggatagaattgtttacgctaatccttgtaaagtagcatctttcattagatatgcagcttcaaaaaatgtaatgaagtctacttttgacaatgtagaagaattgcataaaatcaaaaagtttcatcctgagtctcagttgttattaagaatcgctaccgatgactctaccgctcaatgtcgactttccaccaaatatggctgtgaaatggaaaacgtagacgttttattaaaggctataaaggaactaggtttaaacctggctggtgtttctttccacgtcggttcaggcgcttctgattttacaagcttatacaaagccgttagagatgcaagaacggtatttgacaaagctgctaacgaatacgggttgccccctttgaagattttggatgtaggtggtggatttcaatttgaatccttcaaagaatcaactgctgttttgcgtctagcgctagaggaatttttccctgtaggttgtggtgttgatataattgcagagcctggcagatactttgtagctacagcgttcactttggcatctcatgtgattgcgaagagaaaactgtctgagaatgaagcaatgatttacactaacgatggtgtatacgggaacatgaattgtattttattcgatcatcaagagccccatccaagaaccctttatcataatttggaatttcattacgacgattttgaatccactactgcggtcctcgactctatcaacaaaacaagatctgagtatccatataaagtttccatctggggacccacatgtgatggtttggattgtattgccaaagagtattacatgaagcatgatgttatagtcggtgattggttttattttcctgccctgggtgcctacacatcatcggcggctactcaattcaacggctttgagcagactgcggatatagtatacatagactctgaactcgattgaaggatatatttaaccacgactttcgcaagagagacggagggggtgggaaaaggctgaatgcaaccattgtcactaagaatttgagtgttcatgaacgagttatacacgctatttaagagtcagagaatgatgattcaagaaaattctggcatttttcctgtccaccactgtacgccattgtacacaaaagtatttttttatattttttttacaattttttataatttttttttatgtttagtgtatatttgctagaaagaaacaagatcttttttggtagtgtaaatgcttaaactttgtctctttttcctttttactttggaaaaatgccgacgcaagaacatagacatctgcgaaaaccaaaaataaagtaccaattgtacatacaaaaacagagaaaaagttcatgaacagaacgttactacggtatagcaagatctttgaatacatccattacttcggattgttcaccatacttcaacacaggccaagatagaccatagctacagtgatagacgaatatttatttcaaaagaagcatcaaccataaaataaaaagaaaaatgatgaaaaaaaaaccaaagtgccaaattgcaaggaccaaaccatcggtcgaaaacgtcataccatataaccaattcaagaagacgcagccgcgattcaacggcaacttttctgcactgaataatgaagaatacataatactctttggcggaggtcgggacctgatactaggctccctgacaccttgttcgagctctcatttgtccaatcaagccaacccacaagacaccagtgagtatggcacagacctgtttatactcaacagctgcattatcatttggttcaatggcttgggatatgggctggaaattccctacagcagcgttttgtaccatgcatcaagacggctaccagatggtagggaagggcttcaattagaaattttgctgactttggaaagagacgaagtgttggacatgctctaccaaagcctcgcgccacaggcctgcgaattc

SEQ ID NO: 134 - DNA, 15323 bp, Oryza sativa
  CDS (501)..(750), (1257)..(1417), (1735)..(1800), (3104)..(3218), (3318)..(3427), (3525)..(3620), (7587)..(7744),(7828)..(7915), (8565)..(8669), (8774)..(8878), (9421)..(9450), (9544)..(9656), (9732)..(9819), (9961)..(10180), (11034)..(11164), (12058)..(12204), (12770)..(12898), (12975)..(13073), (13221)..(13259), (14674)..(14823)
tgttgcatatgtttgtgttagtgctcatttaagcgtgttatgaactagaaatgcttagtcaattccaacaaaaagttcttcttagatgattattctgccattgtgctgctttagctgtcactgagtttggcatttccactcttgcagataactctacccaggctgagttgtggctggtattggcgatataagcttgttagctgttttctcttgtgtctttggtcttcatctttgattacgcgtcattgaaaagactgtacatgagaaaactcttttgttgaaacatttctcttgtaatatgaatgtattgagtttgtgactatccttctcctgtgctagaatcatatatttcagcttcaaagctcttgtggtacttttcaagtttcctgttgaaccgaatacctagtgcattaactctaagcttgtgacaaacattcatgcaaattcgtggatattaacattggatacttggtctactggaaaattggagctccttattcatgtcatcaatggagagcctagcacagttagagctgttatgtgaaaagctttacaattctagagactccgctgagcgagcacatgcagaaagcaccctcaagtgcttctcggagaacagtgactacatttcacagtgccaatatatattggacaatgcctcaacaccatatgccctgatgctggccagttcaagcttgttgaaccaagtcaacgaccgcagtctttcattgcaattgcgtcttgatatctgtaatgttccttaccaaaaatttatcatgaaatcagttgttcacctgtttttgcttttctattgcatctgcatggcatgttttcatttacgtctctaccaatttattcagttatgattatttctgcattgcaagttaccacagaaagcagtaagcactcgtttgtactgctatttagtataagtggccatatttaaatctttgttgttccttccttgactcaacttatttctgttgcctttgatgtcttatgcttatttaatatggctcgagttgaacaaacaaatatttattctttgcattctatccttgaattcatttatgcctctgcagcatgttagaatggccaaatatttatttccatttacccactgttgttttatgcatcggtaatgtagataaattgcaaaaatacatgtctataaacaatgcttaaatctattttgtgtacttttgtgcccttgtctactgctaattttaaaccaatatattgtgatctgtttgaagtgaattatgtcataaactatcttgctatgaggggacctaaactgcagacgtttgtgattaaatccctaattcagcttgtctgtcgaattacaaaatttggatggttcgatgatgataaattcagagatattgtcaaggaggcagctgatttcttatctcttgtaagtttgttgtctgttttgttggcatttagttgagagctttttaaccgttgataacatatttaaggactatgtaccttcgatttgagtggagctatacaccttggtacataaatccttggcaatttctatgaccaatgcccgttctttagaactaagtaatatgaaaaaggataaccggcctaccagataaatctacataagaacctgatttctattaaagaatccatatgaggaacagttataggttttattccatgctctattgcgagttaattgatgcatactaaagttgctgcttatgcttttcatttcaggcatcccaggatcattatttcataggattgaagatactatatcatcttgtaggagaaatgaaccaggtgccacctagaaacttctctattattataattgttcaataactattgattctaatcaataagataagggtacccataagataatgcaatttggcaatacgtagattaatttaaaagttgaaaaaaaaatatttcaacagtattttttttgtgtttagaactgcacaacgtgcatggtgttgttggcacttataaaacatcggatgaaacacagaaggtcaaacgtacatgaaacactacatatgcactaacttgtgcatgaatcaattaatatcataagtaaaagttgttctttattttcctttgcgacacttaacaaagagttataaacatgcagatagacatatataggcatagtattattgaaaaaatattaatggttaatccaaccaatgttaacaagacaaagttaaacattgacactgatggttactgtattaatttccatttattttaaagagtattggcggcaatatgatactccttccttccctaaatgtttgacgccgttgacttttttagacatgtttgaccgttcgtcttatttaaaaacttttgtgaaatgtgtaaaactatatgtatacataaaagtatatttaacaataaatcaaatgataggaaaagaattaatagttacttaaattttttgaataagacgaacggtcaaacatttttaaaaaagtcaacggcgtcaaatattttgagatggagggagtatgtggcaccttactaaattgtgttggggtagtgttggtagcattcctttttacctgcttggagctgtgatgcacatttcagcctttttactgtcccacctttctgttagcctgtcacttctttttatgccttccttctttgtcttaactttttctggtatagtttcttgaatatgattgtgtgtcactgtatttcttgtaatgttgagtttcattttatttaacatgaaataacacagattgcttgcttagtacaagaaagggttctagttctacaaatatcttctatgaactgtttctctttttttccggtaacaattctttcaatgaatagttgatttggaccattaagctttctcagtatgtacttggcttcatactttttgcatgctgtcttctgcttatgaattatatagtgttcgttaatatcttcaattctgattgggttatgtacttatgttgttgcttatatcttttcaatatagtttatactgctgtgcccatttttatccactcttgttcaatttcctttgtcaggtggactgtaatgtgtttagctgactttttgtgtctgtgtatgcatgcaggcaaacgctatgcctttgacacttcacagaaaaattgcttgttcgttcaaggaccagtttcttctacagatcttccaaatttctttaacctcattacaccaactgaagagtgaaggtaaagttcaaggaccacattttgtaaaaagtagagtgtatcggaatgcccacactttctcacttccatcttctgatacaatctgtaattaaactgcagtacctgatgactttaggcgtgatcccctctcgcttgcattaaggtgcttgtcatttgactttgttggttgtcctgtggatgaaagctctgaggaatttggtacagtgcaggtatgttagtttgcacaattgttatcttctctgtaaaaccattgacctatcccagttggtctatttcttataatttgtgtaatttttattgatgcagcttcctgcatcttggaggcctctccttcaagatccttctactgttcagatcttcttcgattactataaagtcaacgatacatgtgtttcaaaagaggtatacattgattgggtgatttgaataatatagatgatataatctctgattatttttaccgagtgctttgtccattactccataaacacaaaagaggtatattttgcttcatagttcctcatgtttagaatgtacactttgatcgcatgatttttcattaatacattttacaaacttattgctagttagctatcactacagttctgcaatattttgattgacttccattcagcagcaatatttttccaatgttgtcttttaaaagcatgacttcctcacctctgtgaagcagcaatattctcctaatgtatggatctctaagaggcatgctttattcctttcaagaatctctaagaagaaatattttccttgtgaatttatcttacaaacagctgtttcgtttttctttctatatgagtaatgtgccatgttcagtggatttgctctttccttgactcttccccgcctccctctcctatgcacttctttatgtcatttctgcaggctttggaatgtcttgtgagacttgcttctgtcaggcgcagtatttttgttgaggacccttcaaggacccagtttctttctcatctgatgtcaggcacaaaggagatactccaaactggccaaggtataacgctttgtcctttttttgccaagttctgttctattgtagtactcctgttacaaatttcagttacttggaccagcggtttcaattgcaatcctcttacatggagtgaaaagcctcttttatgtaaagtgaagaagcatttaaaacatgagttgattgactcatgcctagtcacgctatgtggtgcactgtagaaaccagacttgctttttataagtaaaagcacacattggttcattataaatgcaatagtaatctttaaacttaggtacttgtctgtcaaattagctccatgcaggaacaaaaataaatgctccatatctttacgtaatttattctgatgtgtgatctgctcatctgcaggtcttgctgatcatggaaattaccacgagttctgccgtcttcttggacggttcaaagtgaatttccaggttggaatcctgttacttaaaatgaaggatgaagctaacttttcttgtttgttttgtgtcaaggatttgctcttcgttctctctctttgcattcttttacagaattattgacttgctagtttttggtacgtaacaactgatgaattagttggcaacagtagtgatgcattaattctggttggtatcctgactgaaatgaattgcgatggtggggattttgtgggattccaaacacgccttactgatgttattttaccctgatttgtacttttgtactattgctttgaaggaacagtaataagtaaatccaatggtttgtagcttctagtcttttggctttactagcagcactaactagtcatactgatatgcagttcaaggttttaaatagtggattgcatttttatagtgcattggttttgatgtagagcatatcgtaatgatgcagtgcatgttgtagtgaacagttgatggaatagttaatttgtatcataattataattctacgaagtgaactattgtgtttatgatgtttttatgtatttttggtaatgtttgcaacttgcaagtgctatttttgttggcatcttcttttaattttttgccttacagacatttggtaccaatttattagctttcaaagtttcaataaacaacggagcatttaatacctgtgtaatagtgttgtcaactgaagatggccattgttccaaactttcttttaccatttttctatatgcattccttgtcccaattgcctattactaacttactgtttgttaagttctaaataaaaagcatggttcaatattttcttaccacattcaaaatttgccataatgaccattccttcttatttagaactttgataataacgtagttatgtaaattagtctatgttgatcatgaaaataaaattgaactgtattatgtttgttttctgttggcatatcttcattgtgacattcggaatactcccggcattttgactaccaaatgatttggttggttgattgttacctgtgtattagatagtgttggctgcactcatttatgatcctttatcaagttctctgttattatcatagtaatattcaagctatgaatggacctctttgtgatcaagtgtggattcttgcattgttgtactttgcagttgtcagagcttctgagtattgagttttatggtgaatggattggtttagtagcagaattcacaactaaatccttgttgtcatggcaggtctgtttcccttttttttttttgactaattctcttagcactggattattcaataattaatttccaatagttctaactattgaatatttgtagtgggccagcaatagtgtctactatcttttgagcctttggtcaaggctggtgacatctgttccttacttgaaaagtgacacaccaagtatgcttgatgagactgttcccaaaatcacggagggttttatcacctctagaattaattctgttcaggtactgatttctaatgagatgatggaactgctttctatctcagattctcagttgaagagtaacgtttgttatattctgttgtttctatccatctcaggccagctttgcaaacgactcatccgatgatactttggataatgtggatgttcttcaggagcagttggagtctcttccttacctttgtagattccaggtcgccatttcctgtcaagttctggtttccaatttaagagacaattttctgttaaacttttgattggatccatctttgtaatcatgtccacctgtagataagataccttgcttaatcaattgaatgttttcttttatggagattaaccctgttccagcttttcacataacaggattcatagttttatgtaattgatttttttattgaacatatacattggttttacttttatctacttgcagtttactgcatgcacttagtaatttcttgtatatggcactagaatttctttctttaagttatggagaactaatagaatgatacaacaacagtagatgcatcaaatttaagttgcattatgctattcattttttatcgtatttaattatacgattctaaaacaagaataaccagagtaattttttggccaacttaagtgctttgttgagttgttcaacttcatattctggacgggtgcagaaaatatagtaaataagataaaaaatttgacaaatttagaaatgctattggatggatcaaaaggaaagataccagtttctctctgcatttttcttttttgggcggttgggggggggggggtcaatggctgtgatcagatgctcatgttccagtataacagtagctatttgttttgttatggcaaactggctgattgaaattttctaagcacttcatgtggtcgtcagcccttcccgattgacatggtcaagaataaaggcaactgtggatagacatgcaacttagcagttttgagccttcgcaagtgttgtgtacacatcctatgtttattatgtatgttagcttgccaacatgtgagtttagctatctacattgtgcctctcaaacagatgaagatctcttattaccatttctgctgttttcagctaatttattacgccacttcattatatatatctgttatttttgtccggatggaatttttatataattattttgagtcactactaacctccttgccagttaccaatagtacgaagaagctagatgaaatgcccttattgttcttaggcctttttttttttgatagggagttgcattatatgacatggccataacatgattttcttttgctgatttgcagtaccaaaacagtagcatttacatcataaatattatggagcctcttctacaagcttatacggtatgttagtgttatttcacagtcctcttttttgggcagaaagaatgccttttcaaagccaaatactttttacaggaaaggtcaagattaccagctcctggagatgcgaatgagctctctgtcattgaaggacagctcacatggctagtccacataattgaagccattctcaagattaggcagaccattggttgtaggtgagaaattaacattccttgcttccttatattctgtttgatttcctttttttttcacctacaatgctcattttttcatgcagccaagaatcacaggagttaattgatgcagaacttgcagcccgtgtgttacagttgataaacgttactgacacgggggtgcacgcacaggttagatgaaaatgatttggtcatctaacatcaatgctgagtgctgagctagtgtacttgtagcaacaacaattttcctttctagtattgtctgcaaattatagaatataattgcatatgtaggtaggactgattttgttttttgacaaacatagatattttctagtactgtaatgcaaataacttacaactttatttttatcgccaatactgtaacatatataaccaattactcgtttctctatttgtcgtgaagcttggagtcacagcaacgcatgtggttgttgatggtgttttggtgtttcttacagttatcatgagaatgctaccaatagaagctgtgaatttgcacttaaaaataggctgaaattgaatttatttaacgaaaatatctaaacaatgtccccctatgaacttaacctttggtaaccagcccactttaagagagttatatttcatattgtattatgtgcagcatgtaaaccacatactgtccccataaaccaaatctgtttctgtattgcgacactacgtatcacaggatgctctccaatttgttctttactttcattaacctgttttagctgctcttataaccattcacagcttcacaaatttgtgaatgatgacttgggtgcattctttgcagagatatcgagtattaagtaagcaaagacttggtcgtgctattcttatctttgtgcaaaatttcagaaggtcatatgtaggagatcaagccatgcattcttcaaaggttagaagaaaccgaataataggacataactattataatttttctttttatcttgatgtacctttttatgtaaatccccatcaagttttacttctttgctgcagcagttgtatgcaagattatctgagcttcttggattgaatgaccatttagttttactcaatgccattgttgggaaaatagctactaatctaaagtgctatgctgaggtacctattgtttagacatttactgattttaggcatactttgatctatatgctgtggctgatcctttgtgtggttacagtgcgaggatgttattgatcatactctgtccctcttccttgaacttgcatctgggtaaagttgtagctatatgtattcactttacatgtctcatgcttattatggtaacaattcttcatatgtattttcgtagcagctatatgactggaaaactgcttctcaagctggagagtacaaaatttataattgcaaatcattctgtacagtcttctcactagcttctgtttcatgttatccctgtgccattcctggtcttagaagtgattctattttcattattaatcttttcagagggattcttttccatttcttgaagaatacagatgtgcccgcagtagaacaacattctactacatccttggctgcttggttttcatggaagacaccccagtaaaattcaggagtttcatggagcctctcctacaagtgcattgctacttatattcataatctctccgccccagaatgtagctatatctggacctgtacagatcgtaggtagaaatagctacattttggggtgtaggaagtactagttaagttttttctccattcttatatggttttcttcttcgtattctccataggttgcagttaatttggaggcaaccgctgatgctgctttctggactgatgttgtgaagtacgcatttattggtttgatgagagacttacgaggcattgctatggccacaaacaggtgcacaatttgattatatgtggtatatatgtgcatcaactcactaactactttgttgatctgatccagccgcaggacctatggcctcctatttgactggctatatccatctcgcatgccacttttactgaaagccatctcactctgtgctgatgagccggaggtaactaccaaatcgcaatgctttccttgcgtagctgttctttttgaaaaagtttgaactgtttttagaaaatatctagagccttatgcttctaaatcttttgctcagctactgcaaaatcaccactttgtgttcatgcaggtcaccacacccctactcaagtttatgtgcgagtttgttttgaacaaagctcagagattgacatttgattcatcatcaccaaatgggatccttttattccaggaggttagcaagctgattgtggcttatggatcacgtattctgttgcttccaaacggcactgatatttatggaagtaaatacaaaggcatatggatatcacttgctgttctttcaagaggtgagttcagaaaatatgttttgaaaacacctgtatgctctgcaattttattacagtttcagtaaagtctacctgctgttattcactgttttctaatgcttgatttttttagtggatttcatcctttccaattttatgtgcgactctcattgcacaatttttttgtttgaaaaagtgtgctttaggttacacttttgctgtgaaatgttatttgaattccaacatgtctctacgaaatttcaagaccaaaaccttgtttttgcaccccattgagatcattgttttccaacagacaatattaacttatccccatgggccatattacctggactgtgaaagcttgttcatttctgttaatcatttaactccttactgatttgtgatatttgagttgaattgtagcctcataggccctggcagatgataaatatttcaattgcataagatttgcagtagttgagaatgggtttatgatgattttggctaaactgaaatttaactgcaactatggttaaattctgttgcaaatatggcagactttctataccttttcagtttcatgtgtggtatgatctatggatctccttattcaagaggatactgatttacttgaatttggtatgagatgttacttggagttttcggttagggtgacagctgagttccaccatctctgattcaaactttttgttgtgcttttaatgttataagaataaaattggctgagttccactcaactccgagcccaattatttgttcttaaactgtatcttctgggaaccttatctcccattgcagactaaagatttgtattttttttcttttgctgttattctgactggaaccattgcagctttatgtggaaactatgtcaattttggtgtatttgagctgtatggtgacagagcacttgctgatgcccttgatatatctttaaagatgagcctctcagttccattgtctgacatattggcattcaaaaaggtattccttgcaactttagtgatttactattgttttgctgtgtagtgctattgcttttattaatatggttattaagatctcaaatatattcattctaagttttatagcattgaagatgtaaagttctcattatatcgcaatgaaagtgaattgaatgttatgtatatcaattaagcagaggtaattacttgtgcctcaggaactggactgagtgattttagtgccaatcttctaatctaactgagaaccctgcatttacgcacttggtccagttagacaacgctgttatgacagaatatacaaattgatcagatcctagtatcttagcctgtctagaaagatttgtatattctgtcataacagcgctgtcatttttttatttgaaaatatacacagtaaaattaccaggagaaaacatgaaatgagtaccgccaacagtgggctccagagttctatcaggaaactttttctttggaacatgggatgctgctgttattttttatttttatgccagacattttcaaacatttttttaagagcattctccaacccctagaactgtactccagttgtgtttgaactttgcatattttttttcaacattttgtttgtagtctccttggcattttaccagcaggtaccctgcatgcgagcttagtttatttatttaggtgatctcctggcaatttttgcccactggtaacatgcgtacaggtttagtgctatgttttccaacaattgtgcttttactggcttgatcatagacaaataaacagcctagacaccattccaggtcttgcattgtcccacattgatttatggttaaccagatgattgagatattcttgtttcatccgtggaagcattcatactaggctctttctttatttcagctgtcaaaagcattctatggatatattgaagttctgttcagcagccatatcacttttgttctcaatttggatacaaacaccttcgtgcatattgtcagcactcttgaatctggcttaaaaggtctagatacagggatatcaacacaggtatacgacatgatgctttttactgcttgtaaaatgttccccgcttcttgttacaacagcatcggtgaatcactgcttaaactgtgtcctatcggggaagacatacttccaatctgtggttgctggtagataataattgatgccatcataatactctattctcttttatgtggtttcccttttagtttcttctcttggatctggatgtcatgtgcaacctggttagggcccacatagaagcagcagtcaacctctctaggcctgcagtactgtgcacatgaatagtaatgggaacaacatctgcctatggttactgtttaatcatttccatgttcttcgatacggggtatatcgtaaaggtttgggttgtagaggtttattaaggaagcaatacacacaagcttttagtctcttttttatctccttcccttatgcagctacctcagcactgcttggttcattaagcctaagggcccttaactatgttcatcacattggaatccatcattgttctttagtgctttctgtttggactaatctgtaaattgttgcttccttttggcagtgtgcctctgccattgatagcttggcggccttttatttcaacaatatcacagctgctgatggccctccttcaccagctgcactaaatcttgctcggcatattggagagttccccactttatttcctcaggtttgtgttaataatcttctctaccatatgcagaaaggtctggatgtaattacattttgttttttttctgtgacagatactgaagacgctttttgagatcatcatctttgaggatgcgggtaatcaatggagtcttagtaggccaatactgagtctgataatgatcagtgaacaggtgcttgtctttttaaaacttttaaatcatgttccttagcatttcttttgcactcttttttccagtttgtattgtctttgttttttttctttttttttttgcgagggtctttagatcttttctaatcagttgtttttctttgtgcagatgtttagtaatttgagagcacagatattagcatcacaggtcagtgaactctctggtctgatattccactatgcagtcctgtctttctagttttatttttgggttaattggatccatgccactgcaaatatgccaatttgaaaaaatgtcactactattcagcattcggctatgtgccactgaaaattggagaaactggaaccgttcacattttccgtcaaaaatccctgttagcccccaactgcacgtgggccccatctccctcccctctcttctctttccccttctctctccaccaccgtagatgcggtaggtgttgtcgccatcgtctcggagccggaagatttgcgattcaccctcaccgatctcgcgacgatgggtgatgtggccgcaccagctgcggcggcgcgggcggcgaggccgacgagcccgttgcgcccgcccaaggcgatccgcagcaccaagccaaggggctcgacgaggagaccgtcatggcaccattcgtcaagcaccttgtctcggagccggcctgctgggatgcgcctgcgtcgtcgtcgtcgttgtcgagcgcctcgtctcggagccggcgagccagactgcgcctgcatcgtcgtcgtctgctcccccggcaaggtccccggccaccgcccccgtgccggtcgtcaccccgcccaccgccgcatcgctgtggccaaccctcgctgccaccgccaccgacctcctcccggagcgctcgctttcatctccttcccccgtgccgctcgtccctccgcacttcaccatcggctccccggctgccgattcccctcagccgtcgccctcctgggctcgccggcgtccatggcggagaagctccccggctgctaattccctcgacgacggcggtgagggtgctgcgtccgccggcaaggacgacgaggaacggacgggtcgcggcggctgctggtggagcagcgagagatggagggggggggggatcactggctagctgcagtggcaaggaccagcgagttcgaggtggagtgctcgccggtgtccatggtggagaagtgaagaaaggaagagggagagagatgacggaggttgacagaaaactggatggaagtggcatggttccaatttccccaaattctagtggcacgtagccgatatgctcaatagtagtggcattttttcgaattggcatatttgcagtggcatggatccaattaacccttttttttcctctgcttgaagctttctagtgtcaagttatcaacaatgtttccagtcatcagcgtgcaggtgttaggagacaagtttcttttcagtaaaaatattaaattctactagtacatcttttgattagaactgtatgtccagcttgtgatgtacctaagttttgttaacatatgtctgccaataacagcattagtaatcattattgaagaactaatgtacgtcttgtttgcagcctgtagaccagcaacaacgcctttcgcaatgcttcgagaagctgatgtctgatgttgctaggaacttggaaccaaagaacagagataaattcactaaaaatcttacaacattcaggcatgatttccgtgtgaagaacattcaggcatgacagctgttcaggaccagctaccagctttaaggtggtgcactcatgtgctgtaaatactttagcttagcttcgttttaggaaccaccattcccgtggggggaaagttatggtttaactcagtttggtttggattggctgaaagatgaagggttctcctgctgcacgtggtggcaaaatgcagttgttgatctcttaccttgtcgtgtactagactggcgagtgcaggagattcttcttcttcttcttcttcttcttcttcttcttcttcttcttcttcttcttcttcttcttcttcttcttcttcttcttcttcttcttcttctctttttataccttagtgttaattccatctctttttgcttgtacagcaatattcatgtgaaagcctgtgatcgctgtttccctaagttgttagggcgaaagcagccatcgctcaaaatataattcatttgttaacaggttagaagaatagaaaaaaagttgtaaatggttgtgcttcc

SEQ ID NO: 135 - DNA, 3501 bp, Saccharomyces cerevisiae
  CDS (415)..(1605)
ccagagatatgtagccttccatcagtagtaatatccaataaattgggcaccatggtttggcaatcaggctttttaccctcgccctcttttccttcgccttttacctcttctgcatccaatttcagcgtacgtacacaatgattgactttggaaattttcacttttttccactcgaagaaaaaaaattccaaacacggttctccggtatttaggcatcgaataaactttgctaatcgactaaaagcatctctgcatatctatacgtgtatatattgtattcgctacagctcgctccttgcatcaactctttttttcttttttttcttccaggttaatcaattactgtactgtagcttcttttttatattttttaggttttcatatagtgtcttacgcaaataggcggaccatagaatgactgtcaccataaaagaattgactaaccacaactacattgaccacgaactatcagccactttagactcaacggatgcgttcgagggtcccgagaagttgctggaaatctggttcttccctcacaagaagtccatcacgaccgaaaagacattaagaaatattggcatggatagatggatcgagattttgaaattagtgaaatgcgaagttctttccatgaagaagactaaagaactggatgcctttttgttgagtgagtcttccctcttcgtcttcgatcacaaattgacgatgaagacgtgcggtactacaaccacattgttctgtctcgaaaagcttttccagatcgttgagcaagagttatcgtgggctttccgcacaacacaagggggcaagtacaaaccatttaaagtgttttattctagacgatgtttccttttcccctgtaagcaagccgctatccatcaaaactgggctgacgaagtcgactatttgaacaaatttttcgacaatggtaaaagttattccgtgggaagaaatgacaagagcaaccactggaacctgtacgtcaccgagacggaccgctccacacctaagggaaaggagtacatcgaggatgacgacgaaactttcgaagtactgatgacggagctggacccagaatgcgctagtaagtttgtttgcgggcctgaggcatccacaaccgctctcgtggagccaaacgaagataagggccacaacctcggctaccaaatgactaaaaatacaaggcttgacgaaatatatgtcaactcggcccaagactccgatttatcatttcaccacgatgcatttgcgttcacgccatgtggatactcatccaatatgattctcgctgaaaaatactattacaccctgcacgtgactccggaaaagggttggtcttacgcctctttcgaaagtaacatacccgtatttgacatttcccaagggaagcaagacaacttggacgttcttctacatattctgaacgtttttcaaccaagagagttctcgatgaccttttttaccaaaaattatcagaaccaatccttccaaaaactactaagcatcaacgagtcactgcccgactacatcaagttagacaaaattgtttatgatctggacgactaccaccttttctatatgaaattgcagaagaaaatatgaaaagccgccatttgtgtctcctcatacttacatagaatagccctcttctattatccttcgcttgctttctagcactcataactaatgtagtttaacccgcttgtatatcttctacatcattaccccgcatgcttttttttttcctctagagaaaaccggcacagattggccggacccggaacaggaaaaatggccactgaaaattcctggccagaccacccctgagctaagggagtttagccgctcaagcttttatttcctctgatgtaatatatcacacacccagacacggttgccaaggcctcgacggaaggccgcttcaagggacggggcagtggctatcagaaataccttaatatcatcaatatttttcatcaatcgcaaggtgtcaaacatcaataaaggatgatgctcaaaggtttatgcccgatgttcttctaatcccctttctctcctaaaataatcctttttttactcttcttcttttcccctgtttccatttttgtcttttctcaccccttatgggacatcaataatgcaagtatgtttatacatttttatataaatgtatatataaatgccatttcttacacataacctccattctttggttaattctttcttcattcttttttttttcattctgaaaagccctccaagcaagcacgctaatttaatatcgatttaaacatgaaagtatcacaagttttcatttctgccatctctgtcttcggcctcgctactagcgtaaatgctcaaaacgcatccaacaccacgagtaacgctgctcctgctttgcacgctcaaaatggtcaactactaaacgccggagtcgtcggtgctgctgttggtggtgctttggcctttttgatttaggaaaaacgccgcttactgccacgatgatgataccctattgacgtttctgaaatgtataatttcttttctcatcttcccctttgatattccatctataggccccagagtagtaaatttggtgctttaattttttttctcttcttccagttcgtctctattttttcattccattatatttatttatcagttttactttctcaaatattcttatataacactatttcatctacgtaaccgaaaataagtagtttaataacgataataatcataattgtgataaaaatatttacatttttcttacttgtcgcccgcttcgtttttgtatagaacgtactgtattagttgtccgttcttttcacgtctgaagaggtcgatttcttgcaatttaacatcaacgtggtattttccattatatacaatcaaagaatcatcgtccagttcgatttcgccatgaaaccaaaggtgtaatgcatgtgagtccccctgcagtgggtattcgtacttgaacgacccgtataccctctccggcgatataatctcaaataaatcggctgtttccaaaccaatgcggttcagtaaatcgtcgatggttccccgtatacttattggccgatgcgttatcctccatttgcaaacaaagggtattctataccaagtgtgcgaactatcccttttatcgtctggctccattacaataccagttacacatggatcttgatcttcgcaccacatgctgaattcatttaacgtgggtgaattgccatctttatcaagcaatggtactccgtattgttccttgatcatgtcatgaccggataatatctctaaaacccttaatttagaaagcttctgtacttggtttacgtcaacctttttcaaatctctggtactcagtttacgtatcttggatgatggaaacaatggtaagaaactttgttcctttaaatatatcactctatagattagtgagtatcctaatatcacaccgaatataccaccaaatatggcggaccatatttg

SEQ ID NO: 136 - DNA, 1650 bp, Zea mays
  CDS (268)..(1365)
attcggctcgaggcattgaggacgttcgacctgccggaggcgcgaagaagttccagtctgctgcttactccaactgcgcaaagaagccatcctgatatcccttttggctttctcgttctagtagtttaggatttcttttctgacacttcgattcttaccaatccccctggcctgctgctttcctgacaatcgaccagttccccagtcttgctccctgcagtcctccctcctccatctccagcgttgtgttctgactcacctgcaccaatggctgttctttctgctgctggtgctcccccggcctcagctatcgggtttgagggctatgagaagcgccttgagatcacattctctgaggcacctgtctttgtggacccccatggcagcggtttgcgtgccctctccaggtcccagattgactctgttctggatcttgcacggaagattgtcatcaagacctgtggcactaccaagctcctgctcacaattccaaggatcctagagcttgctgaagagctgtctatgcctcttgctgctgtgaagtactcccgcgggacgttcatctttcctggcgcacagccagccccccaccggagcttctccgaggaagttgctgtacttaaccgatactttgggggcctgaagtctggtggcaatgcttatgtgattggagatgcagcaagaccaggacagaagtggcacatctactacgccactgagtacccagagcaaccaatggtcaaccttgagatgtgcatgactggtctggacacgaagaaagcttcagtcttcttcaagactaatgctgatggcaacacaacatgtgccaaggaaatgacgaagctctctggtatctctgaaattatccctgagatggagatctgtgattttgacttcgaaccctgcggctactccatgaatgcaatccatggctctgcgttctccacgatccatgtgacgcctgaggatgggttcagctacgccagttatgaggttatgggcttggatgccactgccctgtcttacggtgaccttgtcaagagggtccttgggtgcttcggcccctcggaattttctgtcgccgtgaccatcttcggcgggcggggccaagctgggacatggggaaaggaacttggtgcggaggcttatgactgcaacaacatggtcgagcaggagctgcctggaggtgggatcctcatctaccagagcttctgtgctgctgaagacgccgttgctagctcgcccaaatccgttcttcgctgctttgatggcgagaatgcagcaccttttgcgaaggactgcaagctggctaatcttgtctgcttggaggaagttggatgctatcgaggagaaggatggagtgcttgatgagtaagacgggtttctggtgtcgatttgcttctgagtttttttctttttatatcgttgcgatctcgtggttgtcgtttggttagcagccaagccaggctattagtacgaagaatgtcgtctataaacatgtgttcctacgttgccacatgctgagtcaatctgtatacagctagctctaggtggtcagctgcgtctaccacaatgagcatacatgtatggataaatcttctgtgaaagcattcgatgaataaaaaaaaaaaaaaaaaaaaaaaaaaaaag

SEQ ID NO: 137 - DNA, 2082 bp, Zea mays
  CDS (581)..(1780)
ccacgcgtccgcccacgcgtccgaaagaattccctcccctagccgccgccgccgccgctcgtctccctgagaggtgccgggaccgaggaactggccgagtactaggtagagaatcggtttttcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcctccctccatctccagcattgtgttctgattcacctgctccaatggctgttctttctgctgctgatgcttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtctgagctctccaacaaggatttcgactcatatgtcctttctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggcgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggtctggacaagaagaaagcttgtgtctttttcaagactaatgctgatgggaacacaacatgtgccaaggaaatgacaaagctctctggcatctctgaaatcatccccgagatggagatctgcgattttgacttcgaaccctgtggctactccatgaatgcgatccatggctctgcattctccacaatccatgtgacgcccgaggacggtttcagctacgccagttacgaggttatgggcttggatgccactgctctgtcttatggtgaccttgtcaagagggtcctccggtgctttggcccctcagagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctacctcgcccaaatctgttttccactgctttgacggcgagaacgtggagagtgctcctcctcctatgaagaaggactacaagctggctaatcttctctgctgggaggaggaagcggatgccatggaggagaaggcgggagtgcttgatgagtaagacgggcttctggggtcgatttgcttctgagttgtttattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtctaccacaatgagcatgaacgtatggagaaatatctgtgaacccattttgtttatgaataagatttgtttttttcgaaaaaaaaaaaaaaaag

SEQ ID NO: 138 - DNA, 1409 bp, Glycine max
  CDS (26)..(1129)
gaagaagagagagacagacagaacaatgggggaagcaaagggaaaggaagaagaagtgttagcctcagttcactcaaccgtgttcaaagaatcagaaagccttgatggaaagtgtgttaagattgagggctatgatttcaaccgcggcgtcaattatccgttgctactcagctccatggtcacaactgggtttcaagcttccaacctcggtgatgccatccaagtcgttaatcaaatgctagattggaggctagttgatgaacccgtagctgaggattgcagtgaccaagagagggatttggagtaccgaaaatctgtgacgtgtaaagtgtttctgggtttcacttctaatcttatttcttctggtgttagagatactgtgaggtttcttcttcagcatcgcatggttgatgtagttgttacaactacaggtggcattgaagaagatcttataaagtgcctggcaccaacatataaaggagatttctctttgcctggagcatatctgcgctcaaaagggttgaatcggattggtaatttattggtcccgaatgacaactattgcaaatttgaggactggattattcctatctttgatcagatgttgggggaacaaaataatgagaatgtgttgtggacaccatctaagttaatagctcgattgggaaaagaaataaaaaatgaaagctcttacctttactgggcatacaagaacaacattccagttttctgtccgggcttaactgatggctcattgggggacatgctgtacttccattccttccgcaatcctggtctgattgtggacatagtgcaagatataagggcaatgaacggtgaagcagtacatgcaagtcccaggaagaccggaatgataattttaggaggtggccttccaaaacatcacatttgcaatgccaatatgatgcgcaatggtgcagactatgctgtttttatcaatactgcacaagaatatgatgggagtgattctggagctcgtccagatgaagctgtttcatggggaaagatacgagactctgctcagactgttaaggtacactgtgatgcaacaatagcatttcctctgctggttgctgaaacgtttgcttcaaaagtgaaacctccccattgatgaaggttaaagatgaatttactctgaagttcattttaattgtgtgtgtttgaggatcttgatggacaagttcggcattggtgttcaatttgactatcatttgattcctaagctcctcttagcagtggagacctttttgaccattcaaaggtaatccattaatcctgtcagtgaggaagtcaggaattatagatgtgaggatcattgtactaatatctttagggaaaataaggctaagaaaactaactgatcatatatggcatttttaatattttcc

SEQ ID NO: 139 - DNA, 1505 bp, Zea mays
  CDS (54)..(1163)
aggctgctgtctcacggctgcggctgcggcggttcgggctccagactccagggatggccgccggtgcgggaggcggcgaactggaggcgctggagggcgtgcgctccatcgtgctcaagccgtcggagtcgctcgacgagtcgcgtttcacgaggatcgccggcgccgacttcaacgacccggccatcggactccaggggctgctcgcctcgctcgcgtccaccgggttccaggcatccaacctcggcgacgccatcgacgtcgtcaaccagatgttagactggaggttgtcgcatgagaagcccagcgaggattgtgatgaagctgaacttgaccctaaatatagagcatctgtgaagtgcaagatatttctgggcttcacctcgaacctcgtgtcttctggcatccgggatataatccgttttctagctcagcatcacatggtggatgttattgttacaagtgctgggggtatagaggaggatctcattaaatgccttgcaccaacttacagaggcgatttttctttacctggagcactgctgcggtcaaaaggactgaaccggataggaaatctgttggtgcccaatgacaactattgcaagtttgagaactggatcatgccactcttcgaccagatgctacaggagcaatctactgagaatgtttggacaccgtcgaaggtgatagcgcgccttggcaaagaaataaatgatgaaagctcctatctttattgggcatacaagaataacatccctgtatactgcccagcattgactgatggatcacttggagacatgctgttctgtcatgcagttcgtaatcctggccttattattgacattgtacaagatatacggctgatgaatggggaagccatccatgcaacaccaaggaagacagggattatagttcttggtggaggccttccaaagcatcatatatgcaatgccaatatgttccgcaatggtgcagattatgctgtctatattaacacggctcaagagtttgatggtagcgattctggagcacaccccgatgaagcagtctcatggggcaagatcaagggttcagcaaaacctgtaaaggtgcattgcgatgcaagtatcgctttcccgcttcttgttgcagcaacatttgcacgtaaggttcataactccaaatgaacagactgaatcggattcggtggagtgaatgggcaacagaattttgttgaactctccaaatgaccttttggagcacgaggtctacttcacctgcacagggatcatgtgcaagttttttcggtgactcgcggcaaccacatgccatcattattcgatgttcacttgatgctgtactagctggttgatagcatttttgttacaactgataatttattgaaatacagacatacgattgttcatccgagtcgtctgcttacgaattttttgtagacgaaacatctgcttacgaaattgacaaatggcctgttttatgaacacattttttttcacctgaaaaaa

SEQ ID NO: 140 - DNA, 820 bp, Zea mays
  CDS (85)..(564)
cccacgcgtccgtccccatccgcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagccttcttacttcagatggcaacactaaggatgatcttagactcccaactgatgagactcttgtggcccagatcaaggaagggtttgaaagcggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatggcaaacacaagtgcagggatcgctgggtgttgcaccgtgtctgcattatgtggttacattctggaccctgtattttctatgcttttatgcccctactgtttagtattaattatcaataaatttgtttgggacggttgaattgcaaaaa

SEQ ID NO: 141 - DNA, 1223 bp, Zea mays
  CDS (61)..(966)
ccacgcgtccgggtgaagccgccgccgctgcagtgtccatagccaccgcaggagactgagatggggggttttgtcaagacccacaagaccaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggacttctctgttgagccagctgatgagaggaggcctttccgtgctctcttggatgttggccttattaggactacaactgggaaccgtgtctttggtgccctcaagggagctttggatggtggactggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgatgacatggaagctctgtacaagaaggtccatgctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcagatgacgacgatgaggatgacgagtaaagtttggtcccatcgaagtagtgctatcttatgcggcgatcagtatttgtgctatggcatttatcgctacctgtagtcgtgcaacatgcatttttgtttaagtttgtcgatgcgaacaaagttgtttctgttagtttggagctggagttctgaatatttacttttataatattaaaattggcccgagttgaacaaaaaaaaaaaaaaaaaaaaaaaaaaaaaaaaaaaaaaaaaaaaaaaaaaaaaaaaaaaaa

SEQ ID NO: 142 - DNA, 1206 bp, Oryza sativa
  CDS (80)..(991)
cttctcccaccttctcccttctcctcgctcttccccctccgccgccgccgcagcggagcagcaacagcaggcgagcgacatgggagggtttgtcaagacccagaagacccatgcctacttcaagcgtttccaagtcaagttcaagagacggaggcagggcaagactgactacagggccaggattaggctcaccaaccaagataagaacaagtacaacacaccgaagtaccgctttgttgtgagatttacaaacaaagatatcacagctcaaattgtctatgctaccattgcgggtgatatcgtgatggctgctgcctactcccatgagctgcctcgttatggtcttgaagttggtctcaccaactatgcggcagcttactgcactggcttgcttctggctcgccgtgtgctcacgctccgtggtttggaccaggagtacgagggcaatgttgaggccactggggaggactactatgttgaaccagctgatgaaaggaggcctttccgtgctctcttggatgttggcctcattaggacaaccactggaaaccgtgtctttggtgccctcaagggagctttggatggtggtcttgacattcctcacagtgacaagaggtttgctgggttcaagaaggacgagaagcagcttgattctgatattcaccgcaagtacatctacggtgggcacgtggctgactacatgaggtctatggctgaggaggaacctgagaaattccaagcccactttagtgagtacctcaagaagggaattgacgctgatggcatggaatcactgtacaagaaggtccatgctgccatccgcgctgatcctaccatggccaaatcgaccaagaaggaaccggctacccacaagagatacaacctcaagaagctaacctacgagcagaggaaggccagtctcgtcgaaagattgaatgctctcaactcctcagctggtgctgatgatgatgacgaggaagaggatgacgagtgagagagtagccttatcacagtagtttcatcttatgctgccaaacaaactccttatggcatttaagtttacctgtagtcttgcaatttgcaacaggcatttttgtttatgttctgcactctgctcaaagaacctatttctttcggtttttgattctcaaccttgagctatcggttatcttatttatgtgagaagctgccgtttggataaaaaaa

SEQ ID NO: 143 - DNA, 1223 bp, Zea mays; identical to SEQ ID NO: 141
  CDS (61)..(966)

SEQ ID NO: 144 - DNA, 917 bp, Zea mays
  CDS (8)..(871)
caacaatatgggttttgttaagttgattaagactaaggcatacttcaagcgctaccaagtcaagttccgccgcaggagagagggcaaaactgactacagacaacgtacaagacttatcacccaagataagaacaagtacaacactccaaagtacagactcgttgtcagaaagaccaacaagaacatcatcgcccaaatcatctacgctaccgttcaaggcgatcgtgttgtgaacgctgcctactcctctgagctcccaaagttcggaatcaagctcggtctcaccaactacgcttccgcttacgctaccggtctcttggttgccagaagacacctcaccaagatcggtcttgccagcaagtaccaaggaaaggttgaagccgacggtaacgactacaccgtcgaaccagctgaaggaccacgcccattcaaggcccttctcgacatcggtctcgctcgtaccagcactggagctcgtatcttcgctgttgccaagggtgctctcgatggtggtattaacatcccacacagcgtcaagcgcttcgccggctacaacgctgaaaccaagaagcacaaccccgaggtcctcaagaagtacatctacggacaacacgttgccgaatacatgaagaagctccaaaaggaggagccacaagcctacgaaaagcaattctcccgcttcgtaaaggccggagtcaaggctggtgacattgaaggaatctacaagaacgcccacaaggctatccgcgctgacccaacaaagaaggccaacgagaagaaggcagtcgaacacaagagatacaaccccaagagacttacacacgcccaacgtgctgaacgtgttgctaagaagaaggccatcttgggactctaaatgtcttttcttaacttacaatataaaacctatgaacaaaaaa

SEQ ID NO: 145 - DNA, 1601 bp, Agrobacterium tumefaciens
  CDS (24)..(1562)
gactgcgaatattcttatctcccatgctgcccaaagtcgcacgtgcccatgtgtgtccgccgagtcctcgatgtggtgaggatttaggtaaggtacctggaactaacccctccagtcgctattccggccaaccgggaaatgcgaggacatatgaagcaacgacggtgcgggcctttctggttctctgccggctttccatcagccggggtactgaagaggcacaccatcattgcctgaagtgcggtcgggtcattccctccaatcgatggcagacaaagccgaatgatgctctggcagggcatcgttcacattcgcgccttgagcgtatgctatcgattctgcgcctccaccggctgattcgaatgcatatctcgagcgtcctttgtcctccggattctgccggagtcggttttatagggaatatatcgatgacgactgcacgcattctcgacttcatcaagacccgacgtcccgaaggcccttgcctcgtggttgatctcgacgtcgtgcgcgacaatttcaacgcgttccggcattccctgccgaacagcgcgatctattatgccgtcaaggcaaacccggctcccgaaatcctgaagctgctcgcttcgctcggctccaacttcgattgcgcctccgtggctgaaatccagatggcgctcgatgccggtgcaacgtccgaccggatttccttcggcaacaccatcaagaaggaacgcgacgtcgcccgtgctcacgcgctcggcatcgatctcttcgccgttgatagccatgaggaagtcgagaaggttgcccgtgccgcccccggcgcgcgtgtgttctgccgcgtgctgacggatggcgaaggtgctgaatggcctctgtcgcgcaagttcggctgcgtgccgcagatggctgtcgatgttctggtttatgcgcatcagatgggtctggaatcctacggcgtttccttccatgtcggttcgcagatgatgaatctcgacgcatgggatgcagcacttgccgatgccaagcgcgtctttgcgtcgcttgccaagcagggcatccacctgcagatggtcaacatgggcggtggtttcccgaccaagtacctgcgcgacgttccggctgccgaagaatacggccaggcgattgacacggcgctgcgcaagcactttggcaaccagatcccgaagacgatcatcgagccgggccgcggcatggtcggcaatgccggcgtcatcaaggcggaagtcgttctcgtgtcgaagaagtccgacaacgacaaccaccgctgggtgttcctcgacatcggcaagttcggcggtctcgccgagacgatggacgaggcaatccgttacccgatccgcaccgagcgtgatcaggacgagatgcagccctgcgttctggccggcccgacctgcgacagcgccgacgtgctgtatgaaaagaacatgtatccgctgccggtctcgctgaccatcggcgatgaagttctgatcgaaggcacgggtgcttacacgacgacctattcggcggttgcctttaatggcttcgagccgctgaaggcttacgtcatctaggcatcgggccgaaaagtgtaacgcggttttcggaaaacc

SEQ ID NO: 146 - DNA, 804 bp, Oryza sativa
  CDS (108)..(527)
gcaaacgtgtcgcccattctacaccgtctccatccatctcatctcgtcgtcttcccccccgcgagtccgcgaccccccgcgctataaaatccaaggccgcgatcgagatgcggaaatatcgagtcgccggattggtagccgccctgctcgtgctgcattcgctagccacgccgtccgctcaggccgaggcgcatcgcgcagggggagaaggggaggagaagatgtcgagcgacggagggccggtgcttggcggcgtcgagccggtggggaacgagaacgacctccacctcgtcgacctcgcccgcttcgccgtcaccgagcacaacaagaaggccaattctctgctggagttcgagaagcttgtgagtgtgaagcagcaagttgtcgctggcactttgtactatttcacaattgaggtgaaggaaggggatgccaagaagctctatgaagctaaggtctgggagaaaccatggatggacttcaaggagctccaggagttcaagcctgtcgatgccagtgcaaatgcctaaggcccatctcgtatcctatgtgtatcaagttatcaagaagatggggaataatatggtgtggatatagctattggacatgttaattatccacatgataatatggcttggatataaggatctcacacgataatatggcttggatatatagctattaaagattttacctatggcatatttcaatgtgtattagtactaagtaagaatgattgcaaggtgtattaactacaaatattgcaataaaagtccctgttactacaacttacaagtaaaaaaa

SEQ ID NO: 147 - DNA, 1038 bp, Oryza sativa
  CDS (18)..(767)
cgaagggaaagtttgggatgcgcgttgctgcgacgacgcggcccgcctcctcctccgccgccgctccgctccccctcttcctcctcctcgccgtcgccgccgccgccgccgccctgttcctcgtcggctccgcgtccctcgccatggccggccacgtcctcggcggcgcgcacgacgccccctccgccgccaacagcgtcgagaccgacgcgctcgcccgcttcgccgtcgacgagcacaacaagcgcgagaacgcgctgctggagttcgtgcgggtggtggaggcgaaggagcaggtggtggccggcacgctgcaccacctcacgctcgaggccctcgaggcggggaggaagaaggtgtacgaggccaaggtctgggtcaagccgtggctcgatttcaaggagctccaggagttccgcaacactggggatgcaaccaccttcaccaacgccgacctcggcgccaagaaaggtggacatgagcctgggtggcgtgatgttccagtacatgatcctgtagtcaaagatgctgcagaccatgctgtgaaatcaatccagcagaggtcaaactccctgtttccatatgaacttctcgagatcgttcgtgcaaaggcagaggttgttgaagacttcgtaaagtttgacattctgatgaaacttaagaggggaaacaaggaggagaagttcaaagccgaggtccacaagaaccttgaaggggcatttgtactgaaccagatgcaacaagagcatgatgaatcgagcagccagtgaaccttgccacattaagctgtagttatgtagtttgtgttcaataagaaaacagtgaacatgcacccttccgtttctatcgggacataggctggaacttgttcctaacatcgatgaaaagaagacactacactatccttttgttcctgttgctcttagtgtgataatacgatactggtcgtgtaacttctcaagggaaccgtgggtctatgccatacagcttgtgaatgtgaaatcctatgttgatacttctcaaaaaaaaaaaaaaaaa

SEQ ID NO: 148 - DNA, 756 bp, Sorghum bicolor
  CDS (135)..(461)
cgcgatctagaggagcaacaaccattcggcggtgcaagtgctactcctgctccttcccactagcggtagtgcccgtcgtctcgccgccgcctcctctccctccgggctcccgccgccggaccgcgtcgtcagcgatggccgaggcacacagcgggcggcgcgtggggatggtaggcgacgtccgggacgcgccggagggccacgagaacgacctcgaggccatcgagctcgcgcgcttcgccgtcgacgagcacaacagcaagaccaacgcgatgctggagttcgagaggctggtgaaggtgaggcaccaggtggtggccgggaccatgcaccacttcaccgtccaggtgaaggaggccggcggcggcaagaagctgtacgaggccaaggtgtgggagaaggtgtgggagaacttcaagcagctgcagagcttccagccggtcggggacgccgcggtcgcctgaggtagtgaaggtatcatcttccagtgccatgatgtgtttttcccctcgaggctcacaagcttttggctgggggctggagcacaagaatgaaagaatttagccgtcggacatggaatacatcccccactgggaaagtatatatgatatgatgaataaaccagcatcttaccacatgtattgtacgctgtatgaaatatcgactcctgtaatggaatgagctgtgctaagaaaaaaaaaaaaaaaaaaaaaaaaaaaaaaaaaaaaaaaaaaaaaaaaaaaaaaaaaaaaaaac

SEQ ID NO: 149 - DNA, 3317 bp, Zea mays
  CDS (113)..(3061)
ccacgcgtccgcccacgcgtccgcccacgcgtccgcccattctctcacacccaacacccagctatcacaccctgatccccgaggccgcgcgtcggggtgaggaggaggggccatgatggagtcggcggcggcccagtcctgcgcggcgtgcggggacgacgcgcgcgctgcctgccgcgcgtgcagctacgcgctctgcagggcgtgcctcgacgaggacgccgccgagggccgcaccacatgcgcgcgctgcggaggggactacgccgctatcaacccagcgcgcgccagcgagggaaccgaggcggaggaggaggtggtggagaaccaccacaccgccggtggcctgcgtgagagggtcaccatgggcagccacctcaatgatcgccaggatgaagtaagccacgccaggaccatgagcagcttgtcgggaattggtagtgaattgaatgatgaatctggtaagcccatctggaagaacagggtggagagttggaaggaaaagaagaatgagaagaaagcctcggccaaaaagactgcagctaaagcacagcctccgcctgtcgaagaacagatcatggatgaaaaagacttgacagatgcatatgagccactctcccgggtcatcccaatatcaaagaacaagctcacaccttacagagcagtgatcattatgcggttaattgttcttgggctcttctttcactaccgtatcaccaatcctgttaacagtgcctttggtctctggatgacatcagttatatgtgagatctggtttggtttctcctggatattggatcaattcccgaagtggtatcctatcaatcgtgagacttatgttgataggctgattgcacgatatggagatggtgaagaatctgggttagcacctgtagatttctttgtcagtacagtggatccattgaaagagcctccactaatcactgcaaacactgtgctgtctattcttgctgtggactatcccgttgagaagatctcatgctatgtatctgatgatggttctgctatgctcacatttgaatcgctcgcagagactgcagaatatgctagaaagtgggtgccgttttgcaagaagtacgccattgagccacgagctcctgagttctacttctcacagaaaattgactacttgaaggacaagatacacccatcttttgtcaaggagcgtagggctatgaagagagactatgaagagtacaaggtgaggataaatgctttggttgccaaggctcaaaagacacctgatgaaggctggatcatgcaagacggtacaccatggcctgggaacaatcctcgtgaccaccctggcatgatccaggttttcctgggtgagactggtgcacgggactttgatggaaatgaacttcctcggttagtgtatgtgtcaagagagaaaagaccaggctaccaacaccacaagaaggcaggggctatgaatgctctggtccgagtgtctgctgttctgacaaatgccccttacattcttaatcttgattgtgatcactatgttaacaacagcaaagctgttcgtgaagcaatgtgcttcatgatggaccctactgttggcagagatgtctgctatgtacaattcccccagaggttcgatggcattgatcgcagtgatcgatatgccaataggaacgttgtgttctttgatgttaatatgaaaggacttgatggcctccaaggcccagtttatgtgggaactggttgttgtttcaataggcaagcactttatggttatgggcctccatctctgcccgcacttccaaagtcttcgatttgttcctggtgttgctgctgctgtcccaagaaaaaggttgaaagaagtgagagggaaatcaacagagactctcggcgagaagacctcgagtctgccatttttaaccttcgcgaaattgacaactacgatgagtacgagaggtccatgctcatctctcagatgagcttcgagaagtcttttgggctgtcctcggtctttattgaatcgacccttatggagaatgggggcgtccctgaatctgcaaacccatctaccctaattaaagaagccattcatgtcattagctgtggatatgaagagaaaactgaatggggaaaagagattggctggatctatggttcagttacagaggatattctgactgggtttaagatgcactgccgtggctggagatccatctactgcatgccggtgagacctgcattcaagggatcagccccaatcaatctttccgatcgtcttcaccaagttctccggtgggctcttggttctgtcgagatcttcttcagtcggcactgcccgctgtggtacggttacggtggcggccgtctgaaatggctccagaggctctcctacatcaacaccatcgtgtacccgttcacttctcttcctctcgttgcctactgttgcctgcctgccatttgcctgctcacaggaaagttcattatacctacgctgtccaacgctgcaacgatatggtttcttggcctcttcatgtccatcatcgtgacgagcgtgttggagctgcggtggagtggcatcgggatcgaggactggtggcgcaacgagcagttctgggtcatcggaggcgtgtccgcgcacctgttcgccgtgttccagggtatcctcaagatgattgccgggctggacaccaacttcacggtcacggcaaaggccacggacgacactgagttcggggagctgtacctgttcaagtggacgacggtgctgatcccgcccacaagcatcctggtgctgaacctggtgggcgtggtggctgggttctcggccgcgctcaacagcggctacgagtcctggggcccgctcttcggtaaggtgttcttcgccatgtgggtgatcatgcacctgtacccgttcctcaagggtctcatgggccgccagaaccgcacgccgaccatcgtggtgctctggtccgtcctcctcgcctccgtcttctccctcctgtgggtcaagatcgacccattcgttggaggaaccgagaccgtcaacaccaacaactgcaacacgatcatctgctgattcaccatcggtcagctgctgtcgtgccgcggcggacgtgtttctggtgttgcaaacgtgggttgcctgcctgatgcgggtctcctctgtctatctcgcatctgggcttttgccccaggatctgaagcgggtggtgtaggttagctttattttgcgtccaagtgttgattgatgttgtctgtgttatgaaaagttttggtggtgaaacctgaaatgttaaaattcggctcaaaaaaaaaaaaaaaaaaaaaag

SEQ ID NO: 150 - DNA, 1900 bp, Glycine max
  CDS (138)..(1496)
attcggctcgagcttctttgtctctcatctgtctgaggatttttccatcttagttcctggaggcaccaggaacctgacccaataaacaaacccttttttttctttctaatttttctaaagtttcattttttaatccaatggcaacttgggtattatcagaatgtagcttgaagcctcttgctccagtaatccctagacctagaactggggcagttttgtccagcacctcaaaggttggatttttggagacaaacaaggtattggaaggttctaagtttcaacctttgaggtgtaaccttagggagaggaattgggggttaaaagtgagtgtccctttgaggattgcttccattgaagaggaggagcaaaagagtgtcgatgtaatcaatgggagtaatggggttgagcatgagaagcttccagaatttgaccctggtgctccaccaccattcaacttagctgatattagagcagcaattccaaagcattgctgggtgaaggaccctttgaagtccatgagctatgtggtgagggatgtcattgctgtctttggtttggcttctgctgctgcttatctcaataattggttggtttggcctctctattgggctgctcaaggcactatgttctgggctctgtttgttcttggtcatgattgtggtcatgggagcttttcaaacaaccccaaattgaacagtgttgttgggcatctgctgcattcttcaattctagtgccatatcatggatggagaatcagtcataggactcatcaccaacatcatggtcatgttgaaaatgatgaatcatggcatccgttgcctgaaaaattgttcagaagcttggacactgtaacacgtatgttaagattcacagcaccttttccacttcttgcatatcccgtgtacctttggggtaggagtcctggcaagactggttctcactttgaccctagcagtgacttgttcgttcccaatgaaagaaaagatgttattacttccacagcttgttgggctgctatgttgggattgcttgttggattggggtttgtaatgggtccaattcaacttcttaagctttatggtgttccctatgttatattcgtcatgtggttggatttggtgacttatttgcaccatcatggccatgaagacaaattgccttggtatcgtggaaaggaatggagctaccttaggggtggtctaactactcttgatcgtgattatggattgatcaataacattcaccatgacattggaactcatgtcattcatcacctatttcctcaaattccacactatcacttagttgaggctactgaggcagctaagccagtgtttggaaaatattatagagaaccaaagaaatcatctcctcttccttttcaccttattggggaattaataaagagcttcaagactgaccattttgttagtgacaagggggatgttgtgtactatcaaactgactctgagattaatggctcgtccaaatcagagtgaagattaaaattcttttttatatagacaagagagacttatacacaattcttattgctctaaagattgtcttgagtttcttacttagagttgaatccgtcattaataaagggatagatggacggatcatataatttcaattgtaactacatgatataatgtttaggttatatgtagtttatcattcttgaacagtgaatcctctgtataaattgattatattgaagtggtaccttgagtcatgatcaaattgttaatgtatttgatcagaactgaaagacctcgattaaatagtaatttaaaataaattgttttatagaatgttgcggtgttttcttaccagttaccatcccctatttaatttatatactccctattttattcttcaaaaaaaaaaaaaaagg

SEQ ID NO: 151 - DNA, 1662 bp, Arabidopsis thaliana
  CDS (132)..(1472)
gcaaagtagaaaacacaagtttctctcacacacattatctctttctctattaccaccactcattcataacagaaacccaccaaaaaataaaaagagagacttttcactctggggagagagctcaagttctaatggcgaacttggtcttatcagaatgtggtatacgacctctccccagaatctacacaacacccagatccaatttcctctccaacaacaacaaattcagaccatcactttcttcttcttcttacaaaacatcatcatctcctctgtcttttggtctgaattcacgagatgggttcacgaggaattgggcgttgaatgtgagcacaccattaacgacaccaatatttgaggagtctccattggaggaagataataaacagagattcgatccaggtgcgcctcctccgttcaatttagctgatattagagcagctatacctaagcattgttgggttaagaatccatggaagtctttgagttatgtcgtcagagacgtcgctatcgtctttgcattggctgctggagctgcttacctcaacaattggattgtttggcctctctattggctcgctcaaggaaccatgttttgggctctctttgttcttggtcatgactgtggacatggtagtttctcaaatgatccgaagttgaacagtgtggtcggtcatcttcttcattcctcaattctggtcccataccatggctggagaattagtcacagaactcaccaccagaaccatggacatgttgagaatgacgaatcttggcatcctatgtctgagaaaatctacaatactttggacaagccgactagattctttagatttacactgcctctcgtgatgcttgcataccctttctacttgtgggctcgaagtccggggaaaaagggttctcattaccatccagacagtgacttgttcctccctaaagagagaaaggatgtcctcacttctactgcttgttggactgcaatggctgctctgcttgtttgtctcaacttcacaatcggtccaattcaaatgctcaaactttatggaattccttactggataaatgtaatgtggttggactttgtgacttacctgcatcaccatggtcatgaagataagcttccttggtaccgtggcaaggagtggagttacctgagaggaggacttacaacattggatcgtgactacggattgatcaataacatccatcatgatattggaactcatgtgatacatcatcttttcccgcagatcccacattatcatctagtagaagcaacagaagcagctaaaccagtattagggaagtattacagggagcctgataagtctggaccgttgccattacatttactggaaattctagcgaaaagtataaaagaagatcattacgtgagcgacgaaggagaagttgtatactataaagcagatccaaatctctatggagaggtcaaagtaagagcagattgaaatgaagcaggcttgagattgaagttttttctatttcagaccagctgattttttgcttactgtatcaatttattgtgtcacccaccagagagttagtatctctgaatacgatcgatcagatggaaacaacaaatttgtttgcgatactgaagctatatataccatacattgcattatcttagataaaaaa

SEQ ID NO: 152 - DNA, 1525 bp, Arabidopsis thaliana
  CDS (61)..(1368)
agagagtgcaaatagaacgacagagactttttcctcttttcttcttgggaagaggctccaatggcgagctcggttttatcagaatgtggttttagacctctccccagattctaccctaaacacacaacctcttttgcctctaaccctaaacccactttcaaattcaatccaccacttaaacctccttcttctcttctcaattcccgatatggattctactctaaaaccaggaactgggcattgaatgtggcaacacctttaacaactcttcagtctccatccgaggaagacacggagagattcgacccaggtgcgcctcctcccttcaatttggcggatataagagcagccatacctaagcattgttgggttaagaatccatggatgtctatgagttatgttgtcagagatgttgctatcgtctttggattggctgctgttgctgcttacttcaacaattggcttctctggcctctctactggttcgctcaaggaaccatgttctgggctctctttgtccttggccatgactgcggacatggtagcttctcgaatgatccgaggctgaacagtgtggctggtcatcttcttcattcctcaattctggtcccttaccatggctggaggattagccacagaactcaccaccagaaccatggtcatgtcgagaatgacgaatcatggcatcctttgcctgaaagcatctacaagaatttggaaaagacgactcaaatgtttaggtttacactgccttttccaatgctcgcataccctttctacttgtggaacagaagtccagggaaacaaggttctcattatcatccggacagtgacttgtttcttccaaaagagaagaaagatgttctgacatcaactgcctgttggactgcaatggctgctttgcttgtttgtctcaactttgtcatgggtccaatccagatgctcaaactatatggcatcccttattggatatttgtaatgtggttggacttcgtcacttacttgcaccaccatggacatgaagacaagctcccttggtatcgtggaaaggaatggagttacctgagaggagggctcacaacattagatcgtgactacggatggatcaataacatccaccacgatattggaactcatgtgatacatcatcttttcccgcagatcccacattatcatctagtagaagcaacagaagcagctaaaccagtactaggaaagtactacagagaaccgaaaaactctggacctctgccacttcacttactgggaagcctcataaagagtatgaaacaagaccatttcgtaagcgatacaggagatgtcgtgtactatgaggcagatccaaaactcaatggacaaagaacatgaggacatactgcagtgaaccaggcagacaagttacataaattcatcttggcccattcattatgttctttttgttttggtgtaaagccttttcgagattaaaaaagcattaatttgtagaaacctgtggtaaaactctcgatcaaatgaaataagatat

SEQ ID NO: 153 - DNA, 2001 bp, Synechocystis sp. PCC 6803
  CDS (643)..(1719)
ccatccttgggcaggattagtgttttggtgggcggccctagaaagacaggtacgggtggatggtcaagtggaaaaaattgatccggcagaatccgatgcctattttcagtcccgtccccggggttctcaattgggggcctgggcttctccccaaagtcggattgttggcgatcgccaggagttagaagacaatctagcccgttgggaaaaacaatacgaaaaccaatccattccccgccccccccactggggaggatttcgagtgattccccatcgcatcgaattttggcaaggccgccctagtcgtctccatgaccgtttgcaatttaatttgcttgatggtcaatggcacagacagaggttggcgccgtagaagttaaactagcccccattccattgcagtcttaaagttttgacgttttagtccataaagttgatcagagttgcgtatttataaacatttgaactttttatcgtcctttctctacacaaatttgaatcaagtattctccttagtgtgttttctgtcttagtcaaaattggtcttactgccgaattttcatcttccaacggcagccttctttgaagatttaggatagaatcataggattgttttgccgtcatagcccctaagataaatacatgcgtctagaaatttcatcgcctcaaacaaagcttccttaccccaaaactgaagaattaccatttaccctccaagagctcagaaacgctattccagcggattgttttgagccatcggtagtccggtccttgggctacttttttttggatgttggtttaattgccgggttttatgctctagcggcctaccttgattcctggttcttctatccgattttttggttaattcagggaaccctattctggtccctgtttgtggtgggccatgattgtggccatggctccttttccaaatccaaaacccttaataattggattggtcatctcagccacacgccaattttggtgccttaccatggctggcgtattagtcatcgtactcaccatgccaacacgggcaatatcgacaccgacgaaagttggtatccagtgtcggagcaaaaatataaccaaatggcctggtatgaaaaacttctacgtttttacttgcctctgatcgcctaccccatttatctatttcggcgatcgccaaaccggcaaggctcccatttcatgcccggcagtcccctattccgtcccggagaaaaagcagctgttctcaccagcacctttgcccttgcagcctttgtcggcttccttggctttttaacttggcaatttggctggctatttttgctgaaattttatgttgccccctacctcgtgtttgtggtgtggttagatttggtcacatttttacatcacactgaagacaatatcccttggtatcgtggtgatgactggtattttctcaaaggtgccctctccaccattgatcgggattacggcttcattaaccccattcaccatgacattggcacccacgtcgcccaccatattttctcgaatatgccccactacaagttacgccgggcgactgaagccatcaagcccattttaggggaatattatcgatattctgacgagccaatttggcaagctttttttaagtcctactgggcttgccattttgttcctaatcaaggttcaggggtctattaccaatccccatccaatggtggatatcaaaagaaaccttaattgatcctaattgaatcaaaccaacatcgggagggaaggcaatattagatggtattactcccttccgatcgccttatgagaagtatggaagaagttaaacaatcacactccaaaagatcagcattaaaccaacaacggtgctgtggtgaggcagaagattgaaaaaggattgtttacctaactgttgactgagaaaaatcgaccaaagtaccccggccaaaagcagcataccttgcaaaaaggcgatcgccgctggatccgccaccaacatcggtaaat

SEQ ID NO: 154 - DNA, 945 bp, Zea mays
  CDS (3)..(758)
agatgatgcttagggtttccgcgtctccggccgccgcggtggccaaccatctctctggtggggccgcggcgaccacggctcctgccagggtgacggcgcagcgcagcggcgtctcgctgtccgccgccgccgccgccggcaaggggaaggaggtgctcagcggggtggtgttccagcccttcgaggagatcaagggggagctcgccctcgtgccccagtcccccgacaggtcgctcgcgcgccacaagttcgtcgacgactgcgaggcagccatcaacgagcagatcaatgtggagtacaacgcctcgtatgcgtaccactccctcttcgcctacttcgaccgcgacaacgtggccctcaaaggatttgccaagttcttcaaggaatccagcgacgaggagagggagcacgctgaaaagctcatggagtatcagaacaaacgcggaggcagggtgaggctccagtcgattgtggcgcctttgaccgagtttgaccaccccgagaaaggcgatgctctgtacgctatggagctgactctggctctggaaaagctggttaatgagaagctgcacagcctgcatggtgtggcaacaaggtgcaatgatcctcagctgatagacttcatcgagagtgagttcctcgaggagcaggtggaagccataaataaggtctccaagtatgtcgcgcagctgaggagagtgggcaacaaggggcacggggtgtggcactttgatcagatgctgcttcaggaaggggcctgaaggccaacaagggtggcgtggacggagctgagctctgggtggtgtattcttttctttttcttttctttccagttggttagtgttttagttgtagaacggtgttgcgttgcccacatgacatgatggatgttacgtggaggattgtctcttatatttgaacattatattgtcgttcgtttttggc

SEQ ID NO: 155 - DNA, 1213 bp, Zea mays
  CDS (34)..(795)
gcgaacgcacacgcacccacacgacacatccagatgatgcttagggtttccccgtccccggccgccgcggtgccaacccagctctccggtgcgcccgcgacccctgctcccgtcgtcagggtggcggcgccgcgcggagtcgcctcgccgtccgctggcgccgcgtgcagggccgcgggcaaggggaaggaggtgctcagcggggtcgtgttccagcccttcgaggagatcaagggggagctcgccctcgtgccccagtccccagacaagtcgctcgcgcgccacaagttcgtcgatgactgcgaggccgccctcaacgagcagatcaacgtggagtacaacgcctcgtatgcataccactccctcttcgcctatttcgaccgcgacaacgtggctctcaaaggatttgccaagttcttcaaggaatccagcgacgaggagagggagcacgctgaaaagctcatggagtaccagaacaaacgtggaggcagggtgaggctccaatcgattgtgacgcctttaaccgagtttgaccaccctgagaaaggagatgctctgtacgctatggagctggctctggccctggaaaagctggtcaatgaaaagctgcacaacctgcatggtgtggcaacaaggtgcaatgatcctcagctgacagacttcatcgagagtgagttcctcgaggagcaggtggaagccataaacaagatctccaagtatgtcgcccagctgaggagagtgggcaaggggcacggggtgtggcacttcgatcagatgctgcttgaggaagaggcctaaaaagaagaacggacagatgaatgaaggaaacaagtgtgtaatgttgatcaggcggaggaataatgggtcaactgacaactctgggtcggtggatttgtagttggtttgggttttttagttgtagaacggtgttgcccccctcctagagagggatgaacacattatgcatgcgatgtgtcagttcggtcggtgctatgctcgttgggatttgattgtcggaaataaaacatgggtgatgaatgtgtaccctccctaatctatgtcttggtgatgaagttgagaaagccctgcgggtgtaggtggatttgtagagttttttcttcagttggttaggttcgctgttgcctacctcatttgcccctcatcatcgccgtaatttatttatttataatataaaagatccagattttccccc

SEQ ID NO: 156 - DNA, 1001 bp, Escherichia coli
  CDS (245)..(742)
gttccttatgtttgaatacggaattcactttgtcatatcagtgccatcattccgccttccctgtctttctctaaatattttaatcagcgaggggatcttcgctgattaaagaaatagcggtaatgcgttttattcccattcgtatttttaataattgaagtttatattttaccttttgcaaataataaaataacaaattatagtgacgccacagcaacaaatataacctttgtggagcactatcatgctgaaaccagaaatgattgaaaaacttaatgagcagatgaacctggaactgtactcttcactgctttatcagcaaatgagcgcctggtgcagctatcataccttcgaaggtgctgccgcgttcctgcgccgtcacgcccaggaagagatgacgcatatgcagcgtctgtttgattacctgactgataccggcaatttaccgcgtattaataccgttgaatctccgtttgctgaatattcctcacttgatgaattattccaggaaacctataaacacgaacaattaatcacccagaaaattaacgaactggctcatgctgcaatgaccaatcaggactacccaacatttaatttcctgcaatggtatgtttctgagcagcatgaagaagagaaactgttcaaatcgattattgataaattaagcctggcaggcaaaagcggcgaaggtctgtattttatcgacaaagaactctctaccctcgacacacaaaactaatgctctccggcggcaggtttactgccgccgtttcaaatcagtgacggcaaatcttactctgatcggtcgaaaaaccgtctttcgaaggtataaatttgccttttgctgccagaaacgctaccagctctcccgctgtcatcccttctgccgagcaggtgtgaaaacgtgcctgttcaccaaaacgcgctttaatcgcagcttccagactggcatgcgtatattgctcgcctgattcaatcatcatatttaacacttcatg

SEQ ID NO: 157 - DNA, 1304 bp, Emericella nidulans
  CDS (146)..(1186)
caaacaaagggatcgtcgtcctgacttttattttatagtccagagatccgtcttgtctgacatctactgccaaaccacaggtgtctgttcaattgcgctggttgtgccctgatttctgaattctctttccgccgcatactccgcaatgccatctactacaagccgcgctgccttcgaggcggtcttcccctccctggctgaggccatgcttgaccatgcgaggaaatacaacctgccccaaaatgctcaggaatggttcagcaaggccattcacaccaacgtccctggcggcaagctcaaccgcggtctctctgtccccgacaccggcgtggccctcctgcagaaggaactgagcgaggagcaatacaaggaccttgctacacttgggtggctgaccgagctgctccaggccttcttcctcgtcagcgatgaccttatggatggttcaatcacccgtcgcggccagccctgctggtaccgccaccagggggtcggtctcattgccatcaacgacgctttcctccttgagtccggtatctacgttatcctgaagaagcaattccgttcacaccctgcctacgtcgactttattgagctgttccatgagaccacctggcagacggaattgggccagctgtgtgatctgatcacggcgcccgaggacaaggtcgatctcaacaacttctccatggagaagtacatgttcattgtcacctacaagaccgcctactatagcttctacctcccggttgccctggccctccactaccttcagcttgctacccccgagaacctccgtcaggctcacgacatcctcattccgctcggccaatacttccaggtccaggatgactacctcgatgcgtacggcgaccccgaggtcattggcaagatcggaacagatatccaggacaacaagtgctcttggttagtgaaccaggctctgcagcgctgcagtgccgagcagcgcaaggtgctcgacgctgcctatggtcgtaaggacgctgagcaagaggccaaggtcaaggctattttccgggaattggacctcgaatccgtctacaaggagtacgaggagaagatcgtgggtgagctgaagacgaagatcgcggctgtcaacgagtcggaggggttgaagaaggaggtttttgaggcattcctcgggaagatctacaagcgcagtaaataagcgataggcagcatagtatgccattttgagatacctcgcaatagactaaagacattaattcggattccaaaaaaaaaaaaaaaaaaaaaaaaaaaagcggccgctcgagcatgca

SEQ ID NO: 158 - DNA, 1289 bp, Oryza sativa
  CDS (42)..(1103)
ccctcgcatcgcacgtgaggcagtcgagggatagcggcgcaatggcggcggcggtggtggcgaacggcgcgagcggcgactcctccaaggccgcgttcgcggagatatacagcaggctcaaggaggagatgctcgaggacccggccttcgagttcaccgacgagtcgctccagtggatcgaccgcatgctggattacaatgtgctcggaggaaagtgcaaccgcgggatctctgtcattgatagtttcaagatgttgaagggcactgatgttctgaataaggaggagacatttcttgcctgcacccttggttggtgcattgaatggcttcaagcttattttcttgtgcttgatgatattatggacaactctcaaacacgacgtggccagccttgctggtttagggtgcctcaggttgggctcattgctgtaaatgatggtattatccttcgcaaccatatttcacgaattcttcaacgccattttaaaggaaagctgtattatgttgatctcattgatttgttcaatgaggttgagtttaagactgcttcaggtcaattgttggatcttattactactcatgagggagaaaaggatctcacaaagtacaacttgacagttcaccgccgcattgttcagtacaagacagcttactactcattctatcttccggttgcatgtgctttgctgctatctggtgagaatttggataacttcggtgatgttaagaacattcttgtggaaatggggacatacttccaagttcaggatgattatctagattgttatggtgatcctgagtttattggcaagattggaacggacattgaagactacaagtgctcatggttagttgtgcaagctctcgagcgtgctgacgagaaccaaaagcacattctatttgaaaattatgggaagccagatcctgaatgtgttgcaaaagtgaaggatctgtataaagaacttaatctggaggccgtatttcatgaatacgagagggagagttacaataagctgattgccgacatcgaagcacatccgaacaaagcagttcagaatgtattgaaatccttcctgcacaagatctacaagaggcagaagtagagctaagctcatggagaagctgtttcatgtttgcttggtaactagagtcgtggggacaaataactggtaactagaatcatggggactgttccctgatgttgtgtgtattatggttatgttcgtaccgtgtagtacagcgtgctactccgtaaaataatgaagcatggtgctatttatgcgtgcgtg

SEQ ID NO: 159 - DNA, 1569 bp, Zea mays
  CDS (313)..(1377)
attcggctcgagctagagttaaaaaaacacttacagcacgcagttgtcgtcgtcattgtcttcgactcttcgtggcacctcccgtccataaaaataaacgtgtgcccacaaatctgttcgctcgcattggcaactgaaccgcaccaggcaccacagtcccgtgcggcagtggcagacgcacagcagatcagcagcgcctccctctgcggctctgcctcttgccaaagccccccacagaattcttctccctccccgtctcctctcgcgctcgcgcgtggtgaggtgaggtggagttccgaccccgaggccgcaatggcgacagcggaggtggtggtggccaacggctcgggcggcgccgacaccaagaccgcgtttaaggagatatacagcaagctcaagcaggagatgctcgaggaccccgccttcgaattcactgacgagtcgctccagtggatcgaccgcatgttggattacaatgtgcttggaggaaagtgcaatcgtgggctatctgttgtcgatagctacaagattttgaagggtgttgacgttctgagcaaggaggagacatttctggcctgcacccttggctggtgtattgaatggcttcaagcttattttcttgtgcttgatgatattatggacaactcccagacacggcgtggccagccttgctggtttagagtgccacaggttggtctcattgcagtaaatgatgggattatccttcgcaatcatatctcacgaatccttcaacgccacttcaaaggaaagccatattatgttgatatcattgacttgttcaacgaggttgagttcaagacagcttcagggcaaatgttggatcttatcactacccacgagggtgaaaaggatctaactaaatataacttgacagttcaccgccgcatcgttcagtacaagacagcttattattcattctaccttcctgttgcatgtgcattgctgctggctggtgagaacttggaaaactttgttgatgtaaagaacattctcgttgaaatgggaacatactttcaagttcaggatgactatctagattgttttggtgatcctgaattcattggcaagatcggaactgacattgaagactacaaatgttcctggctagttgtgcaagctcttgagcgtgctgctgagaaccaaaagagcattctgtttgaaaattacggaaagtctgatccagcgtgtgttgcaaaggtgaaggacttgtacaaagagcttaaactggaggaggttttccatgagtacgagagggagagttacaacaagctgattgccgacatcgaggcccagccgagcaaggcagtccaaactgttttgaagtccttccttcacaagatctacaagagggacaagtagacccagatcgtcgacaagctgctccatcgacgcttgcatcaatcgaattactatacttgattgatgcggacgagtaatttgtactatgttgttttgtgttttcattctcctgttgtacggtacaccttaatataataaagcacagtggtactagggatgcaaaaaaaaaaaaaaaaaaaaaaaaaaagg

SEQ ID NO: 160 - DNA, 877 bp, Arabidopsis thaliana
  CDS (3)..(803)
cgatgacggcggattctcaatctgattatgcttttcttgagtccatacgacgacacttactaggagaatcggagccgatactcagtgagtcgacagcgagttcggttactcaatcttgtgtaaccggtcagagcattaaaccggtgtacggacgaaaccctagctttagcaaactgtatccttgcttcaccgagagctggggagatttgccgttgaaagaaaacgattctgaggatatgttagtttacggtatcctcaacgacgcctttcacggcggttgggagccgtcttcttcgtcttccgacgaagatcgtagctctttcccgagtgttaagatcgagactccggagagtttcgcggcggtggattctgttccggtcaagaaggagaagacgagtcctgtttcggcggcggtgacggcggcgaagggaaagcattatagaggagtgagacaaaggccgtgggggaaatttgcggcggagattagagacccggcgaagaacggagctagggtttggttaggaacgtttgagacggcggaggacgcggcgttggcttacgacagagctgctttcaggatgcgtggttcccgcgctttgttgaattttccgttgagagttaattcaggagaacccgacccggttcgaatcaagtccaagagatcttctttttcttcttctaacgagaacggagctccgaagaagaggagaacggtggccgccggtggtggaatggataagggattgacggtgaagtgcgaggttgttgaagtggcacgtggcgatcgtttattggttttataattttgatttttctttgttggatgattatatgattcttcaaaaaagaagaacgttaataaaaaaattcgtttatc

SEQ ID NO: 161 - DNA, 726 bp, Arabidopsis thaliana
  CDS (1)..(723)
atggcctcgtcatcatcatcatcttatagattccaatctgggtcttaccctctttcgtcaagtccttctcttgggaatttcgtcgaacgcattaaagacgcttgtcatttccttgtctctgctgttttgggtaccattatctccgcgatcttgaccttcttcttcgcactagtgggcacattgctaggggcacttacaggagctttgataggtcaagaaactgagagtggtttcattagaggagcagcaattggagccatttcgggagctgttttctctatcgaggtctttgaatcatctctggatctctggaaatccgatgagtcgggtttcggatgttttctctacttgattgatgtcattgttagtcttctaagcgggagacttgtacgagagcgcattggtcctgcaatgctaagtgcagtgcaaagtcaaatgggagctgtggatacagcttttgatgatcacacaagcctttttgatacaggaggctcaaaaggattgacaggagaccttgttgagaaaatcccaaagatgacaatcactggcaacaataacactgatgcttctgagaacacagactcatgttctgtttgtcttcaggatttccagctcggtgaaacagttagaagcttgcctcattgtcatcacatgtttcacttaccttgcatagacaattggctccttagacacggttcttgcccgatgtgtagacgtgatatttaa

SEQ ID NO: 162 - DNA, 1225 bp, Triticum sp.
  CDS (65)..(877)
cccacgcgtccgccaagagcgaactgagatcatcctaggaccaggcgcgaccacacaggacaagatgctgctgcttaatccggcgtccgaggcggcggcggcggcgctggacagcatccggcagcagctcctggaggagccaatggcgccggcgcggccggcgtactgccggagcgcgagcttcggcagcctggtggcggaccagtggagcgagtctctcccgttccggcccaacgacgccgacgacatggtcgtctacggtgccctccgcgacgccttctcctgcggctggctccccgacggctccttcgcggccgtcaagcccgagcccctgccctcccccgactcctacgacggctgctgcctcggcagcttcctcgcgtcgccgcccgggctggacgcgccgtgggcggaggaggccgaggtcgcagcgacggcgtcaagggggaagcacttcagaggcgtgaggcagcggccgtggggcaagttcgcggcggagatccgggacccagccaagaacggcgcgcgcgtgtggctcggcaccttcgacagcgccgaggacgccgctgtggcgtacgaccgcgccgcctaccgcatgcgcggctcccgcgcgctcctcaacttcccgctccgcatcggctcggagatcgccgcagccgcgggtcagaagcgtccgtctccccagccagcgagccccgactctcctcctccctcctccagcgcacccgggtcgtcgaagcggagaaagagaggcgaggccgcagcagagtccatgtccatggctctggtgccgcccccgccggtgcaggctccggtccagctgaccctcccagtccagccgtggctcgccaccggcgccgtccagcagctagtgagctgaagcggcgaaagcaacaagtgatcgttctcatgaccgatggccattagttcttccttcatggcttcatgtgttgagcccatggaggaacagagcatcaagatggcgtcaatggcgtaatgcgtcgctcgaagaaaccttgatcagttggaggcaattacgcgccacgccattgtgaaatttgtgtggctccgtgtgaaacttgtcgctagggttagtggcgttggcacagtagcaagtgggtgcagtggaatcccgaagctggtttgtaagaggtggtgagggtgcaggtgcaaaagttgcacagaccttctcctctccaatggagaatcttctttgttaaaaaaa

SEQ ID NO: 163 - DNA, 1047 bp, Arabidopsis thaliana
  CDS (1)..(1044)
atggcctccgaggattgggatctcttcgccgtcgtcagaagctgcagctcttctgtttccaccaccaattcttgtgctggtcatgaagacgacataggaaactgtaaacaacaacaagatcctcctcctcctcctctgtttcaagcttcttcttcttgcaacgagttacaagattcttgcaaaccatttttacccgttactactactactactactacttggtctcctcctcctctacttcctcctcctaaagcctcatcaccatctcccaatatcttactaaaacaagaacaagtacttctcgaatcacaagatcaaaaacctcctcttagtgttagggttttcccaccatccacttcttcttctgtctttgtttttagaggtcaacgcgaccagcttcttcaacaacaatcccaacctccccttcgatctagaaaaagaaagaatcagcaaaaaagaaccatatgtcatgtaacgcaagagaatctttcttctgatttgtgggcttggcgtaaatacggtcaaaaacccatcaaaggctctccttatccaaggaattattacagatgtagtagctcaaaaggatgtttagcacgaaaacaagttgaaagaagtaatttagatcctaatatcttcatcgttacttacaccggagaacacactcatccacgtcctactcaccggaactctctcgccggaagtactcgtaacaaatctcagcccgttaacccggttcctaaaccggacacatctcctttatcggatacagtaaaagaagagattcatctttctccgacgacaccgttgaaaggaaacgatgacgttcaagaaacgaatggagatgaagatatggttggtcaagaagtcaacatggaagaggaagaggaggaagaagaagtggaagaagatgatgaagaagaagaagatgatgatgacgtggatgatcttttgataccaaatttagcggtgagagatcgagatgatttgttcttcgctggaagttttccatcttggtccgccggatccgccggtgacggtggtggatag

SEQ ID NO: 164 - DNA, 750 bp, Arabidopsis thaliana
  CDS (1)..(747)
atggcttgtggcggtgctattatttccgattatgcccctctcgtcaccaaggccaagggccgtaaactcacggctgaggaactctggtcagagctcgatgcttccgccgccgacgacttctggggtttctattccacctccaaactccatcccaccaaccaagttaacgtgaaagaggaggcagtgaagaaggagcaggcaacagagccggggaaacggaggaagaggaagaatgtttatagagggatacgtaagcgtccatggggaaaatgggcggctgagattcgagatccacgaaaaggtgttagagtttggcttggtacgttcaacacggcggaggaagctgccatggcttatgatgttgcggccaagcagatccgtggtgataaagccaagctcaacttcccagatctgcaccatcctcctcctcctaattatactcctccgccgtcatcgccacgatcaaccgatcagcctccggcgaagaaggtctgcgttgtctctcagagtgagagcgagttaagtcagccgagtttcccggtggagtgtataggatttggaaatggggacgagtttcagaacctgagttacggatttgagccggattatgatctgaaacagcagatatcgagcttggaatcgttccttgagctggacggtaacacggcggagcaaccgagtcagcttgatgagtctgtttccgaggtggatatgtggatgcttgatgatgtcattgcgtcgtatgagtag

SEQ ID NO: 165 - DNA, 756 bp, Glycine max
  CDS (1)..(753)
atgtacggacggagtgattcttacgaatccgatttggcgcttctggattcgattcgccgccacttgctgggagagtccgaattgatattcggagccccgaatttcggttcgggtcggagctccagtttcagcagcttggactcgtgtttgagtgatgattggggagagcttccgtttaaggaggacgattcagaagatatggtgttgtacggcgttctccgtgacgcagttaatgtggggtgggtcccatccctcgatgccggctcgcccgagagcgtctcgtcgggttttccggcggtgaagctggagcctgatgtcatgccggcgttgattaatccgtgtccgcctccggcgccggcggtggaggagaagaaggttgttccgccgaaggggaagcactaccgcggcgtgcggcagcggccgtggggaaagttcgcggcggagatcccggacccggcgaagaacggggctagggtttggctggggacgtttgagacggcggaggacgcggcgttggcgtacgaccgcgccgcctaccggatgcgagggtcgagggcgctgctgaattttccgttgagggttaactccggcgagccagatccggtgagggtgacgtcgaagcggtcgtcgtcgccggaaagtatggcggcggcggcgccgaagagaaagaaagttatggtggtggggacggtgcaagagcaagtggggagtcaagtggtggagtgtacacgtggcgaacagttattggttagctga

SEQ ID NO: 166 - DNA, 1801 bp, Saccharomyces cerevisiae
  CDS (33)..(1790)
ttaacaatccaggctgaacaaaacaaggaataatgttacacaggcacggttctaagcagaagaacttcgagaatatcgctggaaaagttgtccacgaccttgcaggtctgcaattgctttctaacgacgttcaaaaatccgctgtccaaagtggtcatcaaggatcgaacaatatgagagatacttcgtctcagggcatggctaataagtattcagttccaaaaaagggactacctgctgatttgtcttaccaactgattcataatgaattaacacttgatggtaatccgcatttgaaccttgccagtttcgtgaacacttttaccactgatcaggcaaggaaattgattgatgaaaatttgaccaaaaatcttgctgacaatgatgaatatccgcaattaattgagctaactcagcgttgtatttctatgctagctcaattatggcacgctaatcccgatgaagaaccaataggctgtgccaccacaggttctagtgaggcaatcatgttgggtggactcgccatgaaaaaaagatgggaacacagaatgaagaatgctggtaaagatgcttccaagccgaacattataatgtcttctgcgtgccaagtggcattagagaagtttacgagatattttgaagtggaatgccgattggttccggtatcccacagaagccatcatatgcttgacccagagtcgttatgggattatgtagatgagaacactattggctgttttgtaattttaggaaccacctacactggccatttggaaaatgtagagaaagttgcagatgtcttgtcccaaattgaggccaagcatcctgattggagcaatactgatattccaatccatgcggatggcgcttcaggtgggtttattatcccatttggctttgaaaaagagcacatgaaagcttatggcatggaacgttgggggttcaaccatccgcgtgtggttagtatgaacactagtggtcataagtttggcttaaccactcccggtctgggttgggtgctatggagagatgaatccttactggctgatgaattgagattcaaactaaagtacctcggtggcgtggaagaaactttcggtttgaatttttcaagacctggatttcaagttgtccatcaatacttcaattttgtttctctaggccattcagggtatagaacacaattccaaaattctctatttgttgcaagagcgttttctttcgaattattgaattcgtcaaaattgcccggatgctttgaaattgttagcagtatccatgaaagcattgagaacgattccgcccctaagtcagttaaagactattgggaacacccccaggcttacaaaccaggtgtaccgctggtagccttcaaattgtccaagaaattccacgaagaatatccagaagtgccacaagcaatcctttcctctttactgagaggtaggggttggataataccaaattacccactaccaaaggcaacggatggatccgatgagaaggaggtattaagagtggttttcagatcggagatgaagttggatttagcacagttgttgatcgttgacatcgagagtatcttgacaaagttgattcatagttacgaaaaggtttgtcatcatatagaacttgcctctgagcaaactccagagcgcaagagttcgttcatctacgaaatgttgctggcattggcatctccacaagatgacatcccaacgccggatgaaatcgaaaagaaaaataagctaaaggaaacaacaacgagaaactatagaggaacatgttgagttgaaaaggt

SEQ ID NO: 167 - DNA, 1883 bp, Oryza sativa
  CDS (77)..(1552)
ctcctcttcctcgtcgccggcgagagctcttcgtcttctccaactcgaccggaagcaagcgcgcttccgatccgccatggtgctctcccacggcgtgtcgggctccgatgagtccgtccactccacgttcgcctcccgctacgtccgcacctccctccccaggttccggatgccggagcagtcgatccccaaggaggcggcgtaccagatcatcaacgacgagctgatgctggacggcaacccgcggctgaacctcgcgtcgttcgtcaccacgtggatggagcccgagtgcgacaagctcatccaggcctccgtcaacaagaactacgtcgacatggacgagtaccccgtcaccaccgaactccagaaccgatgtgtgaacatgattgcacacctcttcaatgctcctctaggggactctgaaacggccgtcggagtcggcactgtcggctcgtctgaggccatcatgctcgccggtttggccttcaagaggaggtggcagaacaagatgaaggcagccggcaagccatgcgacaagcctaacattgtcaccggcgccaatgtccaagtttgctgggagaagttcgcgcgatacttcgaggttgagctcaaggaagtgaagctgagtgacggctactacgtcatggacccagctaaggccgtggatatggtcgacgagaacaccatctgcgtcgcggcgatcctcgggtcgacgctgaacggggagttcgaggacgtgaagctgctcaacgatctgctcaccaagaagaacgctgaaacaggctgggacacgccgatccacgtggacgcggcgagcggcgggttcatcgcgccgttcctgtacccggagctggagtgggacttccggctgccgctggtgaagagcatcaacgtgagcgggcacaagtacggcctcgtctacgccgggatcgggtggtgcatctggaggagcaaggaggatctgcctgaggagctcatcttccacatcaactacctcggcgccgaccagcccaccttcaccctcaacttctccaagggttccagccaggtcattgcacagtattaccaactaatccgcctaggctttgaggggtacaagaacatcatggagaactgccaggagaacgcgatggtgctgaagcaggggctggagaagacggggcggttcaacatcgtgtccaaggacaacggcgtgccgctggtggccttctccctcaaggacagcgcccggcacaacgagttcgagatctccgacttcctccgccgcttcggctggatcgtgccggcctacaccatgccccccgacgcgcagcacgtcaccgtgctccgcgtcgtcatccgcgaggacttcagccgcacgctcgccgagcgcctcgtgctcgacgtcgagaaggtgctgcacgagctcgacgcgctccccgcccgcgtcgtcgccaacggcggcgacgccgccgccgcgtcggcgagcgagagggagatggagaagcagcgcgaggtgatctccctctggaagagggccgtgctggccaagaagaagaccaacggcgtctgctaaagcaagtcagctgcgcagcggggatcgtatactattattatggtccacttcgtaattgcgacttcttaatttttaccgtgtcgatcggtttaccgtctcaagtctgctctcatccgattttcggattgatgctgcttaattatgtaccaagttaattaattcttagaggacggaatagttccgactcaatacgaagcattgcctgtataagtcgaacacgggatcatgcattttacgttgggtgtgtagcagtgaattgatcagtgatgctccatctctaaaaaaaaaaaaaaaaaaaaaaaaaaaaaaaaaaaaaaaaaaaaaaaaa

SEQ ID NO: 168 - DNA, 2091 bp, Zea mays
  CDS (268)..(1761)
gtcgatcgggggcgacaacgatggtggttagcgtggccgcgaccgggcccggcacggacgccgagccggtgagctccaccttcttcgcgtcccgctacgtccgcgacccactcccacgtggcaacttccgtttcagcccgccgcgcggaggccgctggttggccaggggacaccacgccttccattattagagtaccactactccattagtaccagcgtaccaccaccaccgaaaacgaatcccagaacagtaccgcagcggcagccatggtgctctcgcacgcgagctccggccgggacgacgacgacgcggtggcctccaccttcgcgtcgcgctacgtgcgcgagcgcctgccgcggtaccggatgccggagcggtcgatcccgcgggaggcggcgcagcagatcatcagcgacgagctcatgctggacggcaacccgcgcctgaacctggcgtccttcgtcaccacgtggatggagcccgagtgcgacaagctcatcatggactccatcaacaagaactacgtcgacatggacgagtaccccgtcaccactgagctccagaaccgctgcgtaaacatgatagctcacctgttcaacgcgccgatcaaggaggacgagacagctattggggtcggaacagtgggatcctcggaagcgatcatgcttgcaggtctggcgttcaagaggaaatggcagaacaagaggaaggagcaggggaaaccgtgtgacagacccaacatcgtcaccggtgccaacgttcaggtctgctgggagaagtttgcaaggtattttgaggtggagctgaaggaggttaagctatcagaagggtactacgtcatggaccccgtcaaggctgttgagatggtggacgagaacactatctgtgtcgcggcgatcttggggtcgactctcaccggagagttcgaggatgtcaagcagttgaacgaccttcttacagagaagaacaaggaaactgggtgggacgtgcctatccacgtcgacgccgcgagcggagggttcatagcgcctttcctctaccctgagctcgagtgggacttcaggctgcctctggtgaagagcatcaatgtcagcgggcacaagtacggcctcgtctaccctggtgttggctgggtcatctggcggagcaaggatgatctgcctgaggagctcatcttccatatcaactacctggggacggaccagcctacgttcacgctcaacttctccaaaggttcctgtcagatcattgcgcagtactatcaactcattcgtctaggcttcgaggggtacagaaacatcatggagaactgccaggagaacgcggcgatactgcgggagggcatcgcggcgacgggccggttcgacgtcctgtccaaggacgccggggtgccgctggtggccttctcgctcagggacagcagccggttcagcgtgttcgacgtctccgagaacctgcggcggttcggctggatcgtgccggcgtacacgatgccggccgacgcggagcacgtggcggtgctccgagtcgtcgtcagggaggacttcagccgcagcctcgccgaacggctggtctcggacgtccgcaagatcctgcgcgagctggacgcgcgcgcgacccacgccgtgagggtcgccaccgccaccgccgagcagtcgggcgacggcgtcgtggccaagaaaagcgtgctggagatcgagcgggaggtcgccgcgcgctggatgaacgccgtgaacaagaagaagacgggggtctgttgatgcgtcgtgggtcggagactgggaggtttcgccatggtagcttcgtctatatgtcgcgtgcttgtttgtgtctgtgcagggcgcttggatgcgttggtccagttccgcgtatgtgaacaaggtgtcgtatgcagtatgcaaatgttcaggatccaggaaccacaaataatggatgtaaatgttgggtttggtgccgtatgttgggtgtggagtatatttcttcgccaggtatttgctgtaatcctgtccctttacgttcgtgcactgcaatgagaataaaaaaaaataagtgtcgttcacggaaaaaaaataaaaaaaaaaaaaaaaaaa

SEQ ID NO: 169 - DNA, 7421 bp, Oryza sativa
  CDS (4531)..(4851), (5011)..(5139), (6072)..(6560), (6663)..(6722)
gtcgaccgaaaaaatatggaagaatacaatttttagctaaaatttatcatagtttaatacgccgaattgacggcctagtaaatctatatccctttaaaagaaaagaaattagaaataaagtagtgatggtaatagtgaatttgctacttcacctactgcattgaaatttttgcaagttaactcctgaactttttaatattaaaaagatcgaatctaaatgggtagctcctaaaaaaaataaaagtaggatgaatattctctatagcaaaaagtgaaagtacattaatacattattttatctgtagcgagcatggacatttagatggtttctaaaaattatatagtattttgtgtttatcatgattttttcttaggaaaacaacgcttactacacgtactattttcagaatgggctttctttatagaagaaaaataatccatcctttcggaggatcggttgtggtcgttagcaggcattgcttcctttagggatttgttgaaagtgtagcgtggctttgccctctcccgctgattggagtagcgttacctgtcgtacgagttatatttttcttccttggttgttttttttctctccttggtataagttggtctagctaattacattgagtaatatattgacgtataatctttttcgcgttcatgaaaaaattatagaaaaataattttggagcggaaactagtctccgcaggaactctttgatttctgacggactcaacgcctgcgggctgcagcttctccctgctatcctccttcccttttgatatcgggtcgaactttccaggaccggtgctgcgcatgcaagtgatcttctggtttactagatgttcacattttctcctttccagccacggcgaaatgtcagtccatcttcgccggttgactagcaccggtcgccaaacttcaaggaaaccgacgtgcaggattctttcgttgccatgttgtcactcacccgtgccaccatcgcgcagcagaatccttcagcggcaaaccaagaaacgacatcccgttgaaaggtcaggtcaaccgtaatcctcatcacggcatcagtgcatcacctgaggccgacctgctctcccgatccctcgcgaactccccgggaagacgacgaagaccagttacttctacaacgcaaatcgaactatagccgccctgctctgtccaggaagcaacgcgccggcgcgggatgctccactataaaacgcacccgctaatcacatcgacccgccacaccacctatcacagcaacacaagccaaccacaaagaattctcatttccggtaacttttctcaagcctttttggcgctctgagaatcatcacacggaagtcaagcctttgttgttgtcgtgattagtttagtttagtcaccgagatgagctcccgaatggccggagcgacgctgctgcgccacctgggcccccgcctgttcgccgccgagcctgtgtactccgggctcgccgcgagcgccaggggcgtcatgcccgccgccgcgaggattttccccgcgcggatggccagcaccagcagcgccggcgcggacgtcaaagaaggcgcagccgagaagctgccggagccggcggcaacggcggcggcggcggcgaccgacccgcagaacaagaaggccgtcgtgagctactggggcatccagccgccgaagctcgtgaaggaggacggcacggaatggaagtggctcagttttagggtaagcgctcatcaaccattgatgtgtgcgcttctttttttgtttttttgcacggtgaattctcgatttgatcgtgttcatgatgtgtgtttcttttgcattgtgacacagccatgggacacgtacacgtcggacacgtcgatcgacgtgacgaagcaccacgagccgaagggcctcccggacaagctggcgtactggacggtgaggtcgctggcggtgcccagggacctcttcttccagcggcggcacgcgagccacgcgctgctgctggagacggtggccggggtgcccgggatggtgggcggcatgctgctccacctgcgctccctccgccgcttcgagcagagcggcggctggatccgcgcgctgctggaggaggccgagaacgagcggatgcacctgatgaccttcctggaggtgatgcagccacggtggtgggagcgcgccctcgtgctcgccgcgcagggcgtcttcttcaacgcctacttcgtcggctacctcgtctcccccaagttcgcgcaccgcttcgtcggctacctcgaggaggaggccgtgagctcgtacaccgagtacctcaaggacctcgaggccggcaagatcgagaacacgccggcgccggccatcgccatcgactactggcgcctccccgccgacgccacgctcaaggacgtcgtcaccgtcatccgcgccgacgaggcgcaccaccgcgacctcaaccatttcgcatcggtacgcatatgccagcctgaaaacaaccaatctcgcctgcttaatttttgtgtgaacgggtttgagctaaccgatcgcgtttctcgtgttggtacatcacttgtgcaggacatccagcaacaggggatgaagctgaaggatacgcctgcgcctatcgggtatcactgatcatcattcatcaacgggcgatgcctgctcagttcatcaccatcactgctactacatgcgtattttacatcctatttgggataaactttgttctgtgtatatatgtaaataagctattgtcactccgttttatgcctgtacctatatgcatgctgagattatgcaaattgtgaataacaatatagtaagattttttttggagtagaagtatccacgtgttcagaattgcagcaggtaacacttgtcaagatgctctgctgctaacaaaggaagcatggccgttggctgacccgtgcacacaaccaagaccaaacatccagtccaaatgtgtaaaggcaaatggaatctcttttagacaagttcaaataccattcacactaaacttttttctttttctggactcttgatttcaatatgccctcagaaaaaaatcaccaaagaagcacaaacacaatggctcacctgcaattcaccatctgtcttagaaaaatcaactcctaacttgaaaaatcagtcaggattttttttatggaagtaagtgtagaaaaataatttctttaagccattttacattttttaattaaggaggtgccataagttgatataattttaaatgtcgattattttttattcatcccaatattccctctccacttcagtaataaaaagttggtgtgttacatttaatcccttttcttttagtattcattattattggcagacgaagactggaccggtatataccatatagataccatataggcacctcgctgtgaaatgttatcacctatcactgaaaaataaatttgagctcccgtgttaaacttagaacttaaaccgacgaggggatgtccccttagaatccacgcccacgctacgcttgatatttccttttgtgtccattatgcgcatacaagcactggattgttatttcccttgtgtgcgttatatattacgggcgtataaacacttactgagttgtcatgagcgataacaccattgacacgtttgcttattcagattgtggttcatgtggcaagcacgtacgtacaccgccatggaggcactttccaaaagcaacatcccagatgtttctagctgcgtatactagtcgcaattagcaatagagctgtttagtcacgttctggaattgtcagtggttagattaaggatctaataatagaagttgcctaatttgactgccatcctggatggttggagtctttcttggtccacaagacaagcaacagaatcaggattcgtttccagtttggctttggctttgttgtacgttccgttttccttgtactaccgggcacttgcaaattgcttgcgcattactatccttggtgtgaaatggttctaaacggaatattctacttgtagtacgtacacttgtactccacctgtacaagtgacgcatttttttacattgactttgtgcactttgttatattagcctcttttgatattaggcagtagtaccatcctaagaaaaaaaaaactcaatcaacatgtgatgcgtgtaccaacgacacatcacatactttaatttggcgataaaacacatgtgaaccttttattattagtcacaggcagtttgaaaaaaaaaatcacaagaattagtagtactgctacagtactactaaccgatcaacttggagaagaagaaaagatttcctcagagtcgggaaagcccgaggaaagcccatctcccccgtcactgacggtgtggccccaccaccggttcctctcctttcgctcttcctccctatataaaaccctcccaaaaaaaccctctccatttgcaaatcgcaaccatctcgtcaacaaaaaggcgcctctaagaattcctcccaaactttttggtgttgtcaagccgtgcgtttcggggtacatcaacggcggcgatgagctcccggatggccggatcggcgatcctccgtcacgtcggcggcgtccgcctcttcaccgcgtcggcgacctctccggcggcggcggcggcggcggcggcgaggccgttccttgcaggcggagaagccgtccccggggtgtgggggttgcggctgatgtccacgtcgtccgtggcgtcgacggaggcggcggccaaggcggaggccaagaaggcggacgcggagaaggaggtggtggtcaacagctactggggcatcgagcagtcgaagaagctggtgcgggaggacggcacggagtggaagtggtcttgctttagggtacttgcgcttcgctttgctcctgatcggtttcctgtttcgattctgtttgtcccgtagattgatcgccagatcgatgtatccatactccgagatagtaggctcggtccttaacttgtcgcgccgccgtgtgtaattttggtttgattttctccgcagccatgggagacctacaccgcggacacttcgatcgatctgacgaagcaccacgtgcccaagacgctgctcgacaagatcgcctactggaccgtcaagtcgctgcgcttccccactgatatcttcttccaggtataattgtgcttactcgatcaccatgcaccgcccgacggccgtttgattctccgggtgattagcgctgtgtgtttagttcaacgtttttttcgaagggaaaaactgagaggccgcgtgactcttggcgtgtcataagaggcaaagtagcattgcaaccagggcacttgagaattttggtttccttgcttccgggaagatgccatttgtatttaggacgcctgggttctacctgatccacctgtgtgattgattttattttcggaaagtattttctacacctaggtaacatggcacctatgtgtatgcatgcaatttaaaccgttataaaaaaatttacaaacattatacaaacatgtaagtctaaattcgatcaacatatgaagaaacaaaaataataaattttatatgcgctcttcgggtactattcactgtctgattttattatttttgtttctctagttatagatcaaatttagtcatgcatgtttgtgtatagacttatatcatcacaatcgatgttactaatttttttttcaattttttctataactatttgagtcgcatgcaaatgatgggtgtcatagcacttaggtgtagaaaatccctgtccttttattttccgctatactatctgataacaacggctaagaaaaggacacgcattgtgagaaggactcaactttgatttgttaatctcttgcccattaaatcaatcataggcttattactgtttgcactacaatgactggtgatccaattgtttcctagtgcaaattaatctatatatgattctaatgtcttatgactaatttggaagaacaattatattacatgatatccatttctagtagtatgtggaaatgatctctagtcggtcgctaattgctgtaactgtcaatggttaacactgcaaattgggttgggtgcagaggaggtatggctgccgcgcgatgatgctggagacggtggcggcggtgccggggatggtgggcggcatgctgctccacctccggtccctccggcgcttcgagcagagcggcggctggatccgcacgctgctggaagaggccgagaacgagcgcatgcacctgatgaccttcatggaggtggcgaacccaaagtggtacgagcgcgccctcgtcatcaccgtccagggcgtcttcttcaacgcctacttcctgggttacctcctctcccccaagttcgcgcaccgcgtcgtcggctacctcgaggaggaggccatccactcgtacaccgagttcctcaaggacctcgaggccggcaagatcgacaacgtccctgccccggccatcgccatcgactactggcgcctccccgccaacgccacgctcaaggacgtcgtcaccgtcgtgcgcgccgacgaggctcaccaccgcgacgtcaatcacttcgcatcggtacgcatgcatgatcagcgatcttgctctttgatctcgccttttggggatgtatgttgaattggttctgacgtgtgatctggtctggcttgtgatgtgcaggacatccattaccagggcatggagctgaagcagacccctgcgccgatcggatatcactgaggatgtttgtctactgccgaggatttgcatcactaataatcaaatcaaatgagtatacttcgtttttcagggaaagcaaatgagagctctttagctgtatcggatttggtaattgctactagtaactactaagtactgaaaaataaggagtctccttgtttgaagtacaaatctaggagattttttgaaccaactctatctgaattgggcctgtttttcgtacgccgcactgcttcatgtacatatattccatcccctatcttatgtgtggcaagtgtctttctaaattcttggatgtaatgacacctgaatttctttcgttgaactattggcagctgagttatatatactacataccattcttttgttaaagcaggtcagagcatagttttgtccatttgatgtctgtcacaattctggtggtaatgttccaacttcgagaaaattgcatatctaccatcccataagaatggcttcgctagaataccattatgaaaacgggcttcgctggaataccttcctcaaccagagtgtcttcgccaaaatgccatcccggacagaaatgcccctggctcttcttcttcctccatctcgcgcgtgaagagctcgccggcggccatggctagctccctccctgccatggctagctcgccacgggctccggcggagggctgcgcggtggcggcaggcgcggtcgac

SEQ ID NO: 170 - DNA, 6154 bp, Emericella nidulans
  CDS (2189)..(2442), (2492)..(2783), (2843)..(3352)
gaattcctggagcgaagtggcggatctggcgagtctcgaaaggctccttcagcacgctaaacccgccgccagcatcgtcatctcctcgctgtactagttatggaggtagtgcagttgttttgaatcttgacacagttgtatctctggaataatatagtagataagcggaatctttggaattgcgtcggaaaggccgggtgctttaagggtaacacctcttacggtctagcggggagatgccaggttcgagtcccaggtaatttttttgccatttttctccataattcatgaccggattagatcccacacctagttagaaatatttgtttttcagaagtcagctgctaaaactcgattgataattttgtgtttctgagcccattcaagtcagcaaatttgccgcccaaaaccttgcaattctcggtggaagtctctgcaatgtgatttagatcacatgtggcgaatgaagtatccaactgtcgaaagcaagagaatattaggaacgagatgttaatcccaaattcaaggttgaggcgggttatatgcagctcgcttgaagccccgcagtgggccctggtcaacctcagcttcaaccgctctagactccttcggatcctacacctaccgaccaggatgacatgttaacactcctctgcttgatcgtcggcgagaatatcacaaaataaacatggcaactcaaagggcatgtttggctgtcagatttattgctacaagcttatacttacgactgttgtcgctgacttttctcagattgcgttcaaagtccatggcaccgttcagggtacgtcttcagttctaactagtttcattcttagccagctatgtttaacaagtacctctacaggtgtgggtttccggtaggcacagtttctacaggtcaacattagacatttctgatcatgtcgttacaccagtgatttcaccatgaagcgtgctgcggaatacggtctcagcggctgggtgaagaacactgattgcggaagggtacgtttgtagtccctattaatgctaacaatcttgcaatgtcttgcatcgctcgtcagagtcactaaatgcatatgaaggtcgaaggcgaagcacaaggctcagaagagggtatccaaaaatttctcaaggatatcaataatggccctcgacttgcacatgtagtcaagctggagaagaagacactcgatccgaaagacggagagagtcattttgggcttaggaagacatcggcgactgtttttgattcactttgatggtcgactatacagtgtatactctggttcaagcagaataaagtccatccgctcggcctcccagtttccatgaaaagtagtctcagcgtagcctcttcatccggtcctctgcttacgtggtagccaatttctgaggggcaagcaggaacgcattgccccagaatctttcagcttcgggaatatttccagtgacgtcgatagggctacgcaaacgtcgttattgaatcccgatttattctcggcgtttgtctgagtcatggcccagttagtggtcccgtcccggcttcgtccgtgatcaagtgacagagagctggatccataataccgtaatctgataacacaggtcaatcttgcatctcagcaagtaggactcccaacagactgaaaaatcaatgggaagtaagtataatctgatttcgcttctgctaaagctaaatatttcaaacacacctgtatatgattgaactatatttgttttatgcccctactcaatgctaaatggagtatccagatttgtaacgctccgtaaggtagggcgccctaaatacatggcgttttgccaggtacgacaagtcaggctcataattagaaatactcaggcactcttcctttacagccaccatctagaatgggcgtcagatctgggtccttctttcggtgaatgaaaagttctgttcggcggcgagcgtgtgactcctgtgtgcgggtactcagccctgagagttccgattcctgcctcagattgcctctggttgaattttttttataggtctttgtatttagttggcatatataaatacaaaaaaagttgcagtcccagtcaactccttatgtatgtcaaagcaacatcttatcttgactaagtacagttcgtcagaattgacagcaccttttcaacaataaacaatatcagcattatgaattcgatgtcaacaacggggcctattagggtggccgctataccgaaacattacctgcaattcacagtgcggacctatacgaggagtatggcgagcgctgggttacgatacagcaatccgcccctcgtcaaaaaatgctacgaccaaccgacagggaaaaggttcatttcctccacgccacaatcacagatcaaagactatttccctcctcctgatgcaccgaaaatagtcgaggtgaaaacagcgtgggctcatcctgtgtaagttatccaatcttcaagagaggcgacagatgctgatcaagaacagctacagtgaagaagaaatgcgtgcagtcactgttggccatcgcgaggcaaagaattggtctgactgggtagcgcttgggagtgtccgcctgctccgatggggtatggacctggtcactggctataaacaccctgcgccgggccaagaagacatcaagaagtttcagatgacggaaaaggaatggttaagaagatttgtcttcttggagagcgtcgcgggtgtacctggaatggttggtggtatgctaaggcatttgaggagtctcagacgtatgaagcgagataacggatgggtatgtcgagatttctttcatctttacttttcgtggctcaactaataatcaatgcgcagatcgagacgctccttgaggaggcatacaatgagcggatgcacttgctcacattcctcaagatggccgaacctgggtggttcatgcgcttaatggtccttggagcgcaaggagtgtttttcaacggcttcttcctctcttatctcatctcgccacgtacctgtcatcgtttcgtcggctatctcgaggaggaagccgtgctcacttacactcgggccatcaaagacctcgaaagcggcaggctgccgcactgggaaaagctggaggctccagagatcgctgtcaagtactggaaaatgcctgagggtaaccggaccatgaaggatctgttgctgtatgtccgagcggacgaggccaaacatcgcgaggtcaaccacacgctagggaacctgaagcaagcggtcgacgtcaaccctttcgccgttgaatggaaggatccgtctaaaccgcatcctggcaaagggatcaaacacttaaagaccaccggctgggaacgagaggaggttgtttgagcatttatgcatttatacattgtggttttgtcattcgcgggagcaaatgggagaacatgcatatatgattaaagcggcgcaaattggttggacttgagcatagcatcgcggatatctcctctccttagtctttattggtaatagaatgttcttgaacctgttcagattaattgatatggaccggccatgcaattatgagcgcagatgaaacatacactaaactatattgggatagcaatatccgtgtggaaaatgggtctttgctgttactgagcgtagccaggggcttgccatcatgtctcagagccagatggctccatccaaagctccgtttatgttcgctaatgcatgtcaagatgtcatcaggtttggtgcagcctgcagacgcgatgcagtgttcatctgcctcttgtgggatgagggaccgacagattgcacggcatatcctgttctgggcgtcaggggcgccgggacgaaacagatcgaaaaagcaaacaatagtcgaatgccgaagaccaggttttctttttcttaaagcatcactctatccatactcagagtaagctatgatcacctggtaggcatggtcgttaggctggcgacgttaaaggtataggcgctactatcgaatagttgacccgcttcccctttagtgccacgaaagaagcccaagaacccccctttcgaacgtctcaagtttgttctcgcctgcagatcggtcacgatcgccattttccgctgttattctaccgaggcgtcccttttctatttacgttaaccgttatttctcctctggtgaccacctgtcctttcatcttttgtgaccgacccgtttatacattatcaagcgtttgctacattccacgcatgaaccgaaacacacagtgtcgcaatggacgatcccgccgcgtttgatgctacagcccctcctgtccgagactcctcaccctccccttccatctctccaacacccgcgatttcgtcctgtccatcaccagaccgtacattttctacagtttcttcgttgtcgacatcgtctggcacatccggtgatgccaggtcttcagtgtcagtttctacgcggagacgggggtatatccggcctcagggggcggaattcgccgcctccgcaaaaaaccgggaaagtgtaatgagcctggggagcatcgcacatttgcaatactatttcgctcgaacaggtctgctggatgggaagggtggtaatgcgcgagaatataagaagaaaaagaggaatacggaggacacaccacaattgctgctcacaccaaatgcccgcttcacggacgaaattacaatgagcccaacggaggatatgaatacggattcaggagaagatgcgtttgacgttgtcgaggacggagacgaagtgatgctgcccccgactgtcagtacctatagcattaagacgcaccatatcccgccgcctccggatctgctgcagctacggagggaccttttgaacgcgatatataaagcacagagagagattgatgcggtgtctcagcagcagcattcaccggagacgcttccaccacgaatcgatgtctcgccagatggcgatacggaaccaaatggagattcgcaacaccaggcgaatctggctgcagctcttcagagctgggatgaaatcaacggtatgcgcttattagatgttgtcacgcttgcgattcgcgcagcaaagatatactataccacccatgaatacccggaacgactggcttctataaaaagcgagcgtgagattaggcaagatctatttaatgtccttgaagtgttgaagcgatgggcaggacgcaattttgcaggtgggtttcgagaagaggaaaagaaggccgttctaggctggatgtccgatgtgcgcgatatgttgtcgcaagaggcgcagcttgaagacgcagaagtgaaagagcgggcatcgtgggtctggattgaaggcgattggactggtcgggaacggcagcgggaagaggaatttctggccagccttgacaggtccagactcacgcttgccagtatggacagagcctgaagatggttcactcccatctgcgatgcttgagagactacgtgacggccgcgatctgatccggatccacaacatagccgtccggaagtccaagcgaccttttggtgagatcaaaaccttccatgaagacgttgccaagccatatcgacaagcagataatcttcggtattggataaaggcggccgaactgcgctgggagacgaagctcgaactggacgtcatgggcgtcgtctatggcaccagcgacgaggcgtggcaccagtttgatcgagccattgcagcctggtgcaagtccgtccgagaagagctctcgcaagaccttcgagtattgagaagacgagcgactgcagccagtgttgacgggctgcttgtcaagatctcatgacggcttccgtcgataatccacctctttgagagcgcatgtcttggatgtctgggcttttgggaaagtggccattgggtccacgtagtttgattcaggatgacgtttgtttgcagtccgcgctgcctgtatttgataccccttacttgtcgatgacagttttggcgagggagtttggtgtttgtcctgcaccttgtacattgtgctgcattgcattagtcaatgattagccagattaaatatttaaagtatatccatgatttcctagtcgtatcccgaaccacaaattcggttagaaattcggcagtattacaacgagcagcgcgttcagggaggagttccttggaaatggaatgcctaggcctacggtacc

SEQ ID NO: 171 - DNA, 989 bp, Arabidopsis thaliana
  CDS (41)..(661)
ctctgctggtatcattggagtctagggttttgttattgacatgcgtggtgtgtcagaattggaggtggggaagagtaatcttccggcggagagtgagctggaattgggattagggctcagcctcggtggtggcgcgtggaaagagcgtgggaggattcttactgctaaggattttccttccgttgggtctaaacgctctgctgaatcttcctctcaccaaggagcttctcctcctcgttcaagtcaagtggtaggatggccaccaattgggttacacaggatgaacagtttggttaataaccaagctatgaaggcagcaagagcggaagaaggagacggggagaagaaagttgtgaagaatggtgagctcaaagatgtgtcaatgaaggtgaatccgaaagttcagggcttagggtttgttaaggtgaatatggatggagttggtataggcagaaaagtggatatgagagctcattcgtcttacgaaaacttggctcagacgcttgaggaaatgttctttggaatgacaggtactacttgtcgagaaacggttaaacctttaaggcttttagatggatcatcagactttgtactcacttatgaagataaggggattggatgcttgttggagatgttccatggagaatgtttatcaactcggtgaaaaggcttcggatcatgggaacctcagaagctagtggactagctccaagacgtcaagagcagaaggatagacaaagaaacaaccctgtttagcttcccttccaaagctggcattgtttatgtattgtttgaggtttgcaatttactcgatactttttgaagaaagtattttggagaatatggataaaagcatgcagaagcttagatatgatttgaatccggttttcggatatggttttgcttaggtcattcaattcgtagttttccagtttgtttcttctttggctgtgtaccaattatctatgttctgtgagagaaagctcttg

SEQ ID NO: 172 - DNA, 3926 bp, Saccharomyces cerevisiae
  CDS (1017)..(3518)
ttcatacttacgataaaatcacttggaatagaatctacaccaatgaacgcgttttctaagatttccctgaggggtgattaaccaaattgaaaaagatatcgtcaaattcttctttgtgtattttaaagaaggtttttgtattagaaaacgtgcgaaacaaatctttattgatttctgaaaacaatggcaatcgaagctcataggaaccacttttctgtgccttttgaaagatattctcaattatctcgattagctttggcaaatctttaccatatataaagtctccactgatgggtttgtcaatgtggccccatgcgtactcaaaaatagcatcaaacgcaccgttactcatacttacgttgtcaaagacagaattgtttgtaaagctttctttcttaaccttggagccgccaaaaaaatactccactaaggccagtagcaacaacacgttttcttggatgatgcgttttcttgaacaaacagtaccgactaggactgtttcaatgaagttgtgtacggtctggtagtatatctatattccgtgatgcctttgtggaggacgttgagatgagactgagtcgtacaccatgttattcctgtttatggttaattgcgcgtcgcgctttctctagcaaatatctcggttcgaagtaaagcaggtccttcatgtaatggtaacctaaggcaaagggtttgtcatatacccgtgaaggcatttacacaagcgcacttctagtcatatgcagttcatgcatattaagtgagtgttataacgcaagagttatatttgaaatagggttgttaaagaagggagaaacccattcaccacattatctttgcgagtgtaaaactagataacttaaatttttaggagagattttgccacttggcagcaaataccaaatagcagtactgttccggtagataaaggcaaagagttagaggtgtgctttacgaacagcgctggaagggaaaggaaacaaaaaagacaaaaagacagctgtattgttggcgccatgaataatgctgcaaatacagggacgaccaatgagtcaaacgtgagcgatgctccccgtattgagcctttaccaagcttgaatgatgatgacattgaaaaaatcttacaaccgaacgatatctttacgaccgatcgtaccgatgcaagtactacatcttccacagccattgaagatattattaacccctcattggatccgcagtcagcagcatcgccggttccttcttcctcttttttccatgactcaaggaaaccttccaccagtacacatttagtaaggagaggtactccattgggaatttaccaaaccaatctatacggtcacaatagcagagaaaatactaatcctaatagtacattattatcttctaagttactcgcgcatccaccagttccttatgggcaaaatcccgatttactacaacatgctgtgtacagggcacagccgtcaagtggaaccactaacgcgcaaccgcgccaaaccacaagaagatatcaatcccataaatcacggcctgcatttgttaataaactatggagcatgttaaacgatgattctaatacgaaacttatacagtgggcggaggatggaaaatcttttattgtcacgaatagggaggaatttgtgcaccaaattttaccaaaatattttaaacattccaatttcgcttcctttgtaagacaattgaacatgtatggatggcataaagttcaagatgtcaagtcaggatcaattcaaagtagttcagatgataagtggcaatttgaaaatgaaaacttcattagaggtagagaagatttgctggaaaaaataatcaggcagaaaggttcctccaataaccataatagccctagtggtaacggtaatccagcgaatggtagcaacatccctctggacaatgccgcaggaagtaataatagcaataataacatcagtagtagtaattcattttttaacaatggtcatttattgcagggtaaaacactaagattaatgaacgaagcgaatcttggagataagaatgatgtcaccgcgattttgggggaattagagcaaataaaatataaccagattgcaatttccaaagatttactaagaataaacaaagataatgagttattatggcaagagaatatgatggccagggaaagacatagaacccaacagcaagccttggaaaaaatgttcagattcttgacatctatagtcccacacttagatcccaaaatgattatggacgggctgggagatccgaaagttaataatgaaaagctaaacagtgcgaataacattgggttaaatcgcgacaacacaggcactatagatgaactaaaatccaacgattctttcataaacgatgatcgtaattctttcaccaatgctacaaccaacgcccgtaataacatgagtcccaacaatgatgacaatagtattgacaccgctagcactaataccaccaacagaaagaaaaatatagatgaaaacatcaaaaataacaacgacataattaatgacattatatttaataccaaccttgccaacaatctcagcaattacaatttcaacaataatgctggctcgccaataaggccctataaacaaagatatcttttgaaaaatagagccaattcctcgacatcgagtgagaatccaagcctaacgcctttgatatcgaatctaataatgaccgcaaaatttcagaaattccttttgatgacgaagaagaagaagaaaccggattttaggccttttacctcgcgagatcctaataaccaaacgagtgaaaacacttttgatccaaacagatttacgatgctctctgatgatgatttaaaaaaagattctcataccaatgacaataaacacaacgaaagtgatcttttttgggacaacgtacatagaaatatagacgaacaagatgcaagactccagaacttggaaaatatggttcacatactttctcctggatatcctaataagtcgttcaacaacaaaacttcctcgacaaacactaattccaatatggaaagtgctgtcaacgttaatagccctggtttcaacttacaggattatttaactggagagtctaattcccccaattctgttcattctgttccctccaatggcagcggctccacaccgttgcccatgccaaatgataatgacaccgagcacgcaagtacaagtgtcaatcaaggcgaaaatggaagcggattaacgcccttcctcacggtagatgatcacacactaaacgacaataacactagtgagggaagtacaagggtgtcccccgatataaagttcagcgccactgaaaacactaaagtgagtgataacctgccaagctttaatgaccacagttattccacccaggccgacacggcgcccgagaacgctaagaaaagatttgtggaggaaataccggaaccggctatagtcgaaatacaggacccgacagagtacaacgatcaccgcctgcccaaacgagttaagaaatagtacacaggacgaggtcattaaatagcgtatataatcatttaatatagtatgttctcgaagctgatcgcgtaaggcgcagaacgaactaaaaaaaataccggcacccatgcacctcacaccgccgcacgcgagtgaggttgaactgcacccggaaaatgccaagtagatgagtcgtgaagagttctcgttattcgagctagtgagagcctgagaagggcttgccgagtgaactggggtcacattggccgttttaacgcaagttggcgtacttatgttgactgttggatgaaagggtaatcaagagaaacggaaacggcctcctcatcgtaaagctcatcagtattcatttctcccctttctgctccatcgcgtgctcgagactatactcttcagattatcaagcagaaa

SEQ ID NO: 173 - DNA, 3942 bp, Zea mays
  CDS (436)..(1773), (1878)..(2159), (2281)..(2621), (2711)..(2990), (3079)..(3276), (3371)..(3670)
  unsure (1)..(3942): unsure at all n locations
gtgggcccatggcacagacggcttacagagatcctaccccacattccagagatatggaacgccaccatggccgataccgaacagccgcgccatgtgtcacacatcgggagcacttcgtcaacaatccaacggtccatgattattaaggcccacatgtcatagaaccctctggcaccctctcgccgcttcgtcacctgtcccgtcgctcgtcctctcgtttccacggccttctagactcccggcgaacactcccctccgccttcttatgctcatcccctccgcttccgaagcacaacatttcaaccagaaacactagccgaagcaaatccattccacaagcacctggtgggatcatctcatcatcagaaaccaagagagagattccgtgtccgcttgttgtagtagattgtgaggactgaggaccgagaagcagccatgaatccggacaacttcacccacaagacgaacgaggcgatcgtgggggcgcacgagattgcggtggaggccggccacgcgcagctcacgccgctgcacctggccgcagtgctggctgcggacaagggcggcatcctgcggcaggccatcacgggggcgtcggggggcgacggagcggccggggactcgttcgagcgcgtgctgaacaactcgctcaagaagctgccgtcgcagtccccgccgccggactccgttccggcgtctacggcgctgatcaaggtcatccgccgggcgcagtccgcgcagaagaaacgcggggactcgcacctcgccgtcgaccagctgctgctcggcctgctcgaggactcgcagatctccgactgcctcaaggaggccggcgtgtccgcggcgcgggtgcgcgccgagcttgagaagctccgcggcggggaggggcgccgcgtggagtccgcgtcgggggataccaacttccaggcgctcaagacatacggccgggacctcgtcgagcaggccgggaagcttgaccccgtcatcggccgcgacgaggagatccgccgcgtcgtgcgcattctctcgcgccgcaccaagaataaccccgtcctcatcggcgagcccggcgttggcaagacggccgtcgtggagggcctcgcgcagcgcatcgttcgcggcgacgtgcccagtaacctcctcgacgtccgcctcatcgcgctcgacatgggcgcgctcgtcgcgggcgccaagtaccgcggcgagttcgaggagcggctcaaggccgtgctcaaggaggtggaagaggccgaggggaaggtcattctcttcatcgacgagatacacctcgtcctgggcgcgggcaggacggagggttccatggacgcggccaacctgttcaagccaatgctggcgaggggacagctcaggtgcatcggcgccaccacgctggaggagtaccgcaagtacgtggagaaggacgcagcgttcgagcggcggttccagcaggtgttcgtcgcggagccgagcgtgcccgacaccgtcagcattctgaggggcctcaaggagaagtacgaggggcaccatggcgtgaggatccaggaccgcgccctcgtggtcgcggcacagctctccgcgaggtacatcatgggtcggcacctgcctgacaaagccatagacctggtggacgaggcctgcgccaatgtgagggtgcagctcgacagccagccggaagagattgataacctggagaggaagagaatccagcttgaggttgagctccacgcgctcgagaaggagaaggacaaggccagcaaagcccggctgattgaggtgcgtgtctcgagcactgaattttcctcaaacaagtcctcttgtctgatgttcctgttttgaacttttgatactaacgtcgcttaactgtggccattgttcaggtcaggaaggaattggacgatctgagggacaagctgcagcccctgaccatgaagtacaggaaggagaaggagagaattgatgagatcaggaagctgaagcagcgccgcgaggagctccagttcaccctgcaggaggccgagcgccggatggacctggcccgtgtggccgacctcaagtacggcgccctccaggaaatcgacgctgctatctccaagctggagagcgaaacaggggagaacctgatgctcaccgaaaccgtcggccctgaacaaattgcagaggtatgttattattcttgttcaccgtcacaaaaattttgcagagcaagtgccgaatttgccgatcgtctcctagtagagtagtcgtgcagcgtgctgaaatggtgtttcgtcctatgggcaggtggtgagccgttggacgggtattccagtgacccggcttggccagaacgacaaggagaggctggttggcctggctgacaggcttcaccagagggtggtcggccagacagaggctgtgagcgccgtcgcagaggcggtgctgaggtcgagggccggtcttggcaggccacaacagcccactggctcgttcctcttcctgggtccgactggcgtggggaaaactgagctggccaaggccctagccgaacagctgttcgacgacgagaaccttcttgtccgcatcgacatgtcggagtacatggagcagcactcggttgcccgcctcatcggagcaccacctgggtaagtagcagaaaatgcatgcatcttcgtatttttaactgcgaattgcgatgaactcttgttctgacagtgggccggacctgtgacagctacgtcggccatgaagagggtgggcagctgactgaacaagtgaggaggaggccgtacagcgtgatcctgttcgacgaggtcgagaaggcccatgtcgccgtgttcaacaccctgctccaggtcctcgacgacggcaggctgacggatgggcaaggcaggacggtggacttcaggaacaccgtgatcatcatgacatcgaacctcggcgccgagcacctcctcgctgggatggtgggcaagaactccatgaaggtcgctcgcgatctggtcatgcaggaggtatgcattgcgataacgttctgaatcgtcgttagacattgttcctctgcagcgtgatgctcaatcggatcgttattgctgtgtgcaggtgaggaggcacttccgccctgagctgctgaaccgtctcgacgagatcgtgatcttcgatcctctgtcccacgagcagctgaggaaggtcgctcgccttcagatgaaggatgtggccgtccgtcttgccgaaaggggcatcgctctggctgtgaccgacgccgcattggacatcatcttgtctctctcttacgatccggtatgtgaccatccatgatttgatccatctgaattcgtcggtgacacctgatggtgctgactctcttatctttcttgtgtggcttcaacaacaggtgtatggcgcgcggccaatcaggaggtggatcgagaagagggtggtgacgcagctgtcgaagatgctgatccaggaggagatcgacgagaactgcacggtctacatcgacgccgcgcccggcaaggacgagctggtctacagggtggaccggagcggcggtctggtgaacgctgagacggggatgaagtcggacatcctgatccaggtccccaacagctccaccaggagcgacgctgcgcaggccgtcaagaagatgaggatcatggaggaggacgaggacggcatggacgaggagtaaaaggcgggccggaggacgcggagctgcgcccaggccgcangtctggcgccggcatcatcgagtgtcttttgaataagcgtgtagataagcccgtgaatatgcagacgaggttgagatgatgttcttgtaacgctgctgtttgtcaagcatggacggatggtctctcatatggtatcaaagtgacgaaggtctctcaatcgatgtcttgtcattatttttatctccctaaatgtttttacatgttttcctctattcattgcatcctttatgca

SEQ ID NO: 174 - DNA, 3301 bp, Saccharomyces cerevisiae
  CDS (334)..(3060)
tttctttcgttgttcttgtagatatatatttttccagaattttctagaagggttattaattacaatcttaaacgttccataaggggccgcgatttttttgttcaattttcaacagggggcccatctcaaagaactgcaaattatatcacagtaaaaggcaaaggggcgcaaacttatgcaacctgccagattattatataaggcattgtaatcttgcctcaattccttcataattcgttcctttgtcacttgttcctttttacccttgaatcgaatcagcaataacaaagaaaaaagaaatcaactacacgtaccataaaatatacagaatatatgaacgaccaaacgcaatttacagaaagggctctaacgattttgacgttggctcaaaaattggcttcggatcatcaacatccacaattacaacctatacatattctagctgccttcattgaaacgccagaagatggatcagtcccttacctacagaatctaattgagaagggccgttacgactatgatcttttcaagaaagtggttaatagaaatctagtaagaattcctcaacagcaacctgcacctgcggagataactccaagttatgctttggggaaagtccttcaagacgctgctaagattcaaaaacaacagaaggactcatttatagcgcaagaccatatattgtttgctctattcaatgattcgtctattcagcaaatatttaaggaagctcaagtagatattgaggccatcaagcaacaagctcttgaacttcgtggtaacactagaattgactctcgtggcgctgatacgaacacacctttggaatatttatcaaagtacgccattgatatgactgagcaggctcgtcaaggtaaacttgaccctgtcatcggccgtgaagaagaaataagaagcactattagagttttagcaagaagaattaagtccaacccatgtttaattggtgagccaggtatcggtaagaccgctattattgaaggtgttgctcaaagaatcattgacgatgacgttcccactatcttacaaggcgctaaattgttcagtctagatttggccgcattaaccgcaggtgctaaatacaaaggtgatttcgaagaaagattcaaaggtgttttgaaggaaatcgaagaatcaaagactctaattgtgttattcattgatgaaattcacatgttaatgggtaatggtaaggacgacgctgctaacatcttgaagccagctttgtccagaggccaattgaaggtcatcggtgccaccaccaataacgaatatagatctattgtggaaaaggatggtgcctttgaaagaagattccagaaaattgaagtcgctgaaccaagtgtgagacaaacagtggccatattgagaggtctgcaaccaaagtatgaaatacatcatggtgtaaggattctggatagcgccttagtcactgctgctcaattagccaagcgttacttgccatatagaagattgccagattctgctttggatttagttgatatttcttgtgctggtgtcgccgtcgcaagagattctaagccagaagaattggattccaaggaacgtcaattgcaattgattcaagtagagataaaagctctagagagagatgaagatgccgactccaccactaaagatagattaaagttagctaggcagaaggaagcttcattgcaagaagaattggaacctctaagacaacgttacaatgaagaaaagcatggccatgaagaattgacacaagctaaaaagaaattggatgaactggaaaacaaggcccttgatgctgaacgtagatatgatactgctaccgccgctgatttaaggtacttcgccatcccagatatcaaaaagcaaatcgaaaagcttgaagatcaggttgctgaggaagagagacgtgctggtgccaactccatgatccaaaatgtggtcgattcagacaccatttctgaaacagctgcaagattgactggtatccctgttaagaagttgtcagaatctgaaaatgaaaaattgattcatatggaacgtgacttatcatctgaagtcgtgggccaaatggatgccattaaagctgtttccaatgccgttagattgtctagatcaggtttagctaatccaaggcaaccagcatccttcttatttttaggtttgtccggttccggtaaaactgaattggctaaaaaagttgctggatttttgtttaatgatgaggacatgatgatcagggtcgattgttctgaattaagcgagaagtatgcggtctctaagttgttgggtaccacggcaggttatgtcgggtacgatgaaggtggctttttaactaaccaactgcaatacaaaccatactccgttttgttattcgatgaagtagaaaaggcacatcctgatgttttgactgtcatgctacaaatgttggatgacggtagaattacttctggtcaaggtaagacgatcgactgttccaattgtattgtcatcatgacttccaatctaggtgctgaatttatcaattctcaacaaggatcaaagatccaagaatctaccaagaatttggtcatgggtgctgttaggcaacatttcagaccagaatttttgaacagaatttctagtatagtcattttcaacaagctatctagaaaagctattcataagatcgtggatattcgtttgaaggaaattgaagagagattcgagcaaaatgataaacattacaagttgaatttaactcaagaggccaaggacttcttggccaaatatggttattccgatgatatgggtgcacgtccactgaacaggttaattcaaaacgaaattttgaacaaactggcactaaggatcttaaagaatgaaatcaaggataaggaaactgtcaatgtcgtcttgaagaagggtaaatctcgtgatgaaaatgttcctgaggaagctgaagaatgtctggaagttctaccaaatcacgaagctactataggggctgacacgttaggtgatgacgataatgaggacagtatggaaattgatgatgacctagattaatttaatatagtgtgatttttaaaaactttcgaacaagaatcagtaatataatatatataattaataaaactaatggaatttgtttaattgaacttgacacccgagcaaaagagctcacattttaacgtttagttcatcttgctgtgaataatctaaaagtaaacaatggacaaaaaagttccactggacgtcaaatctttttttattgtatttgggacatatggcgttgataactaaagtt

SEQ ID NO: 175 - DNA, 4248 bp, Escherichia coli
  CDS (557)..(3130)
agatgactgccgactgcctccctgtgctgtttttgcaatcgacgggaacgaagtcgccgccgctcatgctggctggcgtggactgtgcgcaggcgtgctggaagagacggtttcctgttttgctgataatccggaaaatattctcgcctggttagggccggcaattggtccacgcgcgttcgaagtggggggggaggttcgcgaggcgtttatggcagtagacgctaaagcaagtgcagctttcattcagcatggtgataagtatctggcggatatttatcagcttgcccggcagcgtctggcgaacgtgggtgttgagcaaattttcggcggcgaccgttgtacatatacggaaaatgagactttcttctcttatcgtcgcgacaagaccaccggtcgtatggcaagtttcatttggctgatataacctaaagaatcaagacgatccggtacgcgtgattttcttttcacattaatctggtcaataaccttgaataattgagggatgacctcatttaatctccagtagcaactttgatccgttatgggaggagttatgcgtctggatcgtcttactaataaattccagcttgctcttgccgatgcccaatcacttgcactcgggcacgacaaccaatttatcgaaccacttcatttaatgagcgccctgctgaatcaggaagggggttcggttagtcctttattaacatccgctggcataaatgctggccagttgcgcacagatatcaatcaggcattaaatcgtttaccgcaggttgaaggtactggtggtgatgtccagccatcacaggatctggtgcgcgttcttaatctttgcgacaacgtggcgcaaaaacgtggtgataactttatctcgtcagaactgttcgttctggcggcacttgagtctcgcggcaccgtggccgacatcctgaaagcagcaggggcgaccaccgccaacattactcaagcgattgaacaaatgcgtggaggtgaaagcgtgaacgatcaaggtgctgaagaccaacgtcaggctttgaaaaaatataccatcgaccttaccgaacgagccgaacagggcaaactcgatccggtgattggtcgtgatgaagaaattcgccgtaccattcaggtgctgcaacgtcgtactaaaaataacccggtactgattggtgaacccggcgtcggtaaaactgccatcgttgaaggtctggcgcagcgtattatcaacggcgaagtgccggaagggttgaaaggccgccgggtactggcgctggatatgggcgcgctggtggctggggcgaaatatcgcggtgagtttgaagaacgtttaaaaggcgtgcttaacgatcttgccaaacaggaaggcaacgtcatcctatttatcgacgaattacataccatggtcggcgcgggtaaagccgatggcgcaatggacgccggaaacatgctgaaaccggcgctggcgcgtggtgaattgcactgcgtaggtgccacgacgcttgacgaatatcgccagtacattgaaaaagatgctgcgctggaacgtcgtttccagaaagtgtttgttgccgagccttctgttgaagataccattgcgattctgcgtggcctgaaagaacgttacgaattgcaccaccatgtgcaaattactgacccggcaattgttgcagcggcgacgttgtctcatcgctacattgctgaccgtcagctgccggataaagccatcgacctgatcgatgaagcagcatccagcattcgtatgcagattgactcaaaaccagaagaactcgaccgactcgatcgtcgtatcatccagctcaaactggaacaacaggcgttaatgaaagagtctgatgaagccagtaaaaaacgtctggatatgctcaacgaagaactgagcgacaaagaacgtcagtactccgagttagaagaagagtggaaagcagagaaggcatcgctttctggtacgcagaccattaaagcggaactggaacaggcgaaaatcgctattgaacaggctcgccgtgtgggggacctggcgcggatgtctgaactgcaatacggcaaaatcccggaactggaaaagcaactggaagccgcaacgcagctcgaaggcaaaactatgcgtctgttgcgtaataaagtgaccgacgccgaaattgctgaagtgctggcgcgttggacggggattccggtttctcgcatgatggaaagcgagcgcgaaaaactgctgcgtatggagcaagaactgcaccatcgcgtaattggtcagaacgaagcggttgatgcggtatctaacgctattcgtcgtagccgtgcggggctggcggatccaaatcgcccgattggttcattcctgttcctcggcccaactggtgtggggaaaacagagctttgtaaggcgctggcgaactttatgtttgatagcgacgaggcgatggtccgtatcgatatgtccgagtttatggagaaacactcggtgtctcgtttggttggtgcgcctccgggatatgtcggttatgaagaaggtggctacctgaccgaagcggtgcgtcgtcgtccgtattccgtcatcctgctggatgaagtggaaaaagcgcatccggatgtcttcaacattctgttgcaggtactggatgatgggcgtctgactgacgggcaagggagaacggtcgacttccgtaatacggtcgtcattatgacctctaacctcggttccgatctgattcaggaacgcttcggtgaactggattatgcgcacatgaaagagctggtgctcggtgtggtaagccataacttccgtccggaattcattaaccgtatcgatgaagtggtggtcttccatccgctgggtgaacagcacattgcctcgattgcgcagattcagttgaaacgtctgtacaaacgtctggaagaacgtggttatgaaatccacatttctgacgaggcgctgaaactgctgagcgagaacggttacgatccggtctatggtgcacgtcctctgaaacgtgcaattcagcagcagatcgaaaacccgctggcacagcaaatactgtctggtgaattggttccgggtaaagtgattcgcctggaagttaatgaagaccggattgtcgccgtccagtaaatgataaaacgagcccttcggggctcgtttttgtctataagttagacggaaaagactatatttaagatgttttgcctgaaaagtgagcgaacgataaagtttttatatttttcgcttgtcaggccggaataactccctataatgcgccaccactgacacggaacaacggcaaacacgccgccgggtcggcggggttctcctgagaatctcaacagagaaaagcaaagaaatgcttgactctgtagcgggaaggcgtattatgcacaccgccgcgccgctgagaaaaagcgaagcggcactgctctttaacaatttatcagacaatctgtgtgggcactcgaagatacggattcttaacgtcgcaagacgaaaaatgaataccaagtctcaagagtgaacacgtaattcattacgaagtttaattctttgagcatcaaacttttaaattgaagagtttgatcatggctcagattgaacgctggcggcaggcctaacacatgcaagtcgaacggtaacaggaagcagcttgctcttcgctgacgagtggcggacgggtgagtaatgtctgggaagctgcctgatggagggggataactactggaaacggtagctaataccgcataatgtcgcaagaccaaagagggggaccttcgggcctcttgccatcggatgtgcccagatgggattagcttgttggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaa

SEQ ID NO: 176 - DNA, 3180 bp, Synechocystis PCC6803
  CDS (316)..(2931)
acttctaggacgtagccctcattccaagtcatggcgtctgattctgcgtaggggtcaagattagcccttagcttacaagaaaggggctttggggcctagttgaatggcacaaattttccttccctgactgtttttgcgccattgtctagctcaaagtcagcctccggcatcctctagaaagacttccatcccctggttgagcaagggtaaaccccaccactgcattgggaaaaccctccttcctagctccggattccaccccctaaaattgatttggtagtccttacacacccaatagccaatatagaaaattttatgcaacccacagatcctaataaatttacggagaaagcttgggaggcgatcgccaaaacaccggagattgctaaacagcatcgacaacagcaaattgagacggaacacctactcagtgccctactagaacaaaatggtctggccaccagcatctttaataaggctggggcgagcattccccgagttaacgatcaagttaatagctttattgcccaacagccaaaattaagtaatccgagtgaatcgatttatttaggccgcagtctcgataaattgttggacaatgcggaaatagccaagtctaaatatggagacgactatatttccatcgagcacttgatggcggcttacggccaagatgaccgcctgggcaaaaacttatatcgagaaattggcctaacagaaaataagttggcagaaattatcaagcaaattagaggaacccaaaaagtgaccgatcaaaatccagagggcaaatacgaatcccttgaaaaatatgggcgagatttaacggaattagcccgggaaggtaaactagatcctgtcattggccgggatgaagaagtgcggcgcaccattcagatcctttcccgccgcacaaaaaataaccctgtgttaattggggaaccgggggttggtaaaacggcgatcgccgaaggtttagcccaaagaattattaaccatgacgtaccggaatcattgcgggatcgcaaactaatttccctcgatatgggggcgttaattgccggggcaaaataccggggggaatttgaagaaagacttaaagcggtacttaaagaagttaccgacagccaggggcaaattattctctttattgacgaaattcataccgttgtcggcgctggggccacccaaggagccatggatgcgggcaacttattgaaacccatgttagcccggggtgctttgcgttgtatcggggccaccactttagatgaatatcgcaaatatatcgaaaaagatgcggctttggaacgacgtttccaggaagttttagtggatgaacccaatgtattagataccatttccattctccggggattaaaagaacgctatgaagtacaccacggcgtaaaaattgccgatagtgccctggtagcggcggccatgttgtccaatcgttacatcagtgatcgttttctgccggataaagctattgatttagtagacgaagcagcggccaaattaaaaatggaaatcacctccaaaccagaggaattagatgaagttgaccggaaaattctccaactagaaatggagcgtttatctttacaacgggaaaatgattctgcttccaaggagcggctagaaaaattggagaaagagttggctgattttaaagaagaacagtctaaacttaatggccaatggcagtcggaaaaaacggttattgatcaaattcgtactgttaaggaaaccatcgaccaggtgaacctagaaattcaacaggcccaacgggattacgactacaataaagcagcggagttacagtatggcaaattaactgatttacagcggcaagtggaagctttggaaacccaattggcggagcaacaaacctctggcaaatccctcttacgggaagaagttttagagtctgacattgctgaaattatctcgaaatggaccggcattcccatcagtaaattggtggaatcggaaaaagaaaaactgctccacttggaagatgaactacacagccgagtgattggtcaggatgaagcggtaaccgccgtagccgaagccattcaacgctcccgagctggtctttccgatcctaatcgtcccaccgctagctttatttttctgggccccacaggggtcgggaaaactgagttagcgaaggctttggcgaaaaatttattcgacacggaagaagccctggtgcggattgatatgtctgaatatatggaaaaacacgctgtttcccgtttaatgggggcccctccgggctatgtgggctatgaagaagggggacaattgacggaagcaattcgccgccggccctattcggtcattctttttgacgagattgaaaaagcccatggggatgtgtttaacgtcatgctccaaatcctggatgatggccgtttaaccgatgcccaaggccatgtggtggacttcaaaaatacgattatcattatgaccagtaacctgggctcccaatacattttggatgtggcgggggatgatagtcgttatgaagaaatgcggagccgagttatggatgtaatgcgggaaaacttccgcccagaatttctcaatcgggtggatgaaacgattattttccatggcttacaaaaatccgagttacgatccattgtccaaattcaaattcagtctttggctacccgtttggaggaacaaaaattaactttgaagttaacggataaagccctagattttctggctgccgtgggctatgaccccgtttatggggcccgacctttaaaacgagccgtccaaaaatacctagaaacggcgatcgccaagggaattttacggggggattacaaacctggtgagaccattgtggtggatgaaaccgacgaacgcctcagttttaccagtttaaggggggatttagtcatcgtttagggacttctgttccgtcaactctgacggattaataactccatcaatgctaaccctaggggattccaactccgccgtcatggttgcccctggggtttggtgatggggtaataactcctgaccccggttaatcaaagccgccatgcccttgtcataattgctggcgatcgccaaaaaagcaccggccataacgtaaataggcaggggcaaaattaccccccatagccattggaaaagttgcactccggc

SEQ ID NO: 177 - DNA, 3000 bp, Xylella fastidiosa
  CDS (187)..(2769)
tgttggcgtgtgggctgtttcatcagttttgtgtatttggggtaggttgtgtatctctgttcgatcgggtgttctcaaatgaacacatacttggtcatcggtcgtgtccttgaaagtgacttgttaaaccgcatctgttggatgtcgccggcagatgtccggtctctttcctaactggggctttttatgcggatggataagcttacttcgcgtttccagaatgcgttggctgatgcgcaatcgctggccgtcggtcgtgaccatactattattgagccggtgcatgttttttcggcattgcttgatcagcagggggggagtacacgtccgttgctcatgcaggccggtgtcaatgtgccattgctgcgtgagcggttgaccgagatacttgaggcattgccgaaagtgagtggtcagacggttaatgtctcacccagcaatgaattgagtcgtttgtttcatcggactgataagttagcgcagcagcatggcgatcagtttatggccagtgagtggttcgtgttggctgtggtcgatgatagtggggggctgggccaggcgttgcgtgctgctggtgcggaaaaaaagaagattgaggctgcgattgataaattgcgtggcggtgaaactgtccagactgagaatgcggaggagcagcgtcaagcgttggaaaagtacacgattgatctgactgccagggctgagagtggcaagcttgatccggtgattggtcgcgatgaggaaattcgccgcacgatacaggtattgcagcggcgtacaaaaaataatcctgtgctgattggtgagccgggtgtgggtaaaactgccattgtagaagggctggctcagcgcattgtcaatggtgaggttccggaagggttgcgcagtaagcgtctgctctcgctggatttgggagcgttgattgctggggccaagtttcgtggtgagtttgaggagcgcttgaagggggtgcttaacgatctcgctaagaatgaggggcgggtcattttgttcattgacgagctgcataccatggttggtgccggtaaagccgatggtgcgatggatgctggcaatatgctcaagccggcgttagcacgtggtgagttgcattgtatcggtgcgactacgttggatgagtatcgcaagtacattgagaaggatgcggcgttggaacgccgtttccagaaggtgtttgttggggagccgacggtggaggataccatcgcaattcttcgtggacttaaggaaaagtatgcgttgcaccacggtgtggaaatcactgatccggctattgttgctgcggctacgctgtctaatcgctacatcactgatcgtcagttaccagataaagcgattgacttgatggatgaggctgccagtcgtattcgtatggaaattgactccaagccggaagagcttgatcgtttggagcgtcggttgattcagttgaaaattcagcgtgagatgctgaagaaagaaaaggatgaggcgagcaagcagcgtttagccgatcttgagcgtgatattgaggttctggaccgtgaattttccgatctggaggaggtgtggagatcagaaaaagccgcgctacagggggcgactaagatcaaggagtcgatcgagcaggccaagcttgatttggaagccgcgcagcgccgtcaggactacgccaagatgagcgagattcagtatggtgtactccccgcgttggagaagcagctggtggcagcaagtcaggcggaacagcacgattttacgttggtgcaggagaaagtgactgctgaggagattgccgaggtagtcagtcgttggactggtattccagtgagcaagatgcttgagggcgagcgcgataagttgttgcgtatggaagctgatctaggccgacgtgtggttggtcaagaggaggcgatcaaggtggtatcggatgcggtacgccgttcgcgtactggtttgtctgatccaaatcgaccgagcggctcgttcctttttctgggtccgacgggtgttggtaagactgagttatgtaaggcgctggctgaatttttgttcgacagtcaagatgcaatggtccgcattgatatgagtgagttcatggaaaagcattctgtggcgcgcctgattggtgcgcctccgggctatgtgggttatgaggaaggaggttatcttactgaattggtgcgacgtcggccttactctctgattcttttggatgaagtggagaaggcgcatagtgatgtgttcaatattctgctgcaagtacttgatgatggacgcttgactgatggtcagggccgtactgttgattttcgcaataccgttattgtgatgacatcgaacttgggttcacatcagatccaagaactcagtggagacgattctccggaggtgtatacgcaaatgaaggcggcagtgatggaggtggtgcaggcgcattttcgcccagagttcattaacaggttggatgatattgttgttttccacccgttggacaaggcgcaaatcaagcagattgcgcggattcaactgcaggggcttgagaagcgtctcgctgaatctgagttgaaactagatttggatgatcgtgcgttggaattgcttggtaatgtcggatttgatcctgtatatggtgcccgcccgctgaagagagcgatccaatctcagctggagaatcccttagcgcagcagatcttagctgaagcgttcgtcagtggagatactgtgcaggtgggtgttgatggagggaagcttgtattcgctaaggtgtgaagttgtttactgtatatagtcagtagtgctgtgtattgtatgggtgtacgaggggtgtggttataaataacctttcttggttgccagtagtgttggtttatattgatcaggttgggtccgcgcgcatcgtgcgcggacagatgtaaggtctgtatggaaagccaaattaatttggctggatgctaagaaatggacgaaggaggagatcaattgcgacagtcattgagt

SEQ ID NO: 178 - DNA, 1595 bp, Glycine max
  CDS (23)..(1114)
attcggctcgagtgcgattgcgatggtgaaatcgaacgagaacggttctggttccgtttcggtgcctcctttcctgaaaaaatgttacgatatggtggaagaccgcaacactgattctatcatccgttggagcgatggcggtgacagctttgtcatctccgacatcactcaattctccgtcacgctccttcccacctatttcaaacacaacaatttctccagtttcatcagacaactcaatatctatggtttcaggaaaattgatacggattgctgggaatttgccaatgagaactttgttagaggtcaaaagcatttgttgaagaatatacgtagaaggaaacatccacacagtgcagatcagcaaaaagcattgccacagcaagacaattgtgatgaaccatcacaagaagcaccgtatcatggcctttggaaagaagttgagaatctaaaacttgataaaaattcgctcacgcaagaattggtcaaacttaggcaacaccaggaatctgctgagaataagttgctgctcctgagtgatcgccttcaaggaatggaaaagcatcagcagcagatgttatcatttttagtcatggttgtgcaaagccctgggttcatggttcagcttcttcatcctaaggaaaataattggcatttggctgaatcatggaatatattggatcaagataaacaagatgacaagccagttgcttctgatgggatgataataaagtataaaccacctgtaggtgaaaaactaaagcctgtagttcctctgtctcctggtttcgaaaagcaaacagaacccgagctttctgcagaagggctaaaagacttgtgcgtcagttctgaattcttgaaagtgcttctggatgaaaaattatctccattagaaaatcattctccatttctcctaccagatttacctgatgatggttcatgggaacagctttttctaggtagtcctttcatgggaaacattcaagattctaataaagaaagtgaggggcacaccaatggtggaatggagatggaaccaacaatatctgagactccaaatgaaaattctcgaacttttgaatcgatgattgtagagatggagaaaactcgagaatgagttggagttgtatgcacatggtgggctgtcttcttggaatccatcagatatttttcagctgggctgtctcatactgagctaatggagctttagtttctgaaactaacaatatatagggaaggaagtaataatgtccatcagatatttttcagctgggctgtcttcacagattacttcacactataattatattatagtattaagtcgcaattattttctctcccatcttccttcagcagttgttagatcctcttctagaatccatattttggcttcctgatacatggtgtcggagatcaggagttgtatggtagtgcacaagtgcggcgacctatatatatagcggatcaattatttcttttatggaaaattgtaagggaaaacggcaactttattttttgtgccacattaaacagtggcacttgccttcatatatattataaaatttcacgaaaaaaaaaaaaaaaaaaaaaaaagg

SEQ ID NO: 179 - DNA, 1159 bp, Glycine max
  CDS (93)..(992)
gattccttttcctttctatctctctctcttcttatatttccacattccacgtgaaccttctagaactataatagaaagaaaccctccattccatggctccgccgctcgaacacaacggcgtttccacgagcggtgactctcagagatccattcccacgccgtttctcaccaaaacctaccagctcgtcgacgatcacaccatcgacgatgtcatttcgtggaacgattctggatcgtccttcatcgtctggaacaccaccgctttcgccaaggatttgcttcctaaatatttcaagcacaacaacttctccagcttcgttcgccaactcaacacttatggatttagaaaagttgtacctgaccgctgggagttctcgaacgagtattttcgaagaggcgaaaagcgtcttctctgcgaaatccagcgacggaagatcctctccgcatctcctccgccggcgggagcaactgccaccgtggcggttccgtcgccgctgccgctatctgcgatcccgacggcgaagccgatcgtgtcgccgtcgaactccgcggaggagcaggtgctttcgtcgaactcgtcgccggcgagagcaccggtggagctgttggacgagaacgagcggctgagaaaggagaacattctgttgacgaaggaattggtgaagatgagatcgctctgcaacaatatattcaatctcatgtcgaattacgctaacgctcaagcggacggtagttccgcggcggcggcgaagcggtgctccggcgaggatgcggtggaggagatgaatccgaagctgtttggggtggcgattggtaagaagcgagcgagagaggaggaaggacatggagcgaagtatgatacggctttgagtctgcatcagccgtttcatgcggacgtgaaatctgaagcgttggatttaccaggacgtggcgaaaataaaaaaacgccgtggctaaatcaatgtcatagagcaaatcagagggtgtgtaattgacacacgacgttgtaatagctaggtaacacgttaggttaagttaggggcgtcgtagagaatcagagtctgtaagcacggagacgcgcgtgtcaaatgtacgtcgttaaccgtttgggacttttttcgtagaagtttctcagaagaaaactatattttgttgttcc

SEQ ID NO: 180 - DNA, 1480 bp, Zea mays
  CDS (90)..(1229)
gcttcatgcgtggatcctcgtagaccccgacccgcgtgcactcaatccctaggcggcggcctccggcgcgaggctagcgggcggcacccatggcgtccgtggcggagctcaaggagaagcacgccgcagctacggcgtcggtgaactccctgcgcgagcgcctccgccagcgccgggagacgctcctcgacaccgacgtggcgaggtactccaagtcgcaggggagggtgccggtgagcttcaaccctacggatctggtctgctgccgcacgctgcagggccatagcggaaaggtatattctctggattggacccctgaaaagaattggatagtcagtgcctctcaagatggaaggttaattgtgtggaatgcattgacaagccagaaaacacatgccataaagctgcattgcccatgggttatggcgtgtgcttttgcacccaatggccaatctgtcgcctgtggtggtcttgatagtgcgtgctctattttcaatctcaattctcaagcagacagagatgggaacatgccagtatcaagaattcttactggacacaagggctatgtctcatcatgtcaatatgtcccagatcaggaaacacgtcttattactagttcaggtgatcaaacatgtgttctttgggatgttactactggacagaggatatcaatatttggtggtgaattcccatcagggcatacagctgatgttcaaagtgtgtccatcaactcatcaaatacaaatatgtttgtctctggctcatgtgatacaactgtgaggctgtgggatatcagaattgcaagtcgagctgttcgaacctaccatggacatgaggatgatgttaacagtgtgaagtttttccctgatggccataggtttggtactggctcagatgatggcacatgtagattatttgatatgagaacagggcatcaacttcaggtgtacagtagggagcctgatagaaatagtaatgaactacctactgttacatctattgcattttcaatatcaggaaggctactttttgctggttactccaatggtgactgttatgtgtgggacacacttctcgccgaggtggtacttaatttgggaaacctgcaaaactcccatgatggccgtataagttgcctcgggatgtcatctgatgggagtgcattgtgtacaggaagctgggacaaaaatttgaagatttgggccttcagtggacaccggaagatagtttgaaggccaacttttctcccccatgttgtatgttccttgttgccccttaacaacggacagtggtgattggtgaccaactcgacttgttcctgggaatccctttgttgttttgtaagctctgttcgcgctatgtttaatggaaaaatgtgcaatttgtcagtgtcacggcgctacatcttgttgagttggtaactgtttatactgttattacgagaatatcagtaacgtgtgatctgcccttttctttgtac

SEQ ID NO: 181 - DNA, 1734 bp, Glycine max
  CDS (15)..(1532)
attcggctcgaggaatgagtggcggaggagaagagggagcaactctggagttcactccgacgtgggttgtggccgccttttgcacagtcatcgtcgccatttccctcgccgctgagcgcctccttcattatggcggaaagtttctcaaagccaaggaccagaagccgctctacgaagctctccagaagatcaaagaagagctgatgcttttggggttcatttccctgcttttgacggttacacaaaacggcattaccaaaatctgcgttcgaccctctttgacgctccacatgctcccgtgtaatctccacgacgctccagcaaaccacgaatctcatttccagacatttttccctggaacagccaggcgccttctctctggggaacactccacccccgagtccgcctctaaaattggttattgctctcgcaagcacaaggtgcctttattatctgtggaagcacttcaccaccttcacatcttcatttttgtcctcgctgtcgtacacgtctccttttccgtgctcaccgttgtctttggaggcgccagaatacgtcagtggaaacactgggaagattctattgcaaaacagaactacgagactgaccgagttctcaaaccaaaggtcactcaggttcaccagcatgattttatcaggggtcgttttgctggttttggcaaagactctgctatagtcggttggttgctatcctttctaaagcaattttatggatctgtgacaaaatcagattatgtgacattgcgacatggtttcattatgacccactgcaggacaaatccgaagtttaattttcacaagtacatgattcgtgccctcgaagatgatttcaagcaagttgttggtataagttggtatctttggctctttgtggttatcttcttgttacttaatatcaatggttggcatacgtatttctggattgcttttattcctgtcattcttttacttgctgtgggcactaagctggagcacataataacccaactagctcatgaagtagctgagaagcatgctgccatagaaggtgatttagttgtgcagccatcagatgatcacttttggtttcaccggccccgtgttgtcctctttttgattcactttatccttttccaaaatgcttttgagatagcattttttttctggatatgggttacatatggatttgactcctgtataatgggacaagttcgatacattgttccaaggcttgttattggggtatttattcaggtactatgtagctacagcaccctgccactgtatgcaattgttacgcagatgggaactcactataagcgggcaatatttaatgatcatttgcaacaaaacattgttggttgggcacagaaggcgaagaagaggaaaggactaaaagctgatggcaatcctggccaaggaagttctcaggagagtgctaatacaggaatccagcttgggtcaattttcaagaaggcaactgctccaggagacagttcttctgcccccaaagctgacggaatcagctcagtgtagctatttaagtgaagatttacagtcttattttgtaaagttgctcacagattgcagttttctttatattattttctttgctaacataatgtagcattgtgggacatgtgtttgacttggtgtacgcataaggtcgaagtactatatgagtagatgctagtaatgctattgtcaaaaaaaaaaaaaaaaaaaaaaaaaaagg

SEQ ID NO: 182 - DNA, 1906 bp, Glycine max
  CDS (48)..(1841)
gttttctccttcattctagtctagtctttttcttctttttttcccccatgtatagctccaagttcagaaagctgttttgttctgtgttgttttcatggctctgttttggaggtttggccatggcagcaggtgaaagtagcagcagctccagagacctagaccagacaccaacgtgggccgttgctgctgtctgtactgttttcatcttggtatccatagcactcgaaaagagtctccacaaagttgggacgtggcttggacaaaagaaaaagaaggctttgcttgaagctctggagaaggtcaaggctgagttgatgattttaggtttcatttcactgcttttgactttcgggcagagttacattgtcagaatatgtattcccgaaaagctggcagacaatatgttaccatgtccgtataaatataaggaggacaaaaaggcatcagatagtgaagaggaacatcgtaggaaacttttatcttatgaacgtagatatttagctgctgatactacctcgttcaaatgcagcagggagggacacgagccacttttatctgtcaatggattgcaccagttacacatcctcgtattcttcttagcagtcattcatgtgctttacagtgctattacaatgatgcttggaagactaaagatacgtggatggaaggcatgggaagcggagacttcaactcataattatgagttcgccaatgctgcttcaagatttagacttactcatgaaacatcattcgtgagagcccattccagttttttgactaggattcccatcttcttctacattcgctgcttctttaggcagttctataggtctgtaaataagactgactacctcactttgcgcaatgggtttatcactgtccacctggctcctggaagtaaatttaatttccaaaagtatatcaaaagatcattagaagatgacttcaaggtggtcgtgggagttagtcctatcctctgggcatcagttgtagtttaccttctcatcaatgttaatggatggcacaccgtactttgggcagccttaattcctgttgttataattttggctgttggaacaaaacttcaagccatattggcaaatatggctcttgaaatcacggaaagacatgcagttgtccaaggaatgcctcttgtccaaggctcagacaaatacttttggtttggtcagccacagttagttctacatcttatccattttgctttgttccagaatgcgttccaaataacatatatcttgtggatatggtattcttttgggttgagaaactgtttccgtactgactacaagcttgcagtagtaaaagtagctctagggattttgatgctatgcctctgcagctatatcacccttccattatatgctcttgtaactcagatgggttcaaggatgaaaacagcaatatttgacgagcaaacaaacaaggctctgaagaaatggcacatggctgcgaagaagaagcagggaggagcagtgacgctaggaaagtcgagtgcacgaatcatggatggaagccccattggtaattcttcaacagtgcactccactggccccacactacaccgtttcaaaactactggccactcaacccgctcctcatcaacagcgtacgaggatcaagatcaagatcatgaatatgaatccgatggtgttgagttgtctccgttggcgtcgcaaacaacaagcttcattgtaagagttgatcatggcgaccaacaacaagcagaacatagacaagatagtgagggagaaaccaacagtagtagtgaaggtgaattctcatttgtcaaacctgaccctgtggaaattagaaccaccacatagcatatgatcatatattcatctctattcttatacataaatctttacataaaaaaaaaaaaaaa

SEQ ID NO: 183 - DNA, 1537 bp, Oryza sativa
  CDS (106)..(1248)
ggatcctgagatctagacgtgaacgtgcttggtgggaagagagaggctcaggcatgagagcatgcctctaaaataatgtccgtgcttacctgtgtgtttgataacatgggctcatcctgtagcagatctcattctttaagtgaggctgaaacaacaaaaaatgcaaaatctgcagacattgacaggcgaattttgcaagagacaaaagcagagcaacacatccacaagctcttacttcttggtgcgggagaatcagggaagtctacgatatttaaacagattaagctccttttccaaactggctttgatgaggcagaacttaggagctacacatcagttatccatgcaaacgtctatcagacaattaaaatactatatgaaggagcaaaagaactctcacaagtggaatcagattcctcaaagtatgttatatccccagataaccaggaaattggagaaaaactatcagatattgatggcaggttggattatccactgctgaacaaagaacttgtactcgatgtaaaaaggttatggcaagacccagccattcaggaaacttacttacgtggaagtattctgcaacttcctgattgtgcacaatacttcatggaaaatttggttcgattagccgaagcaggttatgtgccaacaaaggaggatgtgctttatgcaagagtacggacaaatggtgttgtacaaatacaatttagtcctgttggagaaaacaaaagaggtggagaggtatataggttgtatgatgtaggaggccagaggaatgagaggagaaagtggattcatctttttgaaggtgttaatgcggtaatcttttgtgctgccattagcgaatatgatcagatgctatttgaagatgagacaaaaaacagaatgatggagaccaaggaactctttgactgggttttaaagcaaagatgttttgagaaaacatcattcattctgtttctcaacaaatttgatatatgcgagaagaaaatacaaaaggttcctttaagtgtgtgcgagtggtttaaagactaccagcctattgcacctgggaaacaggaggttgaacatgcatatgagtttgtcaagaagaagtttgaagagctctacttccagagcagcaagcctgaccgtgtggaccgcgtcttcaaaatctacagaactacggccctagaccagaaacttgtaaagaagacattcaagttgattgatgagagcatgagacgctccagggaaggaacttgattcagagctaagactaggttgtaagtcacacagggaaggtaattaggacggcgagaggaacaaagtttcacactgtcacagctttatctgttgtaattcttttacacgtggaccattgattgaccttttggttcttactgtgggctgttcaggtctgtaccctattttttgttctctagttagccattgtgcaaattttccttgaatcagattctctacctgttgtctatgtgtgttatcttggtctgttaatttgcatagcccacttgttcattaaaaaaaaaaaaaa

SEQ ID NO: 184 - DNA, 1183 bp, Glycine max
  CDS (210)..(536)
cggctcgaggagaaagggcttttttgagtaataggattattatcagtgaaaagagttcccttttttctctgtaaataaaagggttgttgttattattattattgcctagtgtttgttttcagatctgtgtcgtattattaagcagaacaagcaagggtgcaaagtgggggtgtttttttcgctggatgagtggtagctgacactcacttatggcgtctgaaacggcgtcgtcggcggatgaagaaaccgttgttgttgtttcggctgctgcgggtgcaggaggaactgataagagaggcaagcaccggattcttgccgaactgaagcgtctcgaccaagaatccaagtttcttcaggaagaattggaagagcttgagaaaacagaaaatgtgtcgaccatatgcacagaattgctacaaaacatagacactaggcctgatccattactcccagaagtccatggacccgtaaatctcttatgggatagatggtttgaagggcctcaagatccacaggcatgtagatgttggatactttgatttgaagctgtgtcaattgccttgcgttgcaaataggatgccacatataactgcattaaagtgactctggagctgaagaaaatgtttgatgacatgttataccacgcacactaattctataatggatccttgcttttattacattagattctgttccgaatactgtttatgtgtaatcacattcatatactgcattcaactgagaagtatcattatttgtgcttgtaatcccaatccaactgttaatgcacctgaccttggtggactttcatgtgtgcacgagacgttagagacattttagcatcattcagccttgaaggtggtgtggcttttggaaaggcctttacaatgcaatggtttgacgagtcatcaactagtcctgaatgataacgagattttttgggcagagacctcttggggttgggagagcaaagaaagctcataatcccttgtttgagtcatttcacaattaaatgttatgataagattttgtaatcatgttacttctaagcctttttaagttttggtgttttatttaacaagccattactttttgcgtgccaaaaaaaaaaaaaaaaaaaaaaactaaaaaaaaaaaaaaaaaaaaaaaaaaaaaaaaaaaaaaaaaaaaaaaaaaaaaaaaa

SEQ ID NO: 185 - DNA, 1828 bp, Zea mays
  CDS (57)..(1583)
ctggaactgaaggtggcgggagccgagtgatccggcggtgagctgagcggggcgggatggcggcggagcaggggcggtcgctggcggagacgcccacctggtccgtggcaaccgtcaccacgctcatggtcgctgcctgcttcctcgtcgagcgctccctctcgcgcttcgccaagtggctgcgcaagaccaagcggaaggccatgctcgccgcgctcgagaagatccgcgaagagctgatgctgctcggagtcatctcgctgctgctcagccagacggcgcgcttcatatcggagatctgcgtgccgtcctcgctcttcaccagccgcttctacatctgctccgagagcgactaccaggacctgctgcgcaacacggacgccaaccagacggcgctcgacaagaacatgttcggtggccaacggctgcacgtctgtggcgagggccatgaaccttttgtttcgtacgagggccttgagcagctgcaccggtttctcttcatccttggtatcactcatgtgttgtacagttttgtaacagtggttctgtccatgatcaagatctatagctggaggaagtgggaaaccttagcaggtccaattgctgctgaggaattgaaagctaggagaaccaaggtgatgagaaggcagtcaacctttgtttttaacaatgcttctcatccatggagcaaaaataaaatacttatttggatgctttgctttttgcgtcaattcaagggctccataataaggtcagactatttggcactgaggttgggctttgtcacatatcacaagctaccacattcatatgacttccataaatacatggtacggagcatggaagatgattacaatgggactattggtatcagttggccactttgggcatatgcgattgtctgcatattaatcaatgttcatggtatcaatatatatttctggttgtcctttgttcctgttattctggtgcttctagtgggtactgaacttcagcacgtcattgctcagttggctttggaagtcgctgaggcaacagcgccttatgttggctcacaacttaaactgcgtgatgatctattttggtttggaaagcctcgggtactctggtggcttatacagttcatttcatttcagaatgcttttgagctggcaacattcttatggtctctgtgggaactcagtgcacaaacatgtttcatgaagcactactacatggttgccattcggttgatttctgggctcctagttcagttttggtgcagctacagcacactgccgctgaatgtgattatttctcagatgggttccaagttcaagaaatcactggtctcggagaacgtgagggagtcgctgcacagctggtgcaagagggttaaggacaggagccgacacaatccgctcttctcgcggaacgggaccctcacgaccagatccgtgtgctccctagacaccacctacgagacggatcacgagacgaacacggtgtgcacgctgtcgaggacggcgtcggcgacgtcgctggacgaccagttgaccgtggtcaccgtcgatgacgagccgtcctgcattgagaaggatgtctgacgcagttgctgattcgccaaaactacatactgcaccgacctgtgtgttaggaggtactctaggactgaaatgaatgtatatgtgcagtggttgcccctatcgtggcagtgaccatgtgtatatatagaactaaaaaaactataatgtctcttagctgagagtgagaggctgtacatggaaatacttgaggcagcttggaccaaatacaaaactgcatcttttcgagataaaaaaaaaaaaaa

SEQ ID NO: 186 - DNA, 1629 bp, Zea mays
  CDS (220)..(1329)
cccacgcgtccgcgctgcctttcttctactgttcaccccgcgtgcgctcgctcactcgctctctcccctctggctctgagtggcgctagtgggcgaccgccgccgcgtccctccgtcaggtgcccaggtgtagcctcgtcagcccctccgtcaggtcttcgtcggccccctcgccgacgagcacccaccagccaggcatgagagcgcgcttctagaataatgtctgtgcttacctgcgtgattgaaagcatgggctcatcctgtagcagatcccattctttcgacgaggctgaagcagctgaaaatgcaaagtctgcagacattgaccggaggattttgcaagaaacaaaagccgaacaacacatccacaagctcttacttctcggtgctggagaatcggggaagtctacaatatttaaacaaataaagcttcttttccaaactggctttgacgaggcagagcttaggagctacacatcagtcatccatgctaatgtgtatcagacaattaaaatattatatgagggagctaaagagttagcccaagtggaaccagattcttcaaaatatgtcttatctccagataatcaggagattggagaaaaactatcagaaattggtgccagattggaatacccatcgttgaacaaagaacgtgtacaggatgtaagaaaactatggcaagatccagccattcaggaaacttattcacgtgggagtattctgcaagtcccagactgtgcacagtacttcatggaaaatttggacaaattatctgaagaagattatgtaccgacaaaggaggatgtgcttcatgcaagagtacggacaaatggtgtggtagaaactcagtttagccctctaggagagagcaaaagaggcggagaggtctataggctgtacgatgtaggaggccagagaaacgagagaaggaaatggatccatcttttcgaaggtgttaatgctgtaatattctgtgctgccattagcgagtatgatcagatgttatttgaggatgagacaaagaacagaatgatggagactaaagaactctttgattgggtgctaaagcaaagatgttttgaggtccctttaagcgtgtgcgagtggtttaaagattaccagcccactgcacctggcaaacaggaggtggaacacgcctacgagtttgtaaaaaagaagtttgaggagctctacttccaaagcagcaagcctgaccgtgtcgaccgagtgttcaagatctacagaacaacagccctggatcagaaacttgtaaagaagacattcaagctgatcgacgagagcatgaggcgttccagagaaggaacttgatcgaggatgtggtgttataagccacaagacaagtaactaggatggtgtgaggagcagaaagtttacagtgtcgcggctttggccgattgtgattctttttacatgaggaacatttgttgatctttttgccccaccacaagccagtaaaagtatctgttttgcgctggtcttggggaggtttgggtcgtctccatttccccccaatgttaggacaaaatgtacttaccatcttttggagctctgcctgtttggcctcacaatatcaagttcattcgttgttgtctaaaaaaaaaaaaa

SEQ ID NO: 187 - DNA, 1251 bp, Zea mays
  CDS (58)..(1059)
ctttccctcgcgccgccgccaacgcaacccttgcagccccaatccctcacagcaaccatggctggcgcgcaggagtccctctctctggtgggcacgatgcgcggccacaacggcgaggtgacggcgatcgcgaccccgatcgacaactcgccgttcatcgtctcctcctcccgcgacaagtccctgctggtgtgggacctgaccaacccggtccactccaccccggaatccggcgccaccgccgactacggcgtccccttccgccgcctcaccggccactcccacttcgtccaggacgtcgtcctcagttccgacggccagttcgccctttccggctcctgggatggagagctccgcctctgggacctctccaccggcctcaccacccgccgcttcgtcggccacgagaaggatgtcctctccgttgccttctccgttgacaaccgccagatcgtctccgcgtcccgcgacaagaccattaagctctggaacaccctcggtgagtgcaagtacaccatcggaggtgacctcggtggcggcgagggccacaacgggtgggtctcctgcgtcaggttctccccaaacacatttcagcccaccattgtctccggttcctgggaccgcaccgtcaaggtctggaaccttacgaactgcaagctgcgctgcactctcgatggtcatggcggatatgttaacgccgtcgccgtgagccccgatggatcgctctgcgcctccggcgggaaggacggtgttactctgctgtgggatttggctgaggggaagaggctgtactcgctggatgcgggctccatcatccactccctctgcttctcgcccaaccgctactggctctgcgctgcgacccaggactctgttaagatctgggaccttgagtcgaagcacgtcgtgcaggacctcaagcctgacatccagatctccaagaaccagatcctgtactgcacaagcttgagctggagcgccgatggaagcaccctctacactggctacaccgatgggtctatcagggtctggaagatctctggatatggctacgcaggctagatgtcgaaatccagtcgagggtctaggaggtcttgttctgcgaaacattgcaatgcggaacatagttttttttatgtgagttacatcgtctgcttggtactttatggtcgcccaactatctaagcttagctttgttaatgaagtttattaaatttgcttgtttggttttaccttgtgaaaaaaaaaaaa

SEQ ID NO: 188 - DNA, 1043 bp, Zea mays
  CDS (64)..(407), (514)..(655)
cccttccgttccgtccgtccacttgccgttgccgaccacaacccgctcccggaggacggcgggatgagggggcaagccaacggagtggaggaccgccggcagcggggcgacgaccacgaggcggacaacgacggcgaggaggcggaggaagaggagggcgacgacgagggccgccaccggggccagggcccgccgcagcagcggcgccaccaggcccagaggccgaactccggcccgcagcagcagcagcagccgcgcccgccgccgccgctcgccaggaacgtcggctacgtcggcaagcatcgcctctccgccgccatcgcccgcctcgaccaggagctccagtccctccaggaggagctggacgagcttgagaccatggaatctgcgtccgcggcgtgccaggagtaagcagattttgagtgtgtagcgttgtgttttccacatcatcatcatcatcacgtgctgtttcttctcgttgttgatgtatggctgcccttgtgaacgaaacagagtggtcacgagtacggaagggaagcctgacccgcttcttcctgtcaccagtggcccggagaactcgtcttgggacaggtggttccagcgggtgcgttcccgcagcaacaaatggtgggcatcgaaaggccctgacttctcgtagctcctgcaaataaagcagagaccatcctcatcagtcgtgtgcagattagaatgaaacacgttgagatgtatcgtccattggtgtcctggggaaacagaacaggcggcggcggcggcggcgagtgcggtgtggctctcgcaacgcctgatagtttttttttttttttgagagaatcattgtgtacgtagtaatccctaacgaggccgaacatagatgcatccacataggcctggttgttgtgtttcctagagattctgactcactaggtcggattcctgatggtcatgcgatctcgctgttctttcttcaaacgtgaagaatcacattgtctttgaaaagtttcagaaaaaaaggagaatcagattgaacgttgttaaaaaaaaaa

SEQ ID NO: 189 - DNA, 5401 bp, Oryza sativa
  CDS (48)..(1040), (1127)..(1264), (2100)..(2204), (2500)..(2682), (3113)..(3290), (3374)..(3618), (3937)..(4109),(4430)..(4627), (4988)..(5378)
gaggtgaggaggaggaggttaggttacctaggtttttggagggggagatggccggagcgggagccgtgggggggagcaactgggaggagatggtgaggaggatgctcccaccggggaccaccatcccggaggcgccggccaacctcgactattcgattgcgctcgagtacgacggccctccggtgtcctacgagctccccaggatcgatcccgtcgacctgccggcgattcccaccgcgcagcccgtctccggcccgctggtgcccgggaggagcaacggcgtggtggctccggtcgtcaggccggtgtttatgccgccggtgcaccggaagcaggatgctcaccgtgccgagccaccgccggttgcggcacagggtaggaggaggagaagctcggaatcggtcgattcggcgccgcagaatgaggggttctctgatgatgatgactcatgctcggtgtcgcaagaatccgcgcacaatttccatgggcagagaggtggtaggacagctgctcaggagggaagaagagctcaggttgtcacatttggggtcactgaggacagcaggtatgagagcaaagagtttgatgatgtgtcggaacagtacgtggcggtgaccaagaaggagaagagagggaggacctgcagccgttgcggtaaaaggaagtgggagagcaaggaatcatgcattgtttgcgacgcgaggttttgcagctactgcgtgctcagggccatgggctcgatgccagaagggcgcaagtgcatcacttgcattggccagccaatcgatgagagcaagcggtcgaagctcgggaagggttcgaggatactatcacgtctgctcagcccgttggaagtaaggcaaatactgaaagctgagaaggaatgccaagcaaaccagctccggcctgagcaactcatcataaatggttttcctcttaatccagatgagatggccagcttgcttagttgccaacggcctcctcaaaagctcaagcctggaagatattggtacgacaaggagtcaggcttgtggggaaaggtaagcctgttagtgttggtaggagaagagcataccttcttatgcagtctgagcttttgctaatgacattttgttcctgctgataggaaggagaaaagccagacagggttgtcagcactaacctaacctttaatggaaagcttcagcccaatgccagtaatggcaacactcaggtttatatgaatggaagggaaattaccaagattgaactgagagttctgaaggtatcagtgttctatcattgtacatctatctttgaaagcgggtacaattgcagaaatatccattatgaaacaatattaatatatatgacacatttttttaagactatgtctaagttatatcatagacacactttcttataggcatacagcctttcatagaatttcatatgattgttcaaaccaagaagacaatattacgggagaaactaggtgtatactgtataccatccaaattttcttctttagaaatataccacataccacaaaaaataaagtttactttaataccgtccaaacttcataactcttgtaaattgaccactatcattaccacctgttggaccaactaatagctattgaactagatggctgatctggtgtggcttggctttgggtaagaaggattggcctctgtctagtgcctcactttccttctgcggttctgtctactgtcctggtttggaagaagtcaaaccaagccagatcagccatctagttgagtctctcttaggagattggacgtgaggtaacgggaatagtagttgatgagatttgtgaagtttggatggtcttaaagtgaacccagcaattttggtgttatctatcttaagaggaaagacttgagtggtatacccaatgttgtattctattaatagcaaaacacatgaagatgaatgtagcatgtagtctgactataatttcaccagattaagaaagagtgtaaggactatgtgcgtggtttttaggaaacgaataaggcgattttttttgctggtactataattgtgctatcactatcactgaatttgcctcaatatctgaatcattcttgtagattgcacaagttcagtgcccccgtgacactcacttttgggtttaccatgatggtggctatgaggaagaaggccaaaacaatatcaaagggaagatatgggaatcggtatgtatcttgctcaaaggagttctaaccactttggcaatcatggattagctcacttttataatcgtgttctattttccttcttttcctctgctgcccctctccccgtacataatccagtgcattctcccttccctctttgtaatttatcttatttttaatatttaatgcagtaggagcctctcctactgtttcacgtaaagaaaaaggagttctaacccattcattgtacttcctaaaactactgcatgtcttgttgttttcttaacatgattttgcatgtccttatttgcagcctgtgacacgttttgcatgtgccttgttttcactaccggttcctccagcaaactctgacgaaccaaaggacgaagctccttattcagcaagaactgttcctgattacttagatcagaaaagaatccaaaagcttcttattcttggatcgcctggagctggtacaagcaccatattcaagcaggtacgaccaaatttgacatttaaaactgcagtaaacttttactttgttatacatctcttagggtggactctacctttacctactggccctgtatgatatacagcttgaatttgatttatagtctccgtttagtgacatagaaaccttctcgccgttcggaagcacaggactgcaggttaactgttataggtgacaatcacatatgcaacgtgacatgacattctgcaaactatcactgatcaattttcatgtgtagtttagttatctctggtgtgtttcttttccaataaatgcctgcaaatttttatggagcaccacacaagttattcattctgatatgtggatgcacagtttccagtggacaattgaggagtcagccctattatttatcttgtatacatttgcatgatgtttttttttctcaaaacaggcaaagttattatacgacactaggtttacccaagaagaacttgatagtatcaaacttatgatccaaagtaatatgttcaagtaccttgggatccttcttgagggccgtgagcgttttgaggaagaggctttggctggatcgaataacccaagctcagaggatgagaatacgcagcatggtagaaccacagctaacacatattcttcacttctatttttcagggctatatgcaatatctttaagtttttcttattgatgcagatggaaataaatcgaatggttcagattcttgcatatactcgataaatgcaaagctgaagaagttctcggattggcttttggatataatagcaatgggagacctcgatgcattcttccctgcagctacgcgtgaatatgctccaattgttgaggaaatgtggaaggatcctgccatacaagcaacatataaaagaaaagacgaattgcattttctccctgatgttgccgaatatttcttgagcagggtatttaactcagcttatatattaaacaaagagtgaatttatcattgaaaacttgcattattattcacaacctgcctttgtgcattgtgctacaccagtacctattatggttataactttataagtgtcagtgaatccctctagattcctatatcatatctgttcctaaaaattctacaacagcttgaaccactaatcatttgccttactccggcaccaagcataacataatgtgcccctgcacttactttttttttttgtgtacactataggtgtttgaatccctcattgacttgtctttttatgacatccttgcaggccattgaagtatcaagtaatgagtatgaaccttcagagaaagatataatatatgctgaaggagtaacacaagggaatggattagccttcattgagtttactctggatgaccgtagccctatgtcagaaatgtacactgacaatcatgagcctcactctcagacactaaacaagtaaactctttcttcatgactcatgcctgaagtgcatataaatcctttaatagtacacatctctacatatccatataccctaaacagtgccttttattttccttttccatccgtcattttttttgttactagctctctataaataaaatagccttagatattaaattgttggcaatgtatctttcgattgtggtaaaatgcatttctactggtcagtgaaataggtaggctacctgctctttgcttggggtgattatttatttgccctgcgaagcaagtaccggaaagctattgtctcatcagcttttattccttttcagatatcagctgattagagtaagtgccaagggaatgaatgagggatgcaagtgggtggaaatgtttgaggatgtcagcatggtaatattctcggtagcactcagtgactatgaccagctgggggccccttcaagtggtggcaacagtccccttgtgaataagatgatccaaagcagggacttgtttgaggctacaatcaggtactattggcattagccagatagttttgtaactttaacagttccataattgcgcataatcagaaaaaagatatttaaagtgacaagtgatagatcaagggaggttggtcttgttccaattgaatctagtaatagtttgggaggattgcatacttcatatttgcgaataccgtattgcttgtgtacaaaatggacaatgttacagcttgtttcaattgaatctaatagtttgggaagattgcacatttcatatttgcgaataccatattgcctatatataatgcgaacaatgttacagctttcctgaaattagtaaaatctcattccaggaccaaagttactaacctatacttgtcccaggcaaccatgtttccgcgacatgccatttgttcttgtgctcaacaagttcgacctcttcgaggagaaaatcgggcgcgtcccgctctccacctgcgagtggttcagcgacttctgccctctccggactcaccacaacaatcagtcgctggctcaccaggcgttctactatgtcgcgatgaagttcaaggagttgtacgccgcctgcacggatcgcaagctgttcgtgtggcaggcgcgagcccgcgacaggctgaccgtcgacgaggccttcaagttcatcagggaggtgctcaaatgggaggatgagaaggatgggggtgggtactacccagatgagtccttctacagcaccacagagctcagctcctcacgtctgatcagacaagaatgatgcacattttgcccagaaagaaa

SEQ ID NO: 190 - DNA, 1183 bp, Glycine max
  CDS (210)..(518)
cggctcgaggagaaagggcttttttgagtaataggattattatcagtgaaaagagttcccttttttctctgtaaataaaagggttgttgttattattattattgcctagtgtttgttttcagatctgtgtcgtattattaagcagaacaagcaagggtgcaaagtgggggtgtttttttcgctggatgagtggtagctgacactcacttatggcgtctgaaacggcgtcgtcggcggatgaagaaaccgttgttgttgtttcggctgctgcgggtgcaggaggaactgataagagaggcaagcaccggattcttgccgaactgaagcgtctcgaccaagaatccaagtttcttcaggaagaattggaagagcttgagaaaacagaaaatgtgtcgaccatatgcacagaattgctacaaaacatagacactaggcctgatccattactcccagaagtccatggacccgtaaatctcttatgggatagatggtttgaagggcctcaagatccacaggcatgaagatgttggatactttgatttgaagctgtgtcaattgccttgcgttgcaaataggatgccacatataactgcattaaagtgactctggagctgaagaaaatgtttgatgacatgttataccacgcacactaattctataatggatccttgcttttattacattagattctgttccgaatactgtttatgtgtaatcacattcatatactgcattcaactgagaagtatcattatttgtgcttgtaatcccaatccaactgttaatgcacctgaccttggtggactttcatgtgtgcacgagacgttagagacattttagcatcattcagccttgaaggtggtgtggcttttggaaaggcctttacaatgcaatggtttgacgagtcatcaactagtcctgaatgataacgagattttttgggcagagacctcttggggttgggagagcaaagaaagctcataatcccttgtttgagtcatttcacaattaaatgttatgataagattttgtaatcatgttacttctaagcctttttaagttttggtgttttatttaacaagccattactttttgcgtgccaaaaaaaaaaaaaaaaaaaaaaactaaaaaaaaaaaaaaaaaaaaaaaaaaaaaaaaaaaaaaaaaaaaaaaaaaaaaaaaa

SEQ ID NO: 191 - DNA, 4001 bp, Synechocystis PCC6803
  CDS (437)..(3556)
atcaaccagactcccaggccgcccaccaccatggtgataatggtcacaatccaaaaatcactcacttcctggagcatcaccaaccaggcaagaacaacgaacgggacgctgttggcaattaaatgaccaaaatcggcatggagaaagggtgcaaagacaattcccctcagaccttccaaggagcgggggtaaatgccaaattgatccaaactaccccgaaaaacaaacgcatctaagatttccagaagccaaaaaatggctaaaaaactgacaataatcgagaactgactttgcagggtggcccgcagggcagttttggaattttggctcatggtggtgacaaagagcgacggctgaggttaggagggccagggacccatccataatcaaggataaccaatcgccctagaatgggacagaccagaaactagatcctatggcgactatccacggtaattggcaaccctcccacggggaaaacggcggcaaactgtttctttgggcggatacctggggtcatcctttgccagaaaccattggcgatcgccatccctttgcgttggatctgccggatttgctacaggcctggtcgaatttgcccctggccttccccaaggcggatggggtgacagaggcagcccttactctgcatttacccagccatcgccagcaaaaaattcccctaccctttgtcacagggcaagatccggtggccatggatgcgaaatatctccactggcgatcgtggcaggtaaccggggtaaatctgaccccaagccaaacgttaacgttgctccaatctattcccctggggggccaagccttagctaacttaggatcagagttttacttttacggtcaactgcaccgctggtgtttagatttggtgctacggggtaaatttgtgccgggactggagcaaaggggggaagacggtaattactatgcccaatggattcctatcctcgatagcatccaagaccaaacccatttagcccaatttagccagagagtacctgcctgcgccctggccaacctgactgactcccaggagccccaaatgttggtggtggatttactacaaaaattattgcaagcccaaattggtgccgtcagtcccagcctagccaacgttaaagaagtctggttgaatgattggctccggggattaacccatggggggcaaacctccctcggcacaggcaaagctctacaacgattagccacatccttagaccattggtatttaccagtccagaattatttgggccaaaaaaataaccaagctttagcccaacggcaatggcggggggctctgcggttacaacctccagcggacgatggggggggaacctggcaactggattatggtttacaagccctggatgacggggaattttggctcccggcggcttccctctgggccatggccggcgatcgcctggtgtggcagggaaggagggttgaccagggggcggaaagtttactgcggggcttaggggtagctgcccaaatttacgaacccattgctgcaagtttgacggaaaggtgtcccacgggctgtgggctagatgccatccaagcctacgaatttatcctggcaatcgcccatcaattgcgggatcgggggttaggggtaatcctcccgccggggttagaacggggcggcaccgccaaacggttaggggtaaaagtggtgggggaagtgcaacggcaaaggggccagcggctaactctgcaaagtttaattaattacgacttgcaactaatgatggggagcggggacaatgcccggttattgacggccaaggactttgaagcgttactagcccaaaaatctcccctggtggtgctggacggagaatggattaccctgcaaccggcggacgtgcgggcggccaaggtcattttacagcagcaacaatctgccccgcccctcacagtggaggatgctctgcgcctcagcattggtgatttacaaaccgtctctaaactgccggtgacccagtttgctgctcggggcatattacaggaattgatcgacaccctccgtaacccggaaggagtgaaagccattgctgacccaccgggctttcagggtactttacggccctaccaagctcggggagtgggctggttagcttttctggaacggtgggggctgggggcctgtttggcagacgatatgggtttgggaaaaacaccccagttgctggcttttctgctccatttagccgcggaggatatgttagttaagccggtgttgattgtttgtcctacgtcggtgctgagcaattggggtcatgaaattaataagtttgcgccccaacttaaaaccctattgcaccatggcgatcgccggaaaaaagggcaaccgttggttaaacaggtcaaagaccagcaaattgtcctcaccagttacgctttactgcaacgggattttagtagtttgaaattggtggactggcaggggatcgtgctggacgaagcccaaaatatcaaaaatccccaagctaaacagtcccaggcggcccggcaattgccagcgggttttcgcattgccctcacggggactccggtggaaaatcgcctgacggaattgtggtcaattttagaatttttaaatcccggtttcctgggtaatcagagctttttccaacggcgctttgccaatcccatcgaaaaatttggcgatcgccagtcgttgttaattttgcggaatttagtgcggccgtttattttgcggcggttaaaaaccgaccaaaccattattcaagatttaccagaaaaacaagaaatgaccgtcttctgtgacctttcccaagagcaagctggtttatatcaacaattggtggaggaatccctccaggcgatcgccgacagcgaaggcattcaaaggcacggtttagttttaaccctattaaccaaactcaaacaggtttgtaaccatcccgatctattgctgaaaaagcccgccatcacccacgggcaccagtccggcaagctaattcgtctggcggaaatgctggaagaaatcatcagcgaaggcgatcgggtgttaattttcacccaatttgccagttggggtcatttactcaaaccctatctggaaaaatactttaaccaagaggtgctctatctccacgggggcactccagcagagcaacggcaagctctggtggaacgattccaacaggaccccaacagtccctatttatttatcctttctctcaaggctggcggcacagggttgaacctcacgagggctaaccatgtgttccatgtggaccggtggtggaatccggcggtggaaaatcaggctaccgatcgtgcttttcgcattggccaaactcgcaacgtccaggtgcacaaatttgtctgtacaggcaccttggaagaaaaaattaacgccatgatggcggataaacaacaattggcagaacaaaccgtggatgccggggaaaattggctcacccgcctagacaccgataaactccgtcagttgcttaccctctccgccaccccggtggattaccaagccgaagcgtccgattgatgaaagcacaaaaaaatacagtagggaaaattcatctcctactgtgggcctcgatttaacttgaggtcgagttatttattttgctaaagcaatttccctgcttagagcatgtttggaaagttgagttttggctgtttaatcgcccctagccccccttgggaagaggggaactgtcgcaaaagtccccttttttaagccggagctttagtgaggagatttagggggataaatacctagccttgcacttttcaaacactttcttagaaaatttgctagacagaaagttcgctcagttccctggtcatatggtcaaagggggaagcaataaaatctgtgctgttcaggctggaatcctctgccatggcttcaatcatttccttcatgatctgaatgccccgcaccgtgggcccaatgggtacgcccagggaattgtaggtttcccgta

SEQ ID NO: 192 - DNA, 1190 bp, coliphage T4
  CDS (603)..(1148)
gtacattgaatggcttgaaactcaaatttctttttctgaccgaatgattcagcaatataagcgattgcatcaaatgttttacaatacttgaaaataataaatacccttatctatttaaggtaagggtttattatgttattgactggcaaattatacaaagaagaaaaacagaaattttatgatgcacaaaacggtaaatgcttaatttgccaacgagaactaaatcctgatgttcaagctaatcacctcgaccatgaccatgaattaaatggaccaaaagcaggaaaggtgcgtggattgctttgtaatctatgcaatgctgcagaaggtcaaatgaagcataaatttaatcgttctggcttaaagggacaaggtgttgattatcttgaatggttagaaaatttacttacttatttaaaatccgattacacccaaaataatattcaccctaactttgttggagataaatcaaaggaattttctcgtttaggaaaagaggaaatgatggccgagatgcttcaaagaggatttgaatataatgaatctgacaccaaaacacaattaatagcttcattcaagaagcagcttagaaagagtttaaaatgacaattgaaaaagaaattgaaggattaattcataaaactaataaagaccttttaaacgagaatgctaataaagattctcgtgtttttccaactcaacgggaccttatggctggtattgtgtctaaacacattgccaaaaatatggtcccgtcttttattatgaaagcgcatgaaagcggaattattcacgtgcatgatattgattattcccctgctcttccatttactaattgctgtttagtagatttaaaaggaatgcttgaaaacggatttaagcttggtaatgcgcagattgaaactcctaaatcaattggagttgctactgcaattatggcacaaattactgcgcaagttgcttctcaccaatacggcggaacgacttttgcgaatgtagataaagtactttctccttatgttaaacgcacctatgcaaaacatattgaggatgcagaaaaatggcaaatcgctgatgcgttgaattatgctcaatctaaaacagaaaaagacgtatacgatgcattccaagcttatgagttaacgtaagtcaagctcatgtaaaatctgcctaaaacgggaaactctcac

SEQ ID NO: 193 - DNA, 939 bp, Zea mays
  CDS (106)..(708)
cccaaattcttgggtggacccacgcgtccgcccacgcgtccgaaaaaccctcgctccccacaacccgccgccgcccacgccgccgcctgtaccagcggcgtcaagatgagtcggcaccctgaagtgaagtgggctcagaggatcgacaaggtttacatcactgtacagttacctgatgccaaggacgctaaggtcaatttggaaccagatggtgtcttcacattctctggcagtgttggtacaaacttatatgaattgaaactagatctgaatgacaaagtaaacgttgaggctagcaaaataagtgtgggtgtcaggtccatattctgtattgtagaaaaagctgaggccaaatggtggaagaaacttgttcgagatgatcaaagggcacctcactttgtgaaagttgattgggacaaatgggttgacgaagatgatgatggtgctgatgtcaacttggatgggatggacttttcgaattttggcggcatgggtggtatgggtggcatgggtggtatgggtgatatggctggcttgggtggtcttggtggcatgggtggaatgggcggtatgggtggtatgggaatggatgattttgaggatgatagtgatgaagaagaagtgtcgaaacctcaagctgccggacatgctgctgaggccgagaagactgagtcggcggaagccaagactgagtcggctcagagcagttgaagatgctttcgacatgatctaaactagttgtatcgtcaagttaattctgctgaatcgatggacaaacttctacgttgttggcactggccgatcccagtgacttgccctaaaatttacgttctgtctttacatgggcatcctagtgttgtgctcatcacattattgatattgtttctgtgatgcttcctttggtcgacaatcatgtgctggagtttggtttaaaaaaaa

SEQ ID NO: 194 - DNA, 2019 bp, Zea mays
  CDS (99)..(1757)
ctctctctcgaaccttcttccaaagcacccgaaccctagtgatctcggaaccctagccgcgcgcggatctcggcttttccccttcctccacgccagccatggacgaggacttcgagatgcctcccgccggcgccgatgagatgatgggcgacgacgagatgggcgacttcggcggcgacgagggcccggtgatgaaggtgggcgaggagaaggaggtcggcaaggaggggctcaagaagaagctgctcaaggagggcgagggctgggagactcccgaggtcggcgacgaggttgaagtgcattacacgggcacgctccttgatgggacaaaattcgactcaagccgtgatcgtggagaacccttcaagttcaagcttggacaaggtcaagtgataaagggttgggatcaaggaatcaagaccatgaagaaaggagaaaatgctatttttaccattcctccagagctggcttatggagcatctggttcacctccaactatcccacccaatgcaaccctgcagtttgatgttgagctgctttcatggaccagtgtcaaagacatttgcaaagatggcggcatattcaagaagatccttaaagagggagagaaatgggagaacccaaaggatcctgatgaagtacttgtgaaatatgaggcccgtctggaagatggtactgttgtatccaagtctgagggggttgagtttactgtgaaagatggctacttttgtcctgccctggccaaagctgtcaaaaccatgaaaaaggcagagaaggtgctccttacagtaaagccacaatatggatttggtgagaagggtagaccagcagctggagaggaaggtgctgtgccgccaaatgcttcgctgctcattgaccttgagttgatttcatggaagactgtcacagaaattggggatgataagaaaatccttaagaaggttctcaaggagggagaaggttatgagcgtcccaacgagggtgctgttgttgaagtcaaaattatcggaaagcttcaggatggcgcggtgtttacaaagaaggggcatgacgaagagccatttaaattcaagaccgatgaagaggaagttattgccggtcttgatcgtgctgtgttgaacatgaagaagggcgaggttgctcttgtcacaattcctcctgaatatgcatttggttcaactgagtcaaagcaggatcttgctgttgttccacctaacagcacagtaatatatgaagttgagcttatttcatttgtgaaggacaaggagtcgtgggacttgaacaatgaagagaagattgaggctgctggtaagaagaaagaggaagggaatgcattgttcaaatcgggcaaatatgctagagcttccaagcgatatgagaaggctgccaagtacattgagtacgacacttcgttcagtgaagatgagaagaagcaatccaagcaactgaagatcagctgcaacctaaacaatgctgcctgcaaactgaagttgaaggattacaaggaagctgcgaagctttgcaccaaggttctggaactagacagccaaaatgtcaaggctctctacaggagggtgcaagcttacattcaacttgctgacctagagctagcagaggccgatatcaaaaaggcactggaaatcgatcctgacaacagggatgtcaagttggaatataagatcctgaaggagaagatcaaggagtacaacaagaaggacgccaaattctacagcaacatgttcgccaagatgacaaagtagcttttggggtggaggatgttgtggtgaagcgaagggattaaaaacaccgatttctgctgccgaaggacttcgcccgttgcttaacttctcgcttttcgcatactttgtagtcaattagtgtgcacggatgcttggatatgtgaaactgaggaacatgtacttcgaggattattattggttctgaatttttatgttttctggttcttgttaggaccgttgaatgttctctctatataattttcggacacatgttcttaat

SEQ ID NO: 195 - DNA, 2734 bp, Saccharomyces cerevisiae
  CDS (333)..(2462)
agcttaatcggattattaactcatacgcttgtcacatattgttcgaacaattctggttctttcgagtttcgcagaactttttgaatttttcttttttttctagaacgccgtggaagaaaaacacgcgcatggttttatgagcggttaattctcatcttaataccaaccaggtccttccgccaccccctaaaacatataaatatgcagcttatcccttcaattcttaacatctgtgacctcctcatttcttcccgctgtattagagttcaagaaatcatacctgatagaaaatagagtcctataaacaaaagcacaaacaaacacgcaaagatatggctagtgaaacttttgaatttcaagctgaaattactcagttgatgagtttgatcatcaacaccgtctattctaacaaggaaattttcttgagagaactgatatctaatgcctcggatgcgttggataaaattagatacaaatctttgtctgatccaaagcaattggaaacagaaccagatctctttattagaatcactccaaagccagagcaaaaagttttggaaatcagagattctggtattggtatgaccaaggctgaattgattaataacttgggtaccattgccaagtctggtaccaaagccttcatggaagctctatctgctggtgccgatgtatccatgattggtcaattcggtgttggtttttactctttattcttagttgccgacagagttcaggttatttcaaagagcaacgacgacgaacaatacatctgggaatccaacgctggtggttctttcactgttactctagacgaagttaatgaaagaattggtaggggtaccatcttgaggttattcttgaaagatgaccaattggagtacttggaagaaaagagaataaaggaagttatcaagagacattctgagttcgtggcctacccaatccaattagtcgtcaccaaggaagttgaaaaggaagttccaattccagaagaagaaaagaaagacgaggaaaagaaggatgaggaaaagaaggatgaagacgacaagaaaccaaaattggaagaagtcgatgaagaagaggaaaagaagccaaagacgaaaaaagttaaagaagaagttcaagagatagaagaactaaacaagactaagcctttgtggactagaaacccatctgatatcactcaagaagaatacaatgctttctataagtctatttcaaacgactgggaagacccattgtacgttaagcatttctccgttgaaggtcaattggaatttagagctatcttattcattccaaagagagcaccattcgacttgtttgagagtaaaaagaagaagaataatatcaagttgtacgttcgtcgtgttttcatcactgatgaagctgaagacttgattccagagtggttatctttcgtcaagggtgttgttgactctgaggatttaccattgaatttgtccagagaaatgttacaacaaaataagatcatgaaggttattagaaagaacattgtcaaaaagttgattgaagccttcaacgaaattgctgaagactctgaacaatttgaaaagttctactcggctttctccaaaaatatcaagttgggtgtacatgaagatacccaaaacagggctgctttggctaagttgttacgttacaactctaccaagtccgtagatgagttgacttccttaactgattacgttaccagaatgccagaacaccaaaagaacatctactacatcactggtgaatctctaaaggctgtcgaaaagtctccatttttggatgccttgaaggctaaaaacttcgaggttttgttcttgaccgacccaattgatgaatacgccttcactcaattgaaggaattcgaaggtaaaactttggttgacattactaaagatttcgaattggaagaaactgacgaagaaaaagctgaaagagagaaggagatcaaagaatatgaaccattgaccaaggccttgaaagaaattttgggtgaccaagtggagaaagttgttgtttcttacaaattgttggatgccccagctgctatcagaactggtcaatttggttggtctgctaacatggaaagaatcatgaaggctcaagccttgagagactcttccatgtcctcctacatgtcttccaagaagactttcgaaatttctccaaaatctccaattatcaaggaattgaaaaagagagttgacgaaggtggtgctcaagacaagactgtcaaggacttgactaagttattatatgaaactgctttgttgacttccggcttcagtttggacgaaccaacttcctttgcatcaagaattaacagattgatctctttgggtttgaacattgatgaggatgaagaaacagagactgctccagaagcatccaccgcagctccggttgaagaggttccagctgacaccgaaatggaagaggtagattaggtagaacatcatggccttgaataggttataaacaaaacataatataacgtataggtattcgaatgaataaataagtatgtaaatagggcatctgcatggaaataactgggtaaaacattacaatgtatttttttagagttttcgctattccgacgcgtctagtgtgtcatacaaaacgcgaagaatctgaaatcgtgaaatatactaagaatataactgaaatagcttaagcataaatgaactttactgcgaagataaagggtatgttgaaa

SEQ ID NO: 196 - DNA, 2280 bp, Saccharomyces cerevisiae
  CDS (361)..(2130)
aatattctatgtctggcaacttctgatgatactttcaagacaaacgccgcaattgaccaaactattgaactaaacgcaagttcaatatacataatatttgactatgagaactgatatcttcgtgaagattcgtgtagtatgatagaacattccagaaaaaaaattcagattcatcgctctctcttcgcttctcctcctttaaggaataaagaaaaaatcacatacatagattaagtaaataggatctgctagaaaaattatatatagatcaatcatcttattaaggtatcttgtttaagcccaaaagtctgctcccaaattcctcactgtagctactaaaacaacctatacgcaagaaagatgtcattgacagccgatgaatacaaacaacaaggtaacgctgcatttaccgctaaggattacgataaagcgatagagctcttcactaaagctattgaagtttctgaaactccaaaccatgttttatattctaacaggtccgcctgttatacttctttaaagaaatttagtgacgcattgaatgatgctaatgaatgtgtcaaaatcaatccatcttggtctaagggttataatagactcggtgccgcccacttaggtcttggcgatctcgacgaagctgaaagcaactacaaaaaagccttggagttggatgccagtaacaaggccgccaaagaaggattggatcaggttcatcgtacccaacaggcaagacaggcacagcctgatttagggttgacacagttgtttgctgacccaaatttaattgaaaatttaaagaagaacccaaaaactagcgaaatgatgaaggaccctcaattagtggctaaactgattgggtacaaacaaaatccgcaagctattggccaagatctgtttactgatccaagattaatgaccatcatggctacattgatgggggttgatttaaacatggatgatataaaccaatcaaactccatgccaaaggaaccggaaaccagtaaaagcactgaacaaaagaaagatgctgaaccacaaagcgattccactacgagcaaggaaaattcctctaaagcaccacagaaagaagaaagtaaggaatccgagccaatggaagttgatgaagatgactctaaaattgaggccgacaaggaaaaggccgaaggtaacaagttttacaaggcacgtcaattcgatgaagctatagagcactacaacaaggcgtgggaactgcataaagatattacctatttaaacaaccgtgctgctgctgaatacgaaaaaggcgaatacgagacagctatttctaccttgaatgatgctgttgagcaaggtagagaaatgagagcggattacaaggtcatttccaaatcatttgcgcgtattggtaatgcctatcacaaattgggtgacttgaagaaaactatagaatactaccaaaaatcattgaccgaacatcgtactgctgacattttgaccaagttaaggaatgctgaaaaagaattgaagaaagctgaggcggaggcgtatgttaaccctgaaaaggcggaggaagcccgtcttgaaggtaaggaatattttaccaagagtgattggccgaatgctgttaaggcttacactgaaatgatcaaaagggcacctgaagatgctagaggatattctaatagagctgctgcactagcgaagttaatgtctttccctgaagctatcgcagattgtaacaaagccattgaaaaagatccaaatttcgtgagagcttatatcagaaaggccaccgcacaaattgctgttaaagaatatgcttccgctttggaaacactagatgcggccagaaccaaagatgctgaagtgaataatggttctagtgcaagggaaattgatcaactgtactacaaggcaagccaacaaagattccaacctggtaccagtaacgaaaccccagaagaaacctatcaaagggccatgaaagatcctgaagtggctgcgatcatgcaagatcctgttatgcaaagtattttgcagcaggcccaacagaatcccgctgctttacaagaacacatgaaaaatccagaagtattcaaaaagattcagacgttgatcgctgctggtatcatccggactggccgctaaaaataatacgaaatataactttattatcttgaattctttttttactgctttttcatacatacgtacatataatgatcttctcacttagtatactaaatttgtttcatgctatggttgatatttgagaaatcggaacttgaagataataag

SEQ ID NO: 197 - DNA, 2097 bp, Saccharomyces cerevisiae
  CDS (762)..(1919)
tgtcttagcttattagtaatatccacctgcgcacaaattttgtaaatcccctactaatttaatttgaattcaaattggctcgtgatctgttgacccttgttagcaacgtttgtaatcttcctcaccgaattgcgtcgttttgaataatatatatgattgaaaatttttcaagagaaaagaaaaatttttccttccgcggtcagccattgctaaaaaaaggcctccgttaggagtcgaatagaggacaacaacaatacattgccactttaattttaaatgcttgcatattaactagcgatcagatgctctgctctatataaaataaattattgatacggtttctagtctcggttgatgataagagtacgttaatccacctaccgagcattaccaagatatctggcactttatatgtagagagtctgtgttctcaagtttacttgtgcggataatgagcttaaagacttaaatactaaaagcgtatgcgttcgtatctctgtttaggcaccttgtacagtttcacagaaaactgtgtaatgtgtgattatagtacacagaacaaaataacttcacctcatctctttcttaacgcagtgaggaaaaaggtggaaaaaaaagaaagaaaaaaagaatatgtgtaatttccggcacttttcagagcgatgagcttaaattcaaaagcagcattgaattaaaagtgaggtcttgagcactacattctagcaagtaaaagaaaagaataaattggttttgcatctagaatgagctccgttaacgcaaatggaggatataccaaaccacaaaaatatgtgccagggccaggtgatcctgaacttccaccccaactatccgaatttaaagataaaacatcggatgaaatcttgaaagaaatgaacagaatgccttttttcatgaccaagttggatgaaacagacggtgcaggtggtgaaaacgtggagttagaagctttaaaggcattagcttatgaaggcgaaccacacgaaatcgctgaaaatttcaagaagcaaggtaacgaactatacaaagcaaaaagattcaaggatgcaagggaactttactcaaagggcttggctgtagaatgcgaagataaatcaataaatgagtcactatatgccaatagagcggcatgtgagttagagctgaaaaattacaggaggtgtatcgaggactgcagtaaagctctaactattaaccccaagaatgttaagtgctactatcgtacaagcaaggcttttttccaattaaacaagttggaggaggccaaatcagccgcaacatttgccaatcaaaggattgacccagagaacaaatcaattttgaatatgttatcagtgattgatagaaaagaacaagaattgaaagcaaaagaagaaaaacagcaaagagaagctcaggaacgtgaaaacaagaaaattatgttagagagcgcaatgacgctgagaaacataactaacatcaaaactcactctccagtagagttacttaatgagggtaaaataaggctagaagacccaatggattttgaatctcaattgatctatcccgcattaattatgtaccccacgcaagatgaatttgattttgtaggtgaagtaagtgagttaactactgtgcaagaacttgttgacctagttttggaagggccgcaagaacgcttcaaaaaagaaggtaaggaaaacttcacaccaaagaaagtgttggtgttcatggaaacaaaggcaggtggtttgattaaagctggtaagaaactgacatttcacgatatcttgaagaaagagtcgccagatgtaccattgttcgataacgctttgaaaatatatattgtgccaaaggtagaaagtgaagggtggatttccaagtgggataagcaaaaagccttagaaagaagatctgtgtgaagtgtcaaatagttaaaaatatgtaacgcaaagttgtagatagaaataacaaagcaagaaggaaaagtaaagaaagtgaacgatatacgtaatgcagggggaataccagagtatttaaagtgtacttgatttaatgttaaccagtttgaatttttcttttctggggtaatcgaattca

SEQ ID NO: 198 - DNA, 820 bp, Saccharomyces cerevisiae
  CDS (193)..(654)
acaaaattacccgcgcaggcctatttttctagaagacagaagaaaaaagtgggcagagaaagcgaggaaaaaaagaaatacatatgaagaagaaaaaagctgaaatttaagcaaatactttttggacaaaatcatcaaactactactaaagtttgaaacgatcggaaagttacaacacatttacgataaaatatggttgtcttgaatccaaataactggcattgggtggataaaaacaccttaccttggtctaaggactacttgaacggtaaattaacgagtttgtccactgtttcctctgatgggaagagcaaaattgagttaacccaggtgagtagcatcaccggtgactccaacgtatctcaaaggaagggcaagccgatttgctactttgacttacagttgtcgatgaacgtcaaagtgacaaatttggatactaataaggacgacgaggatgatgacggcatacttgcggacgggaaactagaaattccagagtttatgcatgacgagtctgatattccgattttgtcgcaagggtttgatgcttttgatggattggttaggtctgaatttgtccctaaagtagtggaaacgctactaaaataccaagatgacttgattaaagaacactcaaaggatatacaagtttgatgtgttcatgtaacgaaaaggggagcgttgcatagatagaccaccgccccttttaatttttccagcgttttcaattgttattcttcttcttcctcatactcacccaatacataacatgtatacacacatacatagataatgaagaaaatagcagtggtagaaaaac

SEQ ID NO: 199 - DNA, 1126 bp, Oryza sativa
  CDS (68)..(706)
aaaacctcgcaaaaccctcggccctcacccgccgccgccgccgtcgcctccaccggtaaacggcagcatgagtcggcaccctgaagtgaagtgggctcagaggattgacaaggtttacataactgtacaattagctgatgctaaggatgctaaggtcaatctggaaccagaaggtgtattctctttctctgctacagctggaactgatgggaacttatacgaatcaaagctagagttgaacgacaaagtaaatgttgaggagagcaaaataagtgtaggtgttaggtccatattctgtattgtagaaaaagctgaggccaaatggtggaagaagcttgttcgagatgatcaaaaggcaccacactttgtgaaagttgactgggacaaatgggttgatgaagatgatgatggtgctgatgtcaacgtggatggaatggacttttcgaattttggtggcatgggtggaatgggtggaatgggcggaatgggtgatatgatgggtggcatgggtggtatgggtggcatgggtggcatggctgagatgatgggtggcatgggtggtatgggcggtatgggtggcatgggtggcatggatgagttcgaggacgagagtgacgatgaagaagaagtgtctaaacctcaagacgcagagaaggctgctgaagccggaaaatcccaggagtcggacgctaaagccgagacaagttagagcaatcgaaggcccctctacataattcctttctctgttgcatcccgtcttttatggatctggtgaactgaagaaaacattttacgttatgacggtagggatgggtgctcccttgtagaacgatgctatgaaactggagctccaactgagtacgcaaaccattcttggattgtttttcttaatgcgctttgatgcttcatcgctctgcaatcatatattaagctttggatgctttaatctgcttttgtgagatactgctgtgcccgtgctagagtccactgagcatgcaacaattcatgtgatctgacgatgcttgtgctagacgagtgaggcagtagcactgttagttcccaagcttgttttgaaaggatgcatagtgaatccctatttatttgtttaaaaaaaaaaaaaaaaaaa

SEQ ID NO: 200 - DNA, 870 bp, Zea mays
  CDS (71)..(565)
ttctcgtttcaccgtgcgccacaagcacacaactagggcgaccgccgccgacctacggccagctgtgcccatgtcttcgtcgggccctttgctggcgacgggaacccaccacaccggccgccaacctgaggttttgtgggctcagcgctccgagaagattttcttgactatctcattgccagatgcgaaagatgttgtgttaaagaccgatcctaagggcctctttaacttctctgctgttgtccatggggaaccttttagcttcactttggagctttttgattcaatactgtcagagggaagtaaaacgaagacaaagatgggcctgcgaaacataatctgctcaatccagaaagaaaagaaaggttggtggaagcgcttgctaaagtcagaggaaaagcatccatacatcaaagttgactggaacaaatggtgcgatgaggatgaagagtctgagttctctggggattcagatggtggctttgatgaggcaaatgaaggagatgaaagtgatgatgatgatgggatgctttatctccccgaccttgaaaagctaaggggcaagtgatctggctgcttcggtgaagggagtagggttgatgtaacaagttaccgttgacgtgacagagtaggcttatcatcgacgtagttggggtcttacttgctgagcatctgcgacggcttgagacttttaggcatgtcttctatctccgaagcactctttcggtctttcctgatcagtgagctagcgctctgaaaacgtagcgatgagctgtcccattttcgactaactatttagtgccagtgaatggcctaattctacaactatcacgatgtgcctatatgttaggggattatggattcaaaaaa

SEQ ID NO: 201 - DNA, 870 bp, Oryza sativa
  CDS (124)..(642)
cggacgcgtgggaaaaaaaaccctaatccatccactccaaatcgccacgcaggaagggaggaaaggaccaccagccaccgcgcgcgcccaaatcgtcgcagctgcttccccgaggagaagaacatgagtcgccacccgagcactaagtgggcgcagaggtccgacaaggtgttcttgacgatcgagctgcccgatgccagggatgtgaagctcaacctgaagcctgagggccagttcatcttctcggcgaagggccctgccgacgacaccccttatgagcttgatcttgagctctttgatgctgtgaatgttgaggagagcaaggcagctgttgcggcaaggtccatatgctatcttatcaagaaagcagagagcaagtggtggcctaggctgctgaagaaggaaggcaagccacctgtgttcctcaaggttgattgggataagtggcaagatgaggatgatgaagacattgggcttggtgacttcggtgatatggacttctcgaagctgggcatgggaggtcctgatgatgatcttgaggacgatgacgaagatgacacggctgacagtgctaacaaagatgatgaagacattaaggcagaggggagcggggaacaggaagctgctggtgaagcgaagccgtgaaatacctgagagttttagaacgctatgcttgacttgtttgtgacgctgccaggtcttaagatttttttggtgtaaactctggagagtggatcactgccactaaagtaaagtagtagttatggtttagtagctccattttgttaaaaaactttgtgcattgcacactgttctgttatgtgaatcgccatatttgcatcaaccattgcaaagctatccagccaaaaa

SEQ ID NO: 202 - DNA, 845 bp, Zea mays
  CDS (90)..(617)
ggcagtcttcccccaagacgtctaaaccccaatccctaaatccccgacgcagaccacacgacgcgcacctccgttcacgaggcggaagcatgagtcgccacccgatcactaagtgggcacagaggtccgacagggtgttcttgacgatagagctgcccgacgcccaggatgtgaagctgaacttgaagcctgaaggccatttcaacttctcagctaagggctcagatgacttgcgctatgagtttgacattgagctgtttgatgctgtgaatgtggaggagagcaaagcagctattgccccaaggaccatatgctacctgataaagaaagctaagagcgggtggtggccaaggctgctgaagcaggagggcaaaccacctgtgttcttgaaggttgattgggacaaatggcaggacgaggatgatgaagacgctggatttaatgactttggtggtatggacttctcgaaactggacataggaggtgctgatgacgacgatattggggatgatgaagatgatgtggttgaaagtgctaacaaagatgaagaaggaggtaagacagaagagagcaaggaggaggaagcagctcctgcggctgcagaggaagtgaagccatgaagaatcatttgactttgctccgcgccatgggtgtccacggtatctagctaggctagacgttcccttggatttttggtgtaaaatctggaggtcgaaccactcactgcctattgaagtaaaggatacaaaaacagttgtgctgtcttagtttttggctgaaccctgtgaactgctgctacaatatttggtcagagtttatatgcatccatcatgcgacgcaaaaaa

SEQ ID NO: 203 - DNA, 1527 bp, Oryza sativa
  CDS (121)..(1242)
cagaagcccgtggaagcttcggaagcggcgcggcgcggcgctgggcgggggagaagaccagagcggcgaggaaggaggcggcgcccagcggggagagcgagcggctcgacgccgacggccatggcgctgctgatggatcccggggcgggaggccccctgacggagagcgagaaggccgacctggacgccatcgccgccatcaaggagtcggcggcggcagagtacaaggagaagggcaaccggctcgtcaagatgggccggagccactacgccgacgccgtcgactgctacaccaaggccattgcccagatggagccgctgccgccgccgccggtgccatcccccgacgcctccgtcctcttcgccaaccgcgcccacgtcaacctcctcctcggcaaccaccgccgcgccctcgacgacgccgcccgtgccgtccagctctctccctccaacgtcaaggcgtactaccgggcggcgaaagcggcgattgctctcggcttgctgccggaggcggcggccttctgccggcgggggatcgagcaggaccctgctaatgaggagctcaagaaattgctcgcacaagtggacgcccaacagagtgagcaagatcgtcatagggccaaggttgcgcaggccgtgtccgctgcgaaggatattgttgccgctatagagaagagggggttgaagcttgggaaggcagcatatcaagagcttaccggtgtaaagaagccgaagttggatgagcagggtgtgcttcactggccagttcttctgctctacccggaggtcatgtcgagtgacttcatcgaggattttccggagacagatactttcgtgccccaccttgatgtcatgttctcagaaagttctccaccattaccatgggatgataaacacgcttacacacgggatgctgttgagttatattatcaggctggcgttggcacagttctgtccaaaagtgaaatattgaaaattcttttggaaggcactatggactcaaagtcacttcctgaaagcctgcttgatgaggaagatggagaaaatgatgatggcaagagcagcacaattacatcatcagataagggttctgtgaagtggatcaatgtaaaagagggaaaaactcttcaagaagtgctgcagcataaagacttcatcatccctgcaattcctgtgttctttgttgtttcaagaaaatccaccttttacagaaagttcaaggcaggaaactggtctttgccgtaatgcttagcgtgattcagtttggcacatttggaagatgattagtgcggtacgcgtatgatcagagaagaaaagctggccacctagtcattcttgtatggttttatatgttgctttatagaatgatgaggtgtgttctttcctgtatttggtacaattctcaagtattttcctatcctttgcttgagatgctcagtatgccgtttctggagaaacacactgagaatgtacttatgtatggacagctttgggcctgatttagcgcttggcacaaaaaaaaaaaaa

SEQ ID NO: 204 - DNA, 1306 bp, Zea mays
  CDS (42)..(1100)
cgcctctccctcctcttcctctcaacaccaccggcatacccatggcgaagtacggcgagggcgacaagcggtggatcgtggaggagcgcgccgatggcaccaacgtccacaactggcactgggcggagcgcgactgcatcgagtggtcccgcgcgcggctctcctcgctgctcgcgggcctcaccgtcctcgacggcgaggacggcctcacgctccgcaccgtcgcgctcgacaatctcgacggcgaggcctacgtcaacatccgcaagggcaaggtcatcccagggtacgagctctcgctcaccctctcttgggaggccgaggccgcttcggagtccggagctgtgaaggtcgccggcaccgccgaggtcccctaccttgccgacgagaacgctgacgaggaccccgacctccacatcaccgtgcgcggtgacgagacgcccctcgcgctccgcgccaaagatgccttcctctcccgcggcaaacccatggtgctcgaaaagatccgggagttcgttgctgccatggccaagggtggaccggcgaaggacgagctggattccaagaaaactcctgcgaaggtcgccgctgcagcgcctggcgccgctccggcgaagaaagaggaggtggtggctcctgcaccggctgcggggaagaaaaaggccaaggggaaggacaaggaggggttcaagaccattaagatgacggagacgttctactgccgctcaaaggacatatatgagatcttgatggatgagaacagatggaaagggtttacacagagcaatgcgaagatcagtagagaggttggaggggaatttagcctctttgatgggtgcatcactggcgtcaacgaggatctgcaggaaggaaaactgattgcgcagaaatggcggtttggaagctggcctgacggcttgtactcctcggtccggttgatgttggatgagcccgagtctggagttacagtcataaaactcaaacaaactggtgtgccagaggaagacaagtatgggaattcaactgtggttgagaacacggagagaggctggagagatctcatattccagcggatacgtgggatgtttggttttgggatctaaagagtctatagagaggcgatttaatttggcatgatgtcctaattcaaatttttacggggtcaggccatgaatgctatagcaatccatgtttctcacccagttttttttcttcatgtcggcaaaacgcaaaactctgcatatgatggggatttgaaaacatctgttattcatcaggctaaaacgctgcagtattccttgccccc

SEQ ID NO: 205 - DNA, 2005 bp, Zea mays
  CDS (88)..(1830)
accccaagcgcgcacccatcttctggcctttccagccgccaagccttctagaagcttcaagagctcgattcgatcggaaccctcgccatggccgacgaggcgaaggcgaagggtaacgcggcgttctcggccggccgcttcgaggaggcggcgcggcacttcacggacgccatcgcgcttgccccagacaaccacgtcctctactccaaccggtcggcggcgctcgcctcgctccaccgctactccgatgctctcgccgacgcgcagaagaccgtcgacctcaagcccgactgggccaagggctactcccgcctcggcgcggcgcacctcggcctcggcgacgcggccagcgccgtcgccgcctacgagaagggcctcgagctcgaccccagcaacgagggcctcaaagcggggctccaggacgccaagaaagccgccgccgcccctccgcgccgcgggtcgtccggccccgacgccatcggccagatgttccagggccccgagctgtggagcaagatcgcgtccgacccctccacgcgcgcctaccttaacgagcccgattttatgcatatgatgcgcgaagtgcagaggaaccccagcagcatcagtatgtatctctccgatccccgcatgatgcaggtgctcagcctcatgcttaatgtcaagatccagagacccgaggcctccgagccgtcgcagtctaccccgccgccgccgaagcagcagcagcagcagcagacgccgccttctgagacgaaggctagggatgtggagcccgagcccgaggcagagccgatggatttgactgatgaggaaaaggaccgcaagcagacgaaagctgctgctcagaaagagaaggagttaggtaacgcagcttacaagaagaaggacttcgaggtggcaatccagcattacaccaaagccttggaacttgacgacgaggatatttcctatctgactaaccgagcagcagtctacattgagatgggaaagtacgatgaatgcatcaaggactgtgataaggctgtggagaggggaagagaacttcgtgctgatttcaagatgatttcaagggcactgacaagaaaaggaacagctctggtcaaacttgctaagacctctaaggattttgatattgctatcgagaccttccagaaggctctgactgagcatcggaacccagacactcttaaaaagttaaatgaggctgagaaagcaaagaaagagttagagcaacaagagtattatgatccaaaattggcagatgaggagagagagaaaggcaatgagttcttcaaggagcaaaaatacccagaagcaataaaacactacacagaggctctcaagagaaacccgaaggatcctagggtttatagcaatagggccgcctgctacaccaagttaggagccatgcctgaaggtcttaaagacgcagaaaagtgtcttgaacttgaccccaccttcaccaaagggtatacgaggaaaggtgcaattcagttcttcatgaaagaatatgacaaggccgtggaaacctaccaggctggcttgaagcatgacccgaacaaccaggaactgcttgatggtgttaagaggtgtgttgaacagatcaacaaggccaacagaggtgaaataagccaggacgaattgcaagaaagacagaacaaagctatgcaagacccagagatccagaacattcttaccgaccctatcatgcgacaggttctaatagatttccaggagaacccaagtgcggcccaggagcacctgaagaaccccggggttatgcagaagattcagaagcttgtaagtgctgggatagttcagatgagatgatcgagcgatgcgatgattggctttgttcgttcacgtgcaccctggtcatacatatgttttaacaagcagcagcggcataagaatgaacctgttcgggggctaatcttattccttttggattgtaagtgcattgacattggataattcatgtttgtggcactgagtttcgagt

SEQ ID NO: 206 - DNA, 1554 bp, Emericella nidulans
  CDS (65)..(1261)
ctccatcgtcaaggaaggaacacggccctaactaaaccctagctaagggaagggaaacaagaccatggatgcctccaagctccgcgagcttcgcgacttcgtcgaggcgtgcaagaagaatccttcgctcctcgccgaccccaacctctccttcttccgggattacctccagagtttgggtgccaaaattcccgccgccgccccctctttcgaaagtcccaagagatcttccatggacgacattgatgacgacggtgatgacgacgacgatttggatatgagggatcccactcctgagcgagacgagctcgatgaagagattgttgagtctgatcttgagctcgaaggagaaattgtacagtctgaccatgatgacccaccacagaagatgggaaatccttcagtggaggtgactgaggaaaaccgtgatgcttcccaagaagcaaaaggcaaggctatggaagcaatttctgaaggaaaacttgaagatgctattgaacaccttaccaacgcaatagtgctgaatccactctcagcaatcatgtatggtactagagcatctgtgtttataaaaatgaagaaaccagctgctgccattcgtgatgccaatgctgctctagagatcaacccagactctgcaaaaggctataaaactcgtggaatggcatatgccatgcttggcaaatgggaggaagctgctcatgatctgcacacagcatctaacatggattacgacgaggagatcaatgctgtgctcaagaaggtggagcctaatgctcacaagatagtggaacatcgcaggaagtatgagaggttgagaaaagagagggaggaaaagagagcgcagcgtgatcggcttcgtcaacgtgcagaggcgcaggctgcttacgacaaggccaagaggaaggagcaatcgtcaagtcgctcatcaggaggtgcatctcccagaggctttcctggagggatgcctggtggtggtttccctagagggatgcccggtggaggtttccccgggggtggcatgcctgggggtttccctgggggtggcatgcctggaggtttccctggtggtgttcccggtaatgttgatatgagtaaaatcctgaatgaccctgacctgatggcagcattcagtgacccagaggtcatggcggctttacaagatgtgatgaacaatcctgccaactttgctaagcaccaagcgaatcctaaggtgggccctatcatcgcaaagatgatggccaagttcaatgggtcccagtgatggttatgtcgcagtcaggttttgtgagcagcaagcaaaggtttgttggacagtgaacaggtgttcttttcgtgcatctggtctgggagtgtgtttagcttgtgatgaagaacatgagtgtgtgtgttggtcgtggtgcatctggaggtgcgatgagcatgtgatgaaaaaaaaccaaacggctctatggtgatgtatgcaaaaagttgctttcgaacttgatttctcaattcacagatggtttgacagtttcttgaattatagaatgcttgtgtgctgctagtttccct

SEQ ID NO: 207 - DNA, 1235 bp, Oryza sativa
  CDS (121)..(939)
gcttctccaattttccaagcctgcctccaagcgcacgccacgatcttctagaagcgattcgcgcgcgccgccgcctcctcccctccccttccccggagcgaagccgccccgccgggggggatgtcgccggcggcggacagcgcggcgtcgaagcggcaggcggagctgctcaagcaggagggcaacgccttcttcaagaaggaccgcatcagcgccgccatcgacgcctacaccggggccatagctctctgcccaaaggttgcagtatattggaccaaccgagcactttgctacaagaggcggaatgagtgggttagggctgaggaagattgtagaacagctattcagcttgacagccactctgttaaggcacattacatgctcgggcttgcacttctcaacaaggacgaattggccgagggaataaaagaactagagaagtcgttggagcttggaaggggtgcacatccagcaagttacatggttgaagagatctggcaagagctttctaaagcaaaatacatagaatgggaaaatttatcaagcgaacgagtccgtcaattgcataagctgaaggaagcatgtaaagaagctcttaggaattataacagccttgacaatcctcctgcatatgtccccgaggaacagctaaatgagcttgaggaagtttttcggaatgccaggaagtctgatattccaacagaagttcctgatcatctctgctgcaaaattactcttgatattttcagagacccggtgataaccccaagtggaatcacgtatgagagggcggtgattcttgatcatcttcatagggtggggaagtttgatcctgtgacccgtgagacacttgaaccacaccaactggttcctaaccttgccatcaaggaagctgtccatgcatttttgagtgaacatggttgggcttacaggatgagatgactactttgaattacacctgggcttggagctttggaggcaacatttcagattgcaatatacatgtttcggttagtcaacttaaatgtgtcattttgtttatctttacatatttattggtggaaaaggttttacctgggatggctgtgtacagattccccttctctagctatccctcctctctactctgttcatgtgtaatgcttggtatcagattatcacttatccacagtaaaagaaaattaaagtggctgtcatactccttgttctctgattattggtttttggcgcactcg

SEQ ID NO: 208 - DNA, 1131 bp, Zea mays
  CDS (115)..(939)
caagaagccacctcaggctcacgccgcggttccacacgagcaaatcccgccgcttcctccccacgcaccccttcccatccttcccgaagcacgaggcgagccgggccgccggatatggcgccggcggcgccgtacggcggggccgagtcgcagcggcaggcggacctactcaagcaggagggcaacgcctttttcaggaaggaacgcctcagcgccgccatcgacgcctacaccggggccataactctttgcccaaatgttgcagtatattggaccaaccgagcactttgctataggaagcggaatgagtggactagagttgaggaagattgcagaacagctatccagcttgacagccagtctgttaaggcacattacatgctcgggttatctcttgtcaacagccaaagattatcagaaggaataaaatcactggagaagtccttggagcttggaaggggtgcacatcctgcaagctacatggttgaagagatatggcaggagctttctaaagcaaaatacatcgaatgggagagcttatcaagagaccgaacttgtcaactgcaaaagctgaaggtagcatgtaaagaggccctaacgagttacaacagccttgataacccagccgcaggtgcgccagtagaacagctaaatgagctcgaggaagttttcaagaaggctgcaaagactgatactccagcagaagtacctgaccatctctgttgcaaaatcacacttgatatcttcagagacccggtgatcaccccgagcgggattacctacgagagggccgtacttctcgaccaccttcaaacggtggggaggtttgaccccgtgacccgtgaggctcttgaaccgcaccagctggttcctaatcttgccatcaaggaagctgtgcatgcgtttttgagtgagcatggttgggcttacaagattagatgatcgctttggaatacaggttttggatactgtcggatgtgacggtgggatttttttgttcactgttggggggcagattttaatctgggatggctgcgtacagattcaccttctccagttgtgtacatatgagatgctcattatgatagtaattgtgaacagtacaccaaaggaagtgaagttgagcgtctg

SEQ ID NO: 209 - DNA, 2684 bp, Zea mays
  CDS (55)..(2478)
tcactggtgtgggccgtggctgtacgccgcagagtgaagcgagacgagacgacgatgcgcaagtgggcgctctcctccgcgctcctccttctcttcctcctcaccaccctccccgacccagctaagaagctacaggtgaatgcggaagagagcagcgatgacttagctaacccacccaaggtagaggagaagcttggtgctgtccctcatggcctgtccaccgactctgaggttgcccagagggaagctgagtctatctctaggaagactcttaggagctccgccgagaagtttgagttccaggctgaggtgtccagactcatggacatcatcatcaactcactctacagcaacaaggatatcttcctgagggagctcatatccaatgcctctgatgcattggataagatcaggttcctttcccttactgataaggaagttctgggtgaaggtgacactgcaaagcttgagattcagattaagttggacaaagagaagaaaatcctctccattcgggataggggtattggtatgaccaaggaggatcttattaataaccttggaaccattgctaagtctggcacttcagcttttgtcgaaaagatgcagtctggaggtgacctcaatcttattggacagtttggtgttggcttctactcggtgtacttggttgctgactatgtcgaagtggtcagcaagcacaatgatgataaacaatatgtttgggaatcaaaagctgatggatcgtttgctatctccgaggatacatggaatgaaccccttggccgtggaaccgagataagattacatctgcgagatgaggccaaggagtacttggaagaggataagcttaaggatttggttaagaagtactctgagttcatcaacttccctatctatttgtggtcaaccaaggaggttgatgttgaagtgccagctgatgaggatgagacaagtgaagaagaggattcgtccccagaaactacagaagaagagacagaagaagatgaagagaaagagaaaaagcctaagacgaagacgataaaggagactacttctgaatgggaacttctgaatgatatgaaggctgtatggcttcgcagcccgaaggaggttactgatgaggaatactcgaagttttaccactcactagccaaggacttcggtgatgacaagcctatgggttggagccacttcactgctgaaggagatgttgagttcaaagctttgctcttcattccaccgaaggctccgcatgatctctatgagagttactacaacagcaacaagtcaaacctcaagttgtatgttagaagagtgttcatctctgatgaatttgatgaccttcttccgaagtatctcagctttttgaggggtattgttgactcagacacactgccgctgaatgtgtcacgagaaatgctccaacaacatagcagtctgaagactatcaagaagaagctgatccgcaaagctcttgacatgattaggaaacttgctgaagaagaccctgatgagtacagcaacaaggataagacagatgaagagaaaaatgagatggaggagaagaagggccagtacgccaagttctggaatgagtttggcaaatcaatcaagctgggtatcattgaagacgcaactaacaggaaccgccttgcgaagcttcttagatttgaaagtaccaagtcggatggcaaacttgcctcccttgacgagtacatttcaaggatgaagccagggcagaaagacatcttctacctcacgggaagcagcaaagatcagctggagaagtctccgttcctggagaggctaaccaagaagaactacgaggtcatcttcttcaccgaccctatggacgagtacctgatgcagtacctgatggactacgaggacaggaagttccagaacgtgtccaaggagggcctgaagctgggcaaggactcgaggctcaaggacctcaaggagtcgttcaaggagctgacggagtggtggaagaaggccctggagagcgagagcgtggactcggtgaaggtcagcagccggctgcacgacaccccctgcgtcgtcgtcacctccaagtacgggtggagcgccaacatggagaagatcatgcaggcgcagacgctgtcggactcgagcaagcaggcgtacatgcgcggcaagagggtgctggagatcaaccccaggcaccccatcatcaaggagctccgcgacaaggtcgcccaggacaacgagagcgaggagctgaagcagacggcgaggctggtgtaccagacggcccttatggagagcgggttcaacctccccgaccccaaggagttcgcgtccagcatctacaagtcggtgcacaagagcctggacctgagccccgacgcggccgtggaggaggaggacgaggccgaggagcagccggaggtggaagagaaggagccggcggccaaggaggggtcggagccgtccttcgacaaggacgagctgtagtcggcgtgctgtggtctcgtctcgtcttcgggatctgttttgaagtctagctgtagctcccgtttagttgagatatcggggagcccactcactgccagctttgtgtttaggaacgtgatacgggatctttttttttttgttgcctgtctttgtacttgtacaaacctcagttcagtgactcggtctaattaccggctccgatt

SEQ ID NO: 210 - DNA, 2691 bp, Oryza sativa
  CDS (68)..(2500)
cgcggcgaggcgacgaactcatcacctccactctctgctgcaacacgagtgaatcggaggcggcacgatgcgcaagtgggcgctctcctccgcgctcctcctcctcctcctcctcaccacactccccgatccagctaagaagctccaagtcaatgctgatgacagcactgatgagttagttgatccgccgaaggtagaggagaagattggtggtgttccccatggcctgtccacggactctgaggttgttcagagggaggctgagtcaatctcgaggaagaccctcaggagctcagcggagaaatttgagttccaggctgaggtgtccagactcatggacatcatcatcaactcactctacagcaacaaggacattttcctgagggagctcatctccaatgcttctgatgctttggacaagattaggttcctggctctcactgataaggaggttttgggcgaaggtgacactgctaagcttgaaatccagattaagctggataaggagaagaagattctctccattcgggataggggtattggtatgaccaaggaagatctcattaagaaccttgggaccattgccaaatctggaacttcagcttttgtggaaaagatgcagactgggggtgacctcaatctcattgggcaattcggtgttggtttctattcagtatacttggttgctgactatgttgaagtgatcagcaagcacaatgacgacaaacagcacgtctgggagtccaaagctgatggatcattcgctatctctgaggatacatggaatgaacccctgggccgtggaactgaaataagactgcacctccgagatgaagccaaggagtacgtggaagaagacaagctaaaggatttggtgaagaagtactctgagttcatcaatttccccatttacttgtgggcaaccaaggaggttgatgtggaagtgccagctgatgaggatgagtcaagtgaatcaagtgaagaagaggaatcatcccctgagtctacagaggaagaagagacagaagagagtgaagagaagaagcccaagacaaagacagtaaaggaaaccactactgagtgggagcttctgaatgatgtgaaggctatatggcttcgtagccctaaggaggttactgaagaagaatacacaaagttttaccactcacttgctaaggactttggtgatgacaagcccttgtcttggagccacttcactgctgagggagatgttgagttcaaagctttgctctttgttcctcccaaggctccacatgatctctatgagagttactacaactctaacaagtcaaaccttaagttgtatgttagaagggttttcatctctgatgaatttgatgagcttcttccgaagtatctcagctttttgaagggtctcgtcgactcggacacattgcctctcaatgtatcacgagaaatgctccaacaacatagcagcctgaagaccatcaagaagaaactaatccgcaaagctcttgacatgattagaaaacttgctgaggaagatcctgatgagtacagcaacaaagataagacagatgaagaaaaaagtgcaatggaggagaaaaagggccagtatgccaagttctggaatgagtttggaaaatcagtcaagttgggcatcattgaagacgcaactaacaggaaccgtcttgcaaagcttctgagatttgaaagtaccaagtcggaaggcaaacttgcctctcttgatgagtacatttcaaggatgaagccagggcagaaggacatcttttacattaccggaagcagcaaggaacaattagagaaatcaccgttccttgagaggctaaccaaaaagaactacgaggttatctacttcactgaccctgttgacgagtacttgatgcaatacctcatggactacgaggacaagaagttccagaacgtctccaaggagggtctcaaactcggcaaggactctaagctcaaggacctcaaggagtccttcaaggagctgaccgactggtggaagaaggctcttgacaccgagagcgtggactcggtgaagatcagcaaccggctgagcgacaccccctgcgtggtggtgacatccaagtacgggtggagcgccaacatggagaagatcatgcagtcacagaccctctcggatgccagcaagcaggcgtacatgcgcggcaagagggtactcgagatcaaccccaggcaccccatcatcaaggaactccgtgacaaggtcgcccaggacagcgagagcgagagcttgaagcagacggcgaagctggtgtaccagacggccctcatggagagcggcttcaaccttcctgatcccaaggacttcgcctccagcatctacaggtcggtgcagaagagccttgacctgagccccgacgcggccgtggaagaggaagaggaggtcgaggaggccgaggttgaagagaaggaatcatccaacatcaaggaggaggcggagccgtcgtcgtatgataaggacgagctgtagtgatgtgtcgccaccaactgttgtttttttatctagctcttgtgttaggttgtttaaaaatgtgatggtttcgagggacgtccatttttccatgcgaaaatgcttagtaccatgatacggggattttgtcgatgtacgtagtttgtgatactctagttcaaattaatggccgtctaatttcgatcaag

SEQ ID NO: 211 - DNA, 2669 bp, Zea mays
  CDS (63)..(2423)
ccacggttccacgaacgttggcgcgcaagctcgtggtgtgagcggtcactgtctcccatcccatggctccggcgctgagcgggactctgggcgcgtcgtcggtggcggcgctgcggccctgcgcggggaggagggcgccgtccgccgcgagctcggttgcgccgcgcgggagcggggtggtgaggtgctccagagggctcaggtgggacgcccacagaagcagggggaggttgctcagggtgaggtgcgatgcggccgtcgcggagaagcccgccgaggaggaggcggctggggagaagttcgagtaccaggcggaggtgagccgcttaatggacttgatcgtccatagtctgtacagtcataaggaggtatttctccgggagcttgttagcaatgcgagtgatgcgctggataagctgaggttcctcggcgtcactgattcttctttgcttgctgatggcggcgagctagaaataagaattaagcctgaccttgatgctggaacgattactatcactgacactggtgttggtatgactaaagatgagctcaaggactgccttggtaccattgctcagagtggcacctcaaaatttctgaaggccctcaaggaaaacaaagaccttggggcggacaatggtctaattggtcagtttggtgttggattttactcagcttttcttgttgcagagaaggttgtggtgtccaccaagagcccaaaatcagataaacagtatgtgtgggaagctgtggctgacagtagctcttatgtcataaaggaagagactgatcctgagaaaatgcttactcgtggaactcagattaccctgtttctaagacctgatgataagtacgagtttgcggacccttcaaggattcaaggcttagtaaaaaattactctcagtttgtgtctttccccatatacacatggcaggagaaatcaagaactgttgaggttgaagaggatgaagagccgaaagaagttgaagaggcaacgaagggtgagaaaaagaagaagactattacagagaaatattgggattgggaactagccaatgagacaaaacccatatggatgagaaatccaaaggaaattgagaacaccgaatacaatgagttctataagaagacattcaatgagtttttggaccctcttgcccacactcacttcacaactgagggtgaggtggaattcaggagtgttctttatgttccaggcatggcgcctcttagtaatgaggagataatgaaccccaagaccaaaaatatccggctatatgtcaaaagagtcttcatctctgatgactttgatggtgaactgtttccaagatacttgagctttgtgaaaggtgtggtggattcaaatgaccttcccctcaatgtttctcgggagattcttcaagaaagtcgaattgtaagaattatgcgcaagcgacttgtcagaaagacctttgatatgattgaagagattgcggaaaaggaagataaggaggactataagaagttttgggagagctttggcaagtttgtcaagcttggttgcatcgaggacacagggaatcacaagcgccttgctccattgttgcgcttccactcttctaaaaacgagggagatttgataagtcttgatcaatatgtagagagcatgcctgaaagtcaaaaggcaatctactacatcgctacagatagtctccagagtgcaaagactgctcctttcctggaaaagctggtccagaaagatattgaagttctctaccttattgagccgatagatgaggttgccattcagaacttgcagacctacaaagagaagaaatttgtggatatcagcaaagaggatctggaattgggtgatgaagaagaagagactaaagaaaccaaacaggagttcactctcctatgtgattgggttaaacaacagcttggcgacaaggttgcgaaggtccaaatatcaaagcgtttaagttcatctccatgtgttctcgtatctggcaagttcggttggtccgccaatatggaaaggctcatgaaggctcaaacacttggtgacacatcaagtttggaattcatgaggggaagaaggatctttgaaatcaaccctgaccacccaattatcaaggatttgagcgctgcttgcaaaaatgagcccgaaagcacagaagccaggagggctgttgagctcctatacgaggctgctttaatctcgagtggatatactccggagagtccagcggagttgggtggcaagatctatgagatgatggcgattgccctcggcgggagatggggaaggtccgacatggaggaggccgaagcgtcgacgggtgaggccagcgcagaggcagactcatctgaagtcaccgtagcagaggtgattgagccctcggaagttagacccgagagcgatccgtggagggaccagtgagttctcccacgggcatccttaactccatatttagcagtgccggggataaaaactaagccatgggcaagaacatattgccgtggcaatttttttgtaggcttagactttgccggccaccagaatcttattgaggaggtagtggccttagaaaagaataataaagcatgaagactgatgattacatagcgaaattgtgctgtccctctcaataatatttataatgaaaagaacttatttctgcag

SEQ ID NO: 212 - DNA, 2521 bp, Sorghum bicolor
  CDS (138)..(2285)
caggaaacaaagcaagcaagcaagcatcgcacgaacgatccatccattcatcgcctctctctgtctctctttcagcaacaagaaagtctcgtaggtagagatcagagcaagcacaagcagaagcagggcaatcaatcatggcgtctgcggacgtgcacatggccggcggcggcgcggagacggagaccttcgcgttccaggccgagatcaaccagctgctctccctcatcatcaacactttctactccaacaaggagatcttcctcagggagctcatctccaacgcatcagatgcgcttgacaagatccggttcgagagcctgacggacaagtcgaagctggacgcgcagccggagctcttcatccggctggtcccagacaaggcaaccaagacgctgtccatcatcgactccggcgtggggatgaccaaatccgacctcgtcaacaacctgggcaccatcgcgcggtcaggcaccaaggagttcatggaggcgctggcggcgggcgccaccgacgtgtccatgatcggccagttcggggtcggcttctactccgcctacctcgtcgccgacaaggtcgtcgtcaccaccaagcacaacgacgacgaccagtacgtctgggagtctcaggccggtggctccttcaccgtcacgctcgacaccaccggggaacggcttggtcgcggcaccaagatcacgctgtttctcaaggacgatcagctcgagtacctcgaggagcgacgcctcaaggatctcgtcaagaagcactcggagttcatcagctaccccatctacctctggaccgagaagaccaccgagaaggagatcagcgacgacgaggatgacgaggacaagaaggagggcgacgtcgaggaggttgacgacgacgacggcgacaaggacgacaaggactccaagacgacgaagaagaagaagaaggtgaaggaggtgacgcacgagtgggtgcagatcaacaagcagaagcccatctggctgcgaaagcccgaggagatcacgcgcgaggagtacgcctccttctacaagtcgctgaccaacgactgggaggaccacctcgccgtgaagcacttcgccgtggaagggcagctggagttcaaggccatcctgttcgtgccccgccgcgcgccattcgacctcttcgacacccgcaagaagctcaacaacatcaagctctacgtccgccgcgtcttcatcatggacaactgcgaggagctcatcccggagtggctgggcttcgtcaagggcgtcgtcgactccgacgacctgccgctcaacatctcccgcgagacgctgcagcagaacaagatcctcaaggtgatccgcaagaacctcgtcaagaagtgcatcgagatgttcttcgagatcgccgagaacaaggacgactacgccaagttctacgacgccttctccaagaacatcaagctgggcatccatgaggactcgcagaaccgcgccaagctcgccgacctgctccgctaccactccaccaagagcggcgacgagatgacgagcctcaaggactacgtcacgcgcatgaaggaagggcagaaggacatctactacatcaccggcgagagcaagaaagccgtcgagaactcgccgttcctggagcggctcaagaagaaaggatacgaggtgctcttcatggtggacgccatcgacgagtacgccgtcgggcagctcaaggagtacgacggcaagaagctggtgtcggccaccaaggagggtctcaagctcgacgacgacgacgaggaggccaagaagcgccgggaggagcgcaagaagcagttcgaggatctctgcaaggtgatcaaggacatccttggtgaccgcgtcgagaaggtggtggtgtcggaccgcatcgtcgactcgccgtgctgcctcgtcaccggcgagtacggctggacggccaacatggagcggatcatgaaggcgcaggcgctgcgggacagcagcatgagcgcctacatgtcctccaagaagaccatggagatcaacccggacaacggcatcatggaggagctccggaaacgcgccgaggccgaccggaacgacaagtccgtcaaggacctcgtgctgctgctcttcgagacggcgctgctcacctccgggttcagcctcgacgaccccaacacgttcgccgcgaggatccataggatgctcaagctcggcctcaacattgacgaggatgctgctgccgacgaggacgctgacatgcctgcgcttgaagagggcgccgccgaggagagcaagatggaggaggtcgactgatgaggggtctgtccgtttgaggtagatccttcatccatcctgccaaaatcgatcgatcgatgagggtgatgcctctgctttgtgtgtctctgcgtgtgggtccatcaagtgtcactgttggtacagcaggtcacagtattcagtagtagtagcttaccatgtcttgtgtcttgttcgtgtcacatttcggatccgctgtgtcatgccaatgctgtggaacataatataataat

SEQ ID NO: 213 - DNA, 2396 bp, Oryza sativa
  CDS (78)..(2174)
ccaaaccctagccgcctctcgtttcttctcgtcctctccacgcccccgagatctcaggagcacaggaggaggaagccatggcgtcggagaccgagacgttcgccttccaggccgagatcaaccagctgctgtccctcatcatcaacaccttctactccaacaaggagatcttcctccgcgagctcatctccaactcctccgatgcattggataagattaggttcgagagcctcacggacaagagcaagctcgatgcgcagccggagctgttcatccacattgtccccgacaaggctagcaacaccctgtcgatcatcgacagtggtgtcggcatgaccaagtcggacctcgtcaacaacctcggtaccatcgccaggtcggggaccaaggagttcatggaggcgctcgctgctggtgctgatgtgtccatgattgggcagtttggtgtcgggttctactccgcctaccttgttgctgagagggttgttgtgaccaccaagcacaacgacgacgagcagtatgtgtgggagtcacaggccggtgggtccttcactgttacacgtgatacctctggtgagcagcttggacggggtactaagatcaccctctacctcaaggatgatcagctggaataccttgaggagcgtcgcctcaaggatctggtgaagaagcattctgagttcatcagctaccctatctccctatggactgagaagacaactgagaaggagatttctgatgatgaagacgaggaagagaagaaggatgctgaggagggaaaggttgaggatgttgatgaggagaaggaagagaaagagaagaaaaagaagaagatcaaggaagtctctcacgagtggaacgtgatgaacaagcagaaacccatttggttgaggaagccagaggagatcaccaaggaagagtacgctgctttctacaagagcttgacaaacgactgggaggaacatctggctgtcaagcacttctctgtggagggtcagcttgaattcaaggccatcctgtttgtaccaaagagagcgccatttgacctctttgacaccaggaagaagcaaaacaacatcaagctgtacgtacgccgggtgtttatcatggacaactgtgaggagttgatcccagagtggctcagctttgtcaagggcattgttgattctgaagaccttcccctcaacatctcacgtgagatgctccagcagaacaagatcctgaaggtgatccgcaagaaccttgtgaagaagtgcgtggagctcttctttgagatcgctgagaacaaggaagactacaacaagttctacgaggctttctccaagaatctcaagcttggcatccatgaggattccaccaacaggaccaagattgctgagctcctgaggtatcactccaccaagagtggtgatgagttgaccagcctcaaggactacgtaacccggatgaaggagggccagagtgagatctattacatcactggtgagagcaagaaggctgttgagaactcccccttcctcgagaagctgaagaagaagggttatgaggtcctgtacatggttgatgccattgatgagtacgctgttggtcagcttaaggagtttgaaggcaagaagctcgtctctgccaccaaggaaggtctgaagcttgatgagagtgaggacgagaagaagcggcaggaggaactcaaggagaagttcgagggtctgtgcaaggtgatcaaggaggtgctcggtgacaaggtggagaaggttgttgtctctgaccgtgtggtggactctccctgctgtctagtcactggggagtatggctggactgctaacatggagaggatcatgaaggcccaggctctgagggactccagcatggccggctacatgtctagcaagaagaccatggagatcaacccggagaatgccatcatggacgagctccgcaagcgtgccgatgcggacaagaatgacaagtccgtgaaggacctggtgatgctgctcttcgagactgccctgctgacctccggtttcagcttggaggaccccaacaccttcggcaccaggatccaccgcatgctcaagctcggcctgagcatcgacgaggacgagtccgccgaggctgacgccgacatgccgccgctggaggacgacgccggcgagagcaagatggaggaggtcgactaaacgtcatggacccatggatgccattctgtcccttctagttatccctctcctagttctcttctcatagctatctgactgctgctgttcgctttctttttggtacgttggatgcatcagttttgtctttgtcttagctcttaaacaatgcgtggtaccttgtcatactgtttgcgttgcaatgctactagccgaagtatatgccagcttcttattcaaaaa

SEQ ID NO: 214 - DNA, 7858 bp, Oryza sativa
  CDS (1108)..(1489), (1813)..(2684), (6105)..(6266), (6417)..(6658), (6911)..(7016), (7103)..(7297)
atattgttttaaaaaacctttccttttttattgtaaaacaataaaagtttaacattattggatccaagggatgtatcgacatatcgttatagagtttaaagtccacgcattttgacggaatagatttaagagacagttctcgatcgagtaactcctcaatttatatcatgtcagagtggatagatatggtttcaaagctttccttttcttattgtaaaccaataaaagtttacctttatatattttttccaactagctgctgcattttatcaataaatgtaaatttatttgtataatcagctgccagtacatactgggaagtggacaacgaacttaagcacccattcgttcgttttaggcggagcaagaatttaaattatggctttagtgccacgctgtactgtagtaggacactaggacagaactactgacagaatcgctctagaaccaaaatgcatggtttggtggcctactgttaattctagctgtagctagccttgcataattcaaccttattgatcgtccatgttttccggtgaattaaacccacatgcaaacgtagtaggttttttatctctctcggttcacaaatttggacccctgaattccgatcctctgtaataagctgagtagtttgtgcaaattacgtgaaagcctgtcgtttccgtggcccacatgaactggcccccatgcttgctgactcagactccgatcacttcgcccggccaatgctccgctataaaaccctccctttttttggcaaggagttcccaccgtgagatcgagatcgcctcctctctccgtttccttttatttcccgattcgctcggcgtctcggcggcgaccttgcgcgagcgcgcgatgcggtgaaaaaaaaatcatcgcccgcgacagagtacatctgtcccttccgcataaggcaacgtcgcttataaatactgccagcctcttcgttcgtttccatttttcctcgtccgctcgctctcgttcatgtacaaataggagggcgcatgcaccttgtttgccattagctctcgacgtagcctagagcgcaagcagcagcagcagctagattggttggttgccaatgacccggccatctccccgatgatggacggcgccgcgcctctgcttcccgagacgagccccgagagccgccagcaacgtgatccggagagggggaagaggcggacgccggtcctcccggccgtcgtcgcgtccgccgtggtccttctcggcctcgcggcgctcttcctggtgtatggatttcacgacggtggagacgggagggcggccgtactcgcgcccggcaccgtggaggtcgcggcctcgtcgtcccgcggcgtcgtggagggcgtctcggagaagtccaccaccccggcgctgcgcctcggcggcggcgcggtccgggactacgcctggaccaactcgatgctgtcctggcagcgcacggcgttccacttccagccccccaacaattggatgaacggtatgtatacacgttgccatcgttcccgtggtttcatctaggccgttggatctgtaatcgcacggctccgattcaccggttatacaatgttttctcgtttctaatcttgttccctttccgtttcttttccacggacgtctcgtgcgcatggccgtgctgctcgtctttttctcggcatctacagatccgaacggtaagttgctggcgctgattgtcaatgcacggcgcaatcttgtacttgtcacgcattgacatcgatgtcgcgagacgtgacactttttttttgcacgcactgaccgggccgtcgatggatcgatctgcaggtccactgtactacaagggatggtaccatctgttctaccaatggaacccggactcggccgtgtgggggaacatcacctggggccatgccgtgtcgcgcgatctcatccactggctgcacctgccgctcgccatggtgcccgaccactggtacgacatcaacggcgtctggaccggctcggcgacgcagctgcccgacggccggatcgtcatgctctacaccggcgccacggaggagtcggtgcaggtgcagaacctggccgagccggccgacccgaacgacccgctgctgcgggaatggagcaaggcggaggcgaacccggtgctggtgccgccgccgggcatcgggctgacggacttccgcgacccgacgacggcgtggcgcaacccggccgactcggcgtggcggatcaccatcgggtccaaggaccgcgaccacgcggggctggcgctcgtgtacaagacggaggacttcctgcactacgacctgctgcccacgctgctgcacgtcgtcaagggcaccggcatgtgggagtgcgtggacttgtacccggtgtccacctcgccggccgtcgaggacgggctcgagacgtccaccccgccggggcccggcgtgaagcacgtactcaaggccagcctcgacgacgacagaaacgactactacgccatcggcacctacgacggcgagaccgatacctggacgccggacaacgccgacatcgacgtcgggatcgggctccggtacgactacggcaagttctacgcgtccaagacgttctacgaccccgtcgggcggcgtcgcgtgctatgggggtggatcggcgagaccgacagcgagcgggctgacatactcaagggctgggcctcccttcaggtaacgtacattgatcgacaacccccataaccttggtttcatatttctgataggctatagaattagtagtagttacgtataaacaaactttttttatttaattttgacaatggattgaacgagacacggatagagatacgaacccgtcaaatttctttgtgaagcatcataactgaacataattacaaaaatataaaaataacaagttatattaatctcaaatgacgtaggaaaactattataaagctgtctgaaaagccatattgatctgtgatataattcattgcaaaactaattagtcttttttttttgcgatgacatgaacaagatacttaattaagatttttaggtaactgggtatgtactatctcaattggcacagaacgagttactattaaaatctgaaaagccgtactgatttggtataattcatatatattgtaattaatttaacttgccgtatacatccctttttcccaatcatgtactgtactccattaattactgtgtcaaaaacatttagctcatactatttgaatcgctagagcaaaaaagtaaagtgactaggacgatataaactcatggaaatccattaaaaccttatgaaaataacgcccctagctaagccagctagctgctagccagctggatatgatgatcatgctgatctggctagttaaccatggatggctagctaggacccggtcattatgtagttatacacttgcatataccatttctagaccacaattccgcccactaagatataatgcaaaacgtctttacctgtgcaccacgagaggcatgcaggcgtgcggctttcttgttgcgccggccggtcgatccagaagaaaacgtgcatgaacatagttggaccagtagtatatgcagtagtccaggtctgggcgggccccacggggatcacgtccttttttttattattttttgaaaaccggatcacgtccttctaccggtctacccaaacgagttgcacgatgccgacttgattaatcggtccgagtcacgcccgcccaaccaccagaggtagccgggcccggcgagatttgcaggctgccaatagactcgcggggatttgcatgcagcagcggcgccatgacatcggactggatcggccggcgttttctggtgcccgaccgtgacttgtctccggttggccgcgagagcacgagagccgtacgtctaagcaaactagttgtcaccacgtcttagtgtggagaagtattagtactctattaattagctaaggctagagttagattaatcctcaaattgcgaagggttttttttatgcgtccataacgtgtcttgcattggcgcatagctagagattagctaggacatttacttgacgaaagggggatttgagtaaatttctgatttgctagagtttggaattccaaacaggactattcaaaggggttgttccaacgaagcagcacgtggataatgacttgcttagcatcaggaaatttaataccctgacctgtcgctgcaatcgtgttgtttttttaataatccgtaatcatttgaataacttagtaatttcgcggtatatgtacatgtcattcttgtggcaagcgtgaaagtgagttcttgagtggccggttcgactcctaggggaattaacttcgtttttgagaaatttgttttacgttatttttggaactaaaatgtttggcaatttattttaatcgatgatgaaatcaatggtttttgtgaaatgaaaaaaaaaatccactcatagttattctaaagatgaaattgaggagttttcgatatttgtactatactataatataaaaaaggaaatcaacaaacgtctcctttctcagttggttaggcaagttgttgtgatgctaataggctacacaagtctaaccgtgttatctaagttgtaaagatacttgagatgtattttaaaaaatatatggaaatggtaattgagtgagtgtgttcaaacttgaacgcggtccactaggtttctaattctaaactttaccaactgcgcaaggtggagttatcgaaattaggtgatagattaataagtaaatgcactttcttggtggtaaagatacttgagatgtattttaaaaaatatatggaaagggtaattgagtgagtgtgttcaaactcgaacgcggtccactaggtttctaattctaaactttaccaactgcgctaggtggagttatcgaaattaggtgatagattaataagtaaatgcactttcttggtggccagttaagttgtaaaaatacttgagatgcatttgaaaaaaaaagcaccatggtggaaagggtggctgttggcgagtgttttaaaactcgaacgcggcccgctaggttcctaattctaacctttgccaactgcgctaggtggagttatcaaaattaggtgatacacaaatttataaatgcactttcttggtgaccagttatgcaaatacactagacttctattaaaaaattatggtggaaaaaggtgagcatgataatttttatattaaacgcaaacgaaaacaagggtgaaaaggtgagtgtgctaaaactcaaacacaataaacaagggtgaaaaggtgagctgctaaaactcgaacacggtccgctagtctgtctaactatagactttgccaactacactaggcagggcttcttaaaaaagcagtggactttgagtaaatatacttccttggttagatggccgggtatgaaaatatcctagaattgtatcaaaaagaatttgggtgggaagtgagcgtgttaagactcgaacccgggctgttatattttacaactctactatttgccattggcgctaggcgagtttatcagaattaggtgataggttaaccaataaatgcattggccttttgttaaattgcgaactatacaaacttactaaaattgcatctttttttaatcatgctaaaattatgtatttttatctgaatgactgtaaaaacttgctaaaattgtatatttttaaaatcatgctacaattttgtattttgtctgaatgactataaaaaaaactaaactgctactaccatctctaaataaatgtaattttaggtgatccactagaccattttaatactagtttatcttttttttttcgttttctccaccacaaggacatcgtagttttttaatctcttgcttaataatatatctttaactagttaaaactatacatttttagagtcggagggagtagatccttaactgtctctccttcaatcattcatgtcattgtccctttttctttaaatcttatttttttcctgttttaaattgttgttgaattcaatgtgcccttgatgggccttgaccgaggcccatccaaacaaggcatttccctttatttaaattaaccttttattattattattatttgcagtcaattccgaggacagttatgctggacacgaagactggcagcaacctgctccagtggccggtggtggaggtggagaacctccgtatgcgcggcaagagcttcgacggcctcgacgtctctcccggctccgtcgtgccgttggacgtcggcaaagcaacacaggtacgtacgcgtgattttgacacatgaacacaaaatgtgtcatacatttataaaaaaaaagtgtgccatacacatacacaacaactgctatatatccgacccgagaaactgacgtgcaagtgtggttctggtgtgcgtgcggttgtacagctggacatcgaggccgtgttcgaggtggacacttcggcagccgacggtgtcgtcacggaggctggagcagcagcatacagctgcggcacgggcggcggtgcggttggccgtggcttgatgggcccgttcgggcttctcgtgctggccgatgatcagttgtcggagcggacggctgtcttcttctacctggtcaagggagtcgacggcaaccttacaaccttcttctgccaagacgagctcaggtgtgtgtggtacacattttccagtatatgcgtgcatgtcttcctctgtgtgcacatatttttgcaaccaaatattcacacttgatcttgttattagaggatgtattttttttcgatacttcaatttgtggacagaggatgtgtgctgtcgtgtgtagaactccttgtgtatatataaaggaggcttaaattttgctttaatcgagtcaagatgtaaattttaatgcattttaaatcttgtttttttttcaggtcatcaaaagcaaacgatctagttaagagagtctatggcagcttggtacctgtgctagatggcgaaaacctgtcaataaggattttggtaagtctttctagcaatgttgagtacatgcatattcatatgccacaacgcatatattttgatacgtcgtaacctaactctttgtgtgcaatttctttcaataggttgatcactccatagttgagggcttcgctcaaggagggaggacatgcattacctcgcgtgtgtatcccaccaaagccatctacgagtcggccaaaatctttcttttcaacaatgccacaaatgttagagtcactgccaaatcgctaaagatttgggagctgaactctgcttacatccgtccatatgtagactagatcatttttaatgtaatgggaatgaatgatttgtctacatttgttagttatgtttttataggctaatttatcttttttgcttccttctttatgtcaaactacaactatgacatattactagcaactgaaataaaacataatcaatcatattgttttgccacaattttgttattgtgtgtgcgcatgcgcacacgtacgtgcacatgtgcgtatgctatcactctacccctgatgttattattagccatcaccgtaatgttgtcgtaagccaattgtgtcatgtttatcctacataaacaatatacgactttgcgaacattcctcttcaacaatgccacaaatttagggccactagaaaatcactcaagattttggagctaaactctacttaagttcatcaatatataaactacatccttttaaatgcaatggtagtgtggtatgtttagattcattagttgtatctctatagtcaaatttgtttgtcttcatctttctacctatcaaaccacaactgaaaatttttagtcaaatatgtttgtttgctttcttcttcttatc

SEQ ID NO: 215 - DNA, 2924 bp, Zea mays
  CDS (89)..(2821)
ccacgcgtccggctcggtcgactactggctagcttgtttcagtcgtccgatctgatctacagaaaaagcaggggcagggcagctagccatgattcagatgaacatgaagcagcctctcgtgctgcccgcgcaccggggcaatgtcatcggctcgcgcctggcgtcgtcgccctctccggtggcggcggcggcggcggcggccagcaggcggaggggcgtcgtgtcctccccccgctcccggctccagcgccacatgcggctgccgaggatcagctgcagcgccaccgaggaggccagcggcgccgtgtcggccgtcaccgtggagaagatgctgacggtgacggcctcggtgcaggcggcgccggccatcggtcagatgtacttccagcgcgccctcgacgacgccggcgacttcttcggcaagacgctgctgatggaactcgtcagctccgaggtcgacgcaaagacgggtctggagaagccgcgggtgacggcgttcgctcacaagacgctgcgggagggccactacgaggcggagttcaaggtgccggcgtcgttcgggcccgtgggcgcggtgctgctggagaacgagcaccacaaggagatcttcatcagggagatcaagctcgtcacgggcagcgacagcagcaccgccgtcaccttcggctgcaactcctgggtgcactccaagttcgacaacccggagaagcgcatcttcttcaccctcaagtcctacctgccgtccgacacgcccaagggcctggaggacctgaggaagaaggacctgcaggcgcttcggggcgacggccacggcgagcgcaaggcgtccgagcgcgtctacgactacgacgtgtacaacgacctgggcgacccggacaagaaccccgcccaccagcggcccgtgctgggcggcagcaagcggtacccgtacccgcgccgctgccgcaccggtcgccccaggaccaggaaggaccccgaggcggaggtgcgccatgggcacaactacgtgccccgcgacgagcagttctcggaggtcaagcagctcacgttcggggccacgacgctgcgctcgggcctgcacgcgctgctcccggccatcaggccgatgctcatcaagagggagctgcgcttcccgcacttcccggccatcgacgacctctacagcgacggcatcccgctgccggcgcagaccgggttgggcgccatccgcagcatcgtcccgcgcgtggtcaagctggtggaggacaccaccgagcacgtcctccgcttcgagctgccggacatgatagagagagaccgcttctcgtggttcaaagacgaggagttcgcgaggcagacgatcgcggggctcaacccgctgtgcatccagctcctgacggagttccccatcaggagcaagctggacccggaggtgtacggcccggcggagtccgccatcaccaaggagatcctggagaagcacatgagcggcggcgccgccatgaccgtggagcaggcgctcgcggcgaagcgtctgttcatcctggactaccacgacgtgttcctgccctacgtgcacagggtgcgcgagctgccggacacgacgctctacggctcccgcaccgtcttcttcctcacggacctgggcacgctgatgccgctggccatcgagctggtgcggcccaaatcgccgacgcagccgcagtggaagcgggtgttcacgcacgggcccgacgccaccgacgcctggctgtggaagcttgccaaggcgcacgtggtgacccacgacacggggtaccaccagctggtgagccactggctgcgcatgcactgctgcgtggagccctacatcattgccgcgaaccggcagctcagccggctgcacccggtgtaccgcctcctgcacccgcacttccgctacaccatggagatcaacgcgctggccagggaggcgctcatcaacgccgacggcatcatcgaggagtccttctggccgggcaggtacgccgtcgagctcagctcagcggcgtacggcgccacgtggcagttcgacacggaggcgctgcccaacgacctcgtcaagcgtgggctcgccgtgcgccgggacgacggcgagctggagctcaccatcaaggactacccctacgcgcacgacgggctcatggtctggaacaccataaggcagtgggcggccgactacgtcaacgtctactacaagtccgacgaggccgtcgccgccgaccccgagctgaaggcgttctgggacgaggtgcgcaacgtgggccacggcgacaagaaggacgagccgtggtggcccgtgctcgacacccgcgacagcctcgcggagacgctcaccaccatcatgtgggtcacctccggccaccactcggcggtcaacttcgggcagtaccacttcggcggatacttcccgaaccgcccgaccaccatccggaagagcatgcccgtggaggaggaggcgggccgggacgaagagatgaagaagttcctgaagcagccggagacgaccctgctggacatgctgccgacgcagatgcaggccatcagggtgatgacgacgctggacatcctctcgtcgcactcgcccgacgaggagtacatgggagagttggcggagccgtcgtggctggaggagcccatggtgaaggcggcgttcgagaagttcggcggcaggatgaaggagatcgagggattcatcgacgagtgcaacaacaacccggagctcaggaaccggtgcggagcagggatcgtgccgtacgaactgctcaagcccttctccaagccgggagtcaccgggaggggcatccccaacagcatctccatttgacccgtccgtcctctccatccaatgggggtttgccttattgcgtgcacgctagctagctgcttggaaataaaaataattaaaataaaaaaaaaaaaaaaag

SEQ ID NO: 216 - DNA, 1814 bp, Zea mays
  CDS (111)..(1556)
ccacgcgtccgagtccttcttcgtaagccttcaaaccgacgaatttgagcaactgcacccagagcgcgatccattgccggggaagaagcaacttgttgcgagcctcctctatggcgagctccgaccatggttccaccaccgcccccaaggacgtgcctggcagctacggcctgccgctggtgggcgccgtgcgcgaccgcctcgacttctactacttccaggggcaggacaagtacttcgagtcccgcgtggagcgctacggctccaccgtggtgcgcatgaacgtgccgccgggccccttcatggcgcgcgacccgcgggtggtggcggtcctggacgccaagagcttccccgtgctcttcgacatggacaaggtggagaagaaggacctgttcacgggcacctacatgccgtccacctccctcaccggcggctaccgcgtctgctcgtacctggacccctccgagcccacccacaccaaggtgaagcagctgctcttctccctcctgctctcccgcaaggacgacgtgatccccaccttccgctccaacttctcctcgctcctcgccaccgtggaggcggagctggccaagggcggcaaggccgagttcaacaagctcaacgacgtcacctccttcgacttcatcggcgaggcctacttcggcgtgcgcccctcggcgaccgacctcggcaagggcgggccgaccaaggcggccaagtggctcatctggcagctccacccgctggtcacgctcggcctccccatggtcctggaggagccgctgctccacacgttccacctcccgcctttcctcgtcaagggcgactacagggcgctgtacaagtacttctccacggtggcgaagcaggcgctggacaccgccgagggcctgggcctgtcgcgcgaggaggcctgccacaacctcctcttcgccaccaccttcaacagctacggcggcctcaaggtgctgttcccgggcctgctggccaacgtggccagcggcggcgagaagctccacgagcggctggtggccgagatccgcggcgccgtggccgacgccggcggcaaggtcaccctcgcggcggtggagaggatggagctggccaagtcggtggtgtgggagtcgctgcgcctggacccgcccgtcaagttccagtacgggcacgccaagaaggacctgctggtggagagccacgacgcggtgttccaggtgaggaagggcgagatgctgttcggctaccagccgtgcgccaccaaggacccccgcgtgttcggcgacaccgccggggacttcgtgcccgaccgcttcctcggcgaggagggcagcaagctgctgcagtacgtgtactggtccaacggccgtgagaccgagaaccccagcgtcgacaacaagcagtgccccgggaagaacttcgtggtgctggtcggcaggctcctcctcgtcgagctcttcctccgctacgacacattcaccgccgaggtcggcaaggagctgctcggcaccagcgtcatcttcaccggtgtcacgaaagctacctccggtccgggcagcgagtaaaccgcccggccggcgcgcgtcgttggatatatgatgagtggacgtgacagagtgtcccattatttcttaatttcgtcattttcctccttccttctaataagacttctctctcaccctcggccccaccttcacgtgtgattggaggtgtttgtcgcttttgtaataattataatgcaggatggcatgttgcataaattgctccccaaaaaaaaatcttatctttcacaaaaaaaaaaaaaaaaaaaaaaaaaaggc

SEQ ID NO: 217 - DNA, 2419 bp, Zea mays
  CDS (139)..(1911)
gaattcccgggtcgacccacgcgtccgcccacgcgtccggcatcaccacaccccgtctccaccccgtacaaatccaaaagagggcgaggagggaaacagatcggctggcggcaatcggtagccggcttggctggcacgatgggcggcgaggccgagggcggggagcggcggctggggcgggtgctgagctttgggatcccggacacggcgctggggctagtgatggggtacgtggaggatccctgggaccgcgacgccatctcgctggtgtgccgacactggtgccgcgtcgacgcgctcagccgcaagcacgtcacggtcgccatggcctactccacaacacccgagcgcctgttccggcgcttcccgtgcctcgagtcactcaagctcaaagcgaagccccgcgcgtccatgttcaacctcatctccgacgactggggcgggtctgcgtcgccttggatccgacagctctcggccaccttccacttcctcaagaagctccacctgcgcaggatgatagtatccaacgaagatatcaacatccttgtgcgtgccaaggcgcacatgctcgtcgcgctgaagctcgaccgctgctccggcttctccactccctccatcgcactcgtcgcccgttcctgcaggaaactggaaacacttttcctggaagaaagcacaattgatgagaaagaaaatgatgagtggatccgtgagcttgctacgagcaattctgttcttgagacactgaatttctttctaacagatctcagggcatccccagagtatcttaccctccttgtgcgcaactgtcaacgattgaaaactctgaagattagtgaatgtttcatgcccgatctggtcagtttgttccgaactgcacaaacactacaagagttcgctggtggttcctttgaagagcagggtcaacctgtggcaagtagaaattatgagaactactattttcctccttcactgcaccacttgagtttgctctacatgggaacaaatgatatgcaaatactgtttccatatgctactgcacttaagaagttagaccttcagtttacattcctttccacagaggatcattgtcagatagttcaacgctgctccaatctggaaaccttagaggtgagggatgtcataggggatcgtggactacaagttgttgcacagacctgcaagaaattgcataggctcagagtagagagaggagatgatgatcaaggaggtcttgaggatgaacaaggtaggatttcacaggtggggttgatggctatagcccaaggctgccctgagttgacatactgggcgatacatgtatcagacattacaaatgcagctttagaggcagttggtacatgcagcaaaaatcttaatgacttccgccttgtcctccttgatagagaagcacatataaccgaattgccactggacaatggggttcgtgctttgcttagaggttgcaccaaactacggaggtttgcattttatgtgagacctggggccctatctgatgttggtcttggctatgttggagaatttagtaagagtattcgttatatgttgcttggtaatgttggtgaatctgataatggaatcatacaattatcaaaaggctgcccaagcttgcaaaaactggaggtgaggggttgtctctttagtgagcatgctttagctttggctgcactacagcttaagtcactgaggtatctgtgggtacaaggattcaggtcatctccaactggaactgatattatggcaatggtacgccccttctggaacattgagtatattgttccagatcaagatgaaccttgcccagagcataagagacagattctggcatactactcccttgctggcaggaggacagattgtcctccatcagtaactctgctttacccggcattttgagtgtagatacttgctttttgccagactgaatctcatggtactaagttccattggtcccactatctgtgaagtaaatggtccctgttcttccaattgatgaggacatgcagacgttccagtgcaaagaaccccaaaggtaagctttaagcaggacggccagctctgaactgaggctagctgagaacaatcatgaatacctgaaggcagcacttatgtcagcttggcctagctgtccagtatgggcatgtaagctttaccatcttttgtagttttggagaaacaattttgcaataactacccttgtttagtgtatattatcgattttcgttcatatgctgttgtattgttgtattgaacaattatgtcaattaattagtctacactctacagtctaacttgctgtgattcgatgaatagtgtttatatcacccacaaaaaaaaaaaaaaaaaaaaaaaaaaaaaaaaaaaaaaaaaaaaaaaaaaaaaaaaaaaaaagggcggccgc

SEQ ID NO: 218 - DNA, 2178 bp, Zea mays
  CDS (130)..(1923)
attcggctcgagaccacacctgcagaaatcacagcggcaggtgcagcaaaaatctccatgcccccgctcggctagatctccgacgagccggccccgcgctgtagcagattcgctccccgatcccgaccgatgggcggtgaggtgccggagccgcgccggctgagccgcgcgctcagcttcggctgcggcggcgtccccgaggaggcgctgcacctcgtgttcggctacatggacgacccgcgagaccgggaggcggcctcgctcgtgtgccgcctctggcaccgcatcgacgcgctctcgcgcaagcacgtcaccgtgggcttctgctacgccgtggagcccgcgcggctgctcgccaggttcccgcggctcgagtcgctcgcgctcaaggggaggccacgcgccgccatgtacgggctcatccccgaagactttggcgcctacgcggcgccctgggtcgccgagctcgccgcgccccttgactgcctcaaggcgctccacctgcgtcgcatgaccgtcaccgacgaggacatcgccgtgctcgtccacgcgcgcggccacatgctacaggcgctcaagctcgacaagtgctccggcttctcaacagacgccctccgcctcgtcgcgcgctcctgcaggtctctgagaaccttgttcctggaagaatgtataattgaggatgaagggagtgaatggctccatgaactcgctgtcaacaattctgttctggtgacactgaacttttacatgacagaactcaaagtggagcctgctgatctggagcttcttgcaaagaactgtaaatcattgatttctttgaagatgggtgactgtgatctttcagatctgattgggtttttccaaacctccaaagcattgcaagaattcgccggtggtgccttttttgaagttggagagtacaccaagtacgaaaaggtcattttcccacctaggctatgcttcttagggggtcttaccttcatgggtaaaaacgagatgccagttatctttccgtattccacaatgcttaagaaactggacttgcagttcactttcctcaccactgaagaccactgtcagcttattgctaaatgccccaacctaagtgttctcgaggtgaggaatgtgattggggatagaggactagaagttgttgctgctacatgcaagaagctacgaaggctcagaattgagcgtggcgacgatgatcctggccaagaagagcagggaggagtctctcagataggtttgacagccgtagccgttggctgccgcgaactagagtacatagctgcctatgtatctgatatcacaaatggggcgctggaatccattggcactttctgcaagaatctctatgatttccggcttgttctacttgacaaacagaagaagataacagacctgccacttgacaacggcgtccgtgccctactgaggaactgcgtcaaacttcggaggtttgccttctacctgagaccgggagggctttcagacgtaggcctcggttacattggactatacagtgggaacatccaatacatgctgctcggcaacgttggtgaatctgacaacggattgatccagtttgcaacgggatgcaccaacctgcggaagctcgagctgaggggctgctgcttcagcgagcgagctctggcagtggccgtgctccagatgccctcgctgaggtacatatgggtgcaggggtacagagcctctcgaacgggccaggacctcatgctcatggccaggccgtactggaacattgaattcgcgcctcccattcccgagagcgcttatcgggtgatggcagatggacagccttgtgttgacacccatgcccaggtccttgcgtattactcccttgctggaaggaggccggactgccctcagtggctggtgactttgcaccctgcgtcactgtaaatacgtcaagctgtcccgagtgtggtttttgtaccagctgcttgtgtaccgtaataaactctagtactgtagtggtggaggcgtagtgcaataaagttgcagttgttgcttgtactagtgaatctaatcctaggaggttgttgccctgtgctttcttttccccggaattgtatctttgctccactgtaaatatcagaaatggcctgtgctagatgagttgaataaaaaaaaaaaaaaaaaaaaaaaaaaagg

SEQ ID NO: 219 - DNA, 2743 bp, Zea mays
  CDS (389)..(2368)
attcggctcgagctcctaacctgtcgagctgcccacagcccgtacctacctgcccccagtccccgccgccccgcctgcccgacccgcggcttatccaccacgtccaccgctgggctggatcgatcgggaccggggtcgcgccgccgccgctgccctccgcactcgcgggatcctgttcctaccatgcagcagcgctgcgcccttgcccgaccgcgccggcccgccgaaccgcgcgttccgctccccgacgatcactccctcgtcgccgtcttctccttcctcttcatccccacctaaatcaacctcctcgccgcgaaattctgctacaatttcttcatcttcccttgccgccgggagcggacggatcgccgcttcctcggccggcgggatgagccgggaggcgcagaaactcgactgcaccgccgccggcggcgggatcggggtcctgtcgctggacctgctgggccaggtgctggaacacctgcgggagccccgggaccgcaagacgtgccgcctcgtcagccgcgccttcgagcgcgccgaggccgcgcaccgccgcgcgcttcgggtgctccgacgcgagccgctcccgcgcctgctccgcgcgttcccggcgctcgagcggctcgacctctccgcctgcgcctcgctcgacgacgcctccctcgccgcggccgtcgccgacgccggcggggggctcgccggcctccgcagcgtgtgcctcgcgcgggccaatggtgtcggctggcgcggcctcgaggcgctcgtcgcggcctgccccaagctggcggccgtcgacctgtcgcactgcgtcagcgccggggaccgcgaggccgccgcgttggcggcggcgtccgagcttagggacctgaggctggacaaatgccttgccgtcaccgacatggggctcgccaaggtggctgttgggtgccccaagctggagaagctcagcctcaagtggtgccgtgagatctctgacattggaattgatctgttggccaagaagtgccctgagctccgcagcctcaacatatcctacctcaaggtgggcaatggatcccttggatcaatttcgtcacttgagaggcttgaggaattggcaatggtttgttgttcaggtatagatgacgaaggcttggaattgctgagcaaggggagcgattcgctgcagagtgttgatgtgtcaagatgtgatcatgtgacttccgaggggttagcttcactcatagatggtcgcaattttcttcagaagttatatgctgcagattgtttgcatgagataggacagcgttttctatccaagttggcaagactgaaggaaaccttgacgttgctgaaactcgacggtcttgaggtctcggactctcttcttcaagccattggtgaaagctgtaacaaattggttgagattgggcttagcaaatgcagtggtgttacagatggaggaatctcatctcttgtagctcggtgtagtgacctaagaacaattgatctcacatgctgcaatctcattaccaacaatgcgcttgattcaatagctgacaactgtaagatgcttgaatgtttgcggttggaatcatgctctttgataaatgagaagggactaaagcgaattgcaacttgttgccccaaccttaaggagatagacctcactgactgcggagtggatgacgcagcattgcagcacttggctaaatgctctgaattgcgaatattgaaattaggcctatgctcaagtatttctgacagaggcattgcatttatcagttctaattgtggaaagctcgtggagcttgatctctaccggtgcaactctattactgatgatggattggcagctttagcaaatggatgcaagaggattaagttactgaacttgtgttactgcaacaagatcactgatactggtttaggtcacttaggctccctggaggagctcacaaaccttgaactgaggtgcttggtccgcgttacaggcattgggatctcctcagttgcaatcggatgcaagaacctgatagagctggacttgaaacgatgctattcggttgatgacgctggactgtgggcccttgctcgttatgctttgaaccttagacagcttacgatttcgtactgccaagtcacggggttgggcctgtgccacctgctgagctccctgcgatgcctccaggacattaagatggtgcacctctcatgggtatcaatagaagggtttgagatggctctgcgagcagcctgcgggaggctgaagaagctgaagatgctctgcgggctgaagaccgtgctctcccctgagctcctccagatgctgcaggcttgtggctgccgaataagatgggtcaacaagcctcttgtctacaaggactagacagactcgtgttcctcattgtgtgtgcagtgtcagcatcagcatgtattgtcaagatcttgcaggtttgccctggctcacgttgtgagtccgcaataatcgttgggggcgtaagctcccgtccccaagatgtggttatggtgcctttggggcacttcttgcgccatttgtcactctctgctccggtgtatctgtgtatgcaaacggaggcaccggtaatgttcatgtgtatatagcgtgcagtagaatgatcccattttatgggattagttagtgtgtaattgttacctcatttcgcatgattcgaatcttgagatgaaagaatcataaggggtatgatcgatgcattgcattcaaaaaaaaaaaaaaagg

SEQ ID NO: 220 - DNA, 1291 bp, Zea mays
  CDS (61)..(1011)
ggcctgccctgtcctgccttgttaagcaacacagcgagacatcacgagagctagagagagatggcggccacggtttcctccttcccggtggtgaacatggagaagctggagacagaggagagggccacggccatggaggtcatccgcgacggctgcgagaactggggcttcttcgagctgctgaaccacggcatctcgcacgagctgatggacgaggtggagcggctgaccaaggcgcactacgccaccttccgggaggccaagttccaggagttcgcggcccggacgctggaggccggcgagaagggcgccgacgtcaaggacgtggactgggagagcaccttcttcgtccgccacctcccggcctccaacctcgccgacctccccgacgtcgacgaccgctacaggcaggtgatggagcagttcgcatcggagatccggaagctgtcggagaggctgctggacctgctgtgcgagaacctcggcctggagcccgggtacctgaaggcggccttcgccgggtcggacggcccgacgttcggcaccaaggtgagcgcgtacccgccgtgcccgcgcccggacctcgtcgacggcctccgcgcgcacaccgacgccggcggcatcgtgctgctgttccaggacgaccaggtgagcggcctgcagctgctcaggggcggggagtgggtggacgtgccgcccatgcgccacgccatcgtcgccaacgtcggcgaccagctggaggtcatcaccaacgggcggtacaagagcgtcatgcaccgcgtgctcacgcgccccgacggcaaccgcatgtccgtcgcgtccttctacaacccgggcgccgacgccgtcatcttcccggcccccgcgctcgtcggcgccgccgaggaggaccgcgccgaggccgcgtacccgagcttcgtgttcgaggactacatgaacctgtacgtgcgccacaagttcgaggccaaggagcccaggttcgaggccatgaagtcggccatcgccaccgcgtgagcaaagactgacttccgctcccggcttccttcgtggcgtcaagccttgaggcttgaacgaacaacgtacgtccatgtgcttatagtggcacagttatcgcgtggaacggcctaatgtatttcggttgcctcagatcgatctatatgtgcgtatacattatgtactgaaaagtgtgtagcgtctggttaatgtacgagcagtgtgtatgtgaccaggacccggtgtgtagttgctactactaccatatccggtgaatgatcaaaccttttggtgtatt

SEQ ID NO: 221 - DNA, 1485 bp, Oryza sativa
  CDS (2)..(1465)
gatggtgagccaagtggtcgccgaggagaagccgcagctgctgtccaagaaggccgggtgcaacagccacggccaggactcgtcctacttcctggggtggcaggagtacgagaaaaacccgttcgaccccgtctccaacccttccggcatcatccagatgggcctcgccgagaaccagctgtcgttcgacctgcttgaggagtggctggagaagaacccccacgcgctcggcctccggcgagagggcggcggcgcctccgtcttccgcgagctcgcgctgttccaggactaccacggcctcccggctttcaaaaatgcattggcgcggttcatgtcggagcagagagggtacaaggtggtgttcgaccccagcaacatcgtgctcaacgccggcgccacctcggctaacgaggcgctcatgttctgcctcgccgaccacggcgacgccttcttcatccccaccccatactacccagggttcgaccgcgacctcaagtggcgcaccggcgcggagatcgtacccgtgcactgcgcgagcgcgaacgggttccgggtgacgcgcgccgcgctggacgacgcgtaccgccgcgcgcagaagcgccggctgcgcgtcaagggggtgctgatcaccaacccgtccaacccgctcggcaccgcgtcgccgcgcgccgacctcgagacgatcgtcgacttcgtcgccgccaagggcatccacctcatcagcgacgagatctacgccggcacggcgttcgccgagccgcccgcgggcttcgtcagcgcgctcgaggtcgtggccgggcgcgacggcggcggcgctggcgtgtccgaccgcgtgcacgtcgtgtacagcctgtccaaggacctcggcctcccggggttccgcgtcggcgccatctactccgccaacgccgccgtcgtgtccgcggcgaccaagatgtccagcttcggcctcgtgtcgtcccagacgcagtacctcctcgcggcgctgctcggcgacagggacttcacccggagctacgtcgcggagaacaagcggcggatcaaggagcggcacgaccagctcgtggacgggctcagggagatcggcattgggtgcctgcccagcaacgccggcctcttctgctgggtggacatgagccacctgatgcggagccggtcgttcgccggcgagatggagctctggaagaaggtggtgttcgaggtcggcctcaacatctcccccgggtcgtcgtgccactgccgcgagcccggctggttccgcgtctgcttcgccaacatgtcggccaagaccctcgacgtcgccatgcagcgcctcaggtcgttcgtcgactccgccaccggcggcggcgacaacgccgccctccgccgcgccgccgtccccgtcaggagcgtcagctgcccgctcgccatcaagtgggcgctccgcctcaccccgtccatcgccgaccggaaggccgagagataatcgccaagaacaaaaccaca

SEQ ID NO: 222 - DNA, 1428 bp, Zea mays
  CDS (128)..(1240)
cccacgcgtccgactcgccattcctaagtcctaactacctccaaccccgcacgcacaactggccgcgccaaggcaaagctagaagaagacaacgcaaagggagaggacagaggaggagcagaggacgatgggcagcggcggcgctaacactgcccccctcctcaccccctacaagatgggaaaattcgatgttacccacagggtagtcctcgcaccactgacgagacagcggtcctacggcaacgttccccagcctcatgccatactgtactatcagcagagggcgactaaaggaggtcttctgatcgctgaggccacgggggtttcagacactgctcaagggtacaaggacactcctggcatttggacccatgagcaagtcgaagcatggaagccgatcgtagacggggttcaccagaaaggagggatatttttctgtcagatttggcacgtagggagagtctccaattccacttttcagcctaatgggcaggctccaatttcaagcaccgataagccactaaagcctcaagtgagagccaatggtatagacgtggctactttcgcagttcctagacgcttagagactgatgaaatccctttggtcgtcaatgatttcagggtagctgctcgaaatgcgattgaagctggatttgatggtgtcgaaatccatggagctcacggttacctgattgatcagtttctaaaggacggggtcaacgaccgcacagacaaatacggtggcagtctggagaaccgctgccggtttgcactggaagtaactcaagctgtggtcgacgaaattggagctgacaaggtcgggataaggctgtcaccattcgctagctactcggaggcgccggactcagacccggaagctctgggcatgtacatggcgaacgcgctgaacgagttcgggattctctactgccacatggtggagccgcggatggtgaaactcggtgaaaagttcgaaaccccctacagccttcgcccgataagggacgctttcaggggaacgttcatcgttgccggcggctacggcagggaggatgggaatcgagcgatctccactgggtatgctgatttggtcgcgttcgggcgcttgttcttggctaatcctgacctgcctcggaggtttgaagtagacgctccccttaacaagtacaacagagacacgttttacatccctgatccggttgttggatacactgactacccatttctttcgtcagatgtataaatgttctcttttcagcaatctgcttttttagattgagtagtaactggttggtgtaccagtaaaatagtagaggaataaaccattggtctgaatgcctcattctcatatatatggacaaaagcaatatgatcgttgtaattgtgcctcaaatcttatagttgtaaaaaatattgtgaagaaaaaaa

SEQ ID NO: 223 - DNA, 1324 bp, Zea mays
  CDS (166)..(1242)
gctccccgtttccctctccaactccaatccatggcctccacggatcgctccacgccggcggaggacgagcaacagcagaagcgcccgtctctcttctcgccgtaccagatgccccgcttccgcctcacccaccggtgagcctccatcgcggtggtgctggcgccgatgaccaggtgcagggcgcccgacgcgatcccaggccccgcgctcgcggagtactacgcgcagcggtccacggagggcggcttgctcatctccgagggcaccatcatctcgccgtccggccctgggttccctcgtgtccctgggatatacaatcaagaacagactgatgcatggagaaaggtggttgatgctgttcatgccaagggagctatctttttctgccaactatggcatgtaggccgagcttctcaccaagtatatcagccgggtgctgctgctccgatatcctcaactgataagccaatatcatcaagatggaggatactgatgcccgatggatcctatggcaagtatccaactccgaggcgcctagccacatccgagataccagaaattgttgagcaataccgtcaagcagccgtaaacgccatcaaagcaggtttcgatggcatcgagatccatggcgcccatggctacctcatcgatcagttcctcaagggcggtatcaacgaccggactgacgagtacggtggctcactctccaaccgttgccggttcctcctggaggtgacccgagccgtggtctctgcgataggggcagaccgcgtcgcggtccgagtgtccccggccatcgaccatctcgacgcctacgactccaaccccctgcagctcggcctggccgtggtggagcgtctcaacgctctccagcaggaggccgggcggctggcctacctccacgtgacgcagccacggtacacggcgtacgggcagacagagtctggccagcacgggagtgccgaggaggagagccggctgatgcgtgccgtgcgaggtgcctaccgtggcacgttcatgtgcagcggtgggtacacgcgggagctcggggtcgaggccatcgagtccggggacgctgacctggtgtcctacgggcggctgttcatcgctaatcccgacctggtggagcggtttcggcgcgacgccccgctgaacaaatacgtgcgcaagacgttctacacgccggaccccgtcgtcggttacacggactacacattcctcggccagcctaaggcacgcatgtgatttgattattagtgcgttgccgtaattataagaggcggagtattgtttgtatgttgtgacttgagaaaacaagcaaaaa

SEQ ID NO: 224 - DNA, 1376 bp, Zea mays
  CDS (92)..(1210)
cccacgcgtccggcgagcaacagagcagaagcaaagcgcagagctagcaagtgaccgaccgagagcaaataggcaaggcaacgcaggcaagatggtgcagcaagccgcgaaggaggtgatcccgctgctgacgccttacaagatggggcagttcgagctctctcaccgggtggtgctggcgccgctgacgaggtgccgctcctacggcaacgtgccgcagccacacgccgccgtgtactactcgcaacgcgccaccaggggtggcctgctcatcgcggaggccacgggggtgtcggccaccgcgcaggggttcccggagtctcctggcatctggacgcaggagcaggtcgaggcgtggaagcccatcgtcgacgccgtccaccgcaagggcgccatcttcgtctgccagatctggcatgtgggcagggtctccaccaacgagctccagcccaacggcgacgcgcctatctcgagcacggacaagcagatctcccccgacgccaagtccggaacggcgtactcgaagccgcgccggctgcggaccgacgaggtccccgggatcgtcgacgacttcaggcgggccgcacggaacgcgatccaggctggtttcgacgccgtcgagatccacggcgcgcacgggtacctcctggagcagttcatgaaggacagctgcaacgaccgcacggaccagtacggcggcagcctggagaaccggtgccgtctcgccgtggaggtcgtggacgccgtcgtccgcgaggtgggcgcgcgccgcgtcggcatcaggctgtcgcccttcgtcgacttcgtggactgcgtggactcggacccggtggcgctcggccactacatggtgcagcagctcaacaggcatagcggcttgctctactgccacatggtggagccccgcattaccgcccacgggcgcaggcagatccctcacgggctcttgccgttccgaaaggcgtttcatggaacgttcatcgccgccggtgggtacgatcgggaggaaggcaacaaggtggtggcagaagggtatgctgacctcgtcgcgtatgggaagctgttcttggctaacccggacctgcctaggaggttcgagctggatgtggcactcaacaaatacgaccgctccaccttctacacgcaagatcctattgttggctacacagattaccctttctttgaagaagaagatggcaagaatgagaggtgaaatctgataatgtggagggttcatcaagtataagttcgtcattatttccaccattcattattggtcattgtggtggagtcattgtgtcatgttgtttcattctgtactagtgtggtgtgaagtgaaataaatctatttggtgaaattgttataaaataaaaaa

SEQ ID NO: 225 - DNA, 1789 bp, Zea mays
  CDS (83)..(1594)
ctcaccaccaccacacacgggagatagctatagctagcatagcaagccagccagtcagcgacttagcagcagctagctagccatgctgccgtccttcgtgtcgccgacggcgagcgccgcggcctcggtgacgcctccgccgcggccgataccaggcagctacgggccgccggtgctgggcccgctgcgggaccggctcgactacttctggttccagagccaggacgagttcttccggaagcgcgcggcggcgcaccgcagcaccgtgttccgcaccaacatcccgcccaccttccccttcttcgtgggcgtcgacccgcgcgtggtcgccatcgtggacgccgccgccttcaccgcgctcttcgacccggacctcgtggacaagcgcgacatcctcatcgggccctacaacccgggcgccggcttcaccggcgggacgcgcgtcggcgtgtacctcgacacgcaggaggaggagcacgcgcgcgtcaagaccttcgccatggacctcctccaccgctccgcccgcacctggtccgccgacttccgcgcgagcgtcggcgccatgctggacgccgtggacgcggagttcggcaaggacgacggcagcgacaagaagccctccgccagctacctcgtccccctgcagcagtgcatcttccggttcctctgcaaggcgttcgtgggcgccgacccgtccgccgactggctggtggacaacttcggcttcaccatcctggacatctggctggcgctgcagatcctgcccacgcagaagatcggcctcgtccagccgctggaggagctgctcatccactcgttcccgctgccctccttcctcatctggccgggctactacgtgctctaccgcttcatcgagaagcacggcgccgaggccgtggcctacgccgaggcgcagcacggcatcggcaagaaggacgccatcaacaacatgctgttcgtgctcggcttcaacgccttcggcggcttctccgtgttcctgcccttcctcgtggccaaggtcggcggcgccccggcgctgcgcgagcggctgcgggacgaggtgcggcgcgccatggtgggcaaaggcaaagacggcgagttcgggttcgccaccgtccgcgagggcatgccgctggtgcggtcgacggtgtacgagatgctgcggatgcagccgcccgtgccgctgcagttcgggcgcgcgcgcagggacttcgtgctgcgctcccacggcggcgccgcgtaccaggtgtccgcgggcgaggtgctgtgcgggtaccagccgctggcgatgcgggaccccgaggtgttcgagcggcccgaggagttcgtgccggaacgcttcctcggcgacgacggcgccaggctgctgcagcacctcttctggtccaacgggccggagacggcgcagcccgggcccgggaacaagcagtgcgccgccaaggaggtggtggtggacacggcgtgcatgctgctggccgagctgttccggcgctacgacgacttcgaggtggagggcacctccttcaccaagctcgtcaagcgccaggcgtcgccgagcgtggcgcaggcagcagccgccgccggagcgcagcagtgagtgcgctgtataggatccatcggtggcgtgcgacgtcgccggcgccggccaagcaataaagtaaattgagtaggccctcctcgtcatccacatgctcgtctgtgttcgacttcgatcggtgtctcttcctcccggccggccgctggccgccggcggccgttgtggtaataaaaaaaacacttgtgcaaaaaa

SEQ ID NO: 226 - DNA, 1684 bp, Glycine max
  CDS (26)..(1135)
gtagagataaaattatagaacaagaatgaaggtagcacaggtactgcacatgaacggtggcgttggacacgcaagctatgcaaacaactcccttcttcagcaaaaggtgatttgtttgacaaagcccataagagaggaagccataacaagcctctattgcaacaccgtccccagaagcttggcggttgcagatttgggttgctcttctggaccaaacactttgcttgttgtgtctgaattcatcaaaattgtggagaagctttgtcgggagctaaaccataaatctccagaatacaaggtctttctgaatgatcttcctgggaatgacttcaacaacatcttcaagtcccttgatagcttcaaaaagaagttgtgtgatgaaatggaaagtgggattggtccatgctacttctctggggttcctggttctttctatggcagggttttcccaaatcaaagtcttcattttgtccattcctcttatagccttcactggctatctaaggttccggagggtgtagacaacaacaggggcaatgtttacattggcagtacaagcccgacaaatgttgcaagagcttactatgagcaatttcaaagagatttctctctttttctcaagtgtcgtgcagaggaattagttaaaggaggtcgtatggttctaacatttttgggaagaagaagcgatgatccctctagcaaagatggtggctacgtttgggagcttatggctactgctcttaacgatatggtcttgcagggaatcataaaagaagagcagttagatacttttaacattcctctatacactccatctccatctgaagtgaaattggaagttcttaaagaaggttcatttgccagcaatcgtctagaggtgtctgaagtgaattggaatgcttttgatgactggaacgctcttgaatttgaatctgaaaggtctgatacacttagtgatggcggatacaatgtggcacagtgcatgagggctgtggcagaaccaatgcttgtcagccactttggtgaagctatcattgaagaggtttttagccgctaccaacaaatcttgactgatcgtatgtccaaggagcaaactaagtgcatcaatgtcaccgtattattgactagaaaagcataagcaagaagtttgcatctatatagggtttctcaaaatgggattgttgtagtcatagtttaaaaatatggctcgactaggcttgtcggatcgagatctgatgacataacccgtccgatttgattattggaccggttatgcatttggtccagaataatccggtccaacccgcccgatttggagtaaattcggcgatcctgtccgatatttccatttcgcctaaaaaagaaaacaaaaaaaaatgttaaaaaaacctaagacttaagtatttgtgttatactccaaagattaaggcagtcgatgtgagacttaagtatttttcaataatatatattggatcaaatcgagctaataactggcctaccggttagaacactgactcactacctcaactgggtcaatgacaggaagagattaactttggctgctctgagttgtgactttttgcttgttcgtttttcttctagcaattagctagatgttaagttggagaaaaataaaactagtattgtgtggttcagtaaaaaaaaaaaaaaaaaaaaaaaaaaa

SEQ ID NO: 227 - DNA, 1410 bp, Zea mays
  CDS (39)..(1184)
cttgtcactcatcagcacggttagtatagctagccaccatgaaggtagagcgcgatctccacatgagccggggcgacggcgaggacagctacgcctccaactcaaggcttcaggagaagtccatactgaagacgaggccggtgctgcacaaggccgtggcggcggcgcacgccttgtcgctctcctcaggaggacccggcggcggcgccatggtcgtcgcggacctcggctgctcgtcggggcccaacacactgctcgtcgtctcggaggtgctagcagcggtggcgatggtggccggcggcagcgcccaaccgcagcacgtgcagttcttcctgaacgacctccccgggaacgactttaacctcgtcttccggtcgctggacctgttgaagaacaagaagctggccgccaaggacaggcgggaggagtcgctgctaccgccgtactacgtggccgggctgccgggctccttctacacccggctgttcccggaccactgcgtccacctcttccactcctcctactgcctcatgtggcgctccaaggtccccgacgagctcgccggtggcgcggtcctcaacgagggccacatgtacatctgggaaaccacgccgcaggcggtggtggccctgtacaggaggcagttccaggaggacatgtcgctgttcctcaggcttcgccacagggagctcgtgcccggtggccacatggtgctggcgttcctgggcaggaagaagagcaaggacgtgcttcgtggcgaggtcagctacacgtgggggctcctcgcgcaggctctccagtccctcgtcaaacagggccgtgtgaagaaggataagctggactccttcaacctgccgttctacgcaccttcgatggacgaggtgagggacgtgatcacgcggagccaggcgttcgacatcacccacatccagctcttcgagtccaactgggatccacacgacgacgacgacgtggagatgaagatggaagaagacgtcgccgccgtccagagcggcgtcaacgtcgccaggtccatcagggccgtgatcgggcccctcatcgcccgccactttggcgagcacatactcgacgatctcttcgagctgcatgccaaaaatgtcgcagtgcacctgcagaaagtgaagaccaagtaccctgtcatcgtcgtttccctccaggcgaaatgagccgcgcgccaaataaaggaccaagctagctgatgcaaaatctggcgtcaagttagctattagtaccgctactattatatgcatgcagaataattagtcaaacaatcagaaaaataaagtgcctcagagactgttagtggcagatccaatgtttcgttaattatatgtagtgtaatggtaatggtaatggtaatggtagacatcaggtttcatcgtccaaaaa

SEQ ID NO: 228 - DNA, 1494 bp, Zea mays
  CDS (63)..(1208)
gaattcccgggtcgacccacgcgtccgcggcgcaccgctgaagcctaaactcgcagccagccatgtcgatgagaatcgagcgtgatctccacatggccacagggaacggagaaactagctacacaaaaaattctaggattcaagagaaagctatgtttcagatgaagtcggtacttgaggaggccactagagcagtatgcacagctctcctcccacaaaccatggttgtggccgacttaggctgctcatcagggcctaacacactgcgcttcgtcactgaggtgactagaatcatagctcaccattgcaagctggagcacaaccgacgacatgaccacccgttgcagcttcagttctttctgaatgacctgcccggtaacgacttcaacaatctcttccagctcatcgagcagttcaataagtcatcgacgacacacaagggagatgcagcaactgaggcactacagcctccttgctatatctccggattgccgggctcctactacactaggatcttccctagcgaaagcgttcatcttttccactctctgttctgccttcagtggcgctctcaggcaccagagcaactgaagggcacccaaaaatcatgcctagatatctacatcacaaagactatgtcaccatcgatggtgaagttgtttcaacagcagtttcagaaggacttctccctcttcctcaggctacgctatgaggaactcgtgtctggtggccaaatggttctaacatttattggaaggaagcatgaggatgtgttcactggagagtccaaccatctttacggattgcttgcgcagtcactgaaatccctagttgatgagggtcttgtggagaaagaaaaacttgagtcattctatcttccgatctactcaccgtcggttggtgaagtggaggcgatagtgaagcaacttgggttgttcaacatgaatcatgttaaagtatttgagataaattgggacccctacgatgactcagaaggtgatgatgtgcataacaatattgagagcggtgaaaatgttgctaagtgcctacgcgcagttatggagccgctggtcgcaagccaatttggagaacgcatactcgacaagttattcaaagagtacgctcgccgtgttgccaaacaccttgagaatgagaaaacaaagcatgctgttcttgtcctatccatcaagaaagcaataattcatgtgtgaagtgtcttgtttctcactatatatctttccattagtatcacatggtaatgtatgtttgttttgaatgtgcatgtttgtgtcactagctggtgtattgaatgtcatggtgtttttgttgttttctttatcgcttctcctatattttagatgcctgaattttaaggtgatttcaggcaacactcttgtacaaggaattaataccaataaattgctccttttatgatcaaaaaaaaaaaaaaaaaaaaaaaaaaaaaaaaaaaaaaaaaaaaaaaagggcggccgc

SEQ ID NO: 229 - DNA, 3330 bp, Zea mays
  CDS (415)..(3150)
ttcggcacgaggatcgatctcacttagctgctgctgctgctgcttgctggtggcctgggcctggctgctgtgtctgtatcgatgtgtccgtattttctccatctcgtctgcatacgctgcaattggtaaggagctagctggcctttcatgtcttccatgctgccatagccatacgcccggccggaaggcaggataccccatcgctcgctgcacatgcatgtatgccgcatggggatacatgttcatcatcagcagcacagtggctctgtatcccccatcccaatccgatcctatataggaggaggagaaggaggagcagcagcagcagccaggcgcggccggcggccggagtagtatccgaatccgctcaacacccacaccggtgcgggtggtctctagctttcccatcgatcaatggctttcaaaggactcccgcgtgattcccgagggtccctcgaagtcttcaatccagacgcccctgtttcagatcgtgcaaccacctccccgttcctcctccctcctgcggtcgcgtcccatcccagcctcctcgccgccggagatggcggcgatgctgacgtgggtcgggcgacacagagggccgccgagtggggcctcgtcctccagaccgacgagcacaccggccgcccccagggtgtcgtcgcccgtccctccggttccaaccgcaccagcgagagtggcaactccatcgacgagagggccgccgccgccggtgctggtagagctctcccccgggtgtcggaggagcttcgcgccgcgctctcagcgttccagcagaccttcgtcgtgtccgatgccacccgccctgaccaccccatcctctacgccagcgctggattcttcaacatgacgggctactcctccaatgaggtcgtcggaaggaactgccgcttccttcaaggttctgggaccgaccccgtagagatttccaagatcagacaggctctcgcagctgggtcaaattactgtggccgtatcctcaactacaagaaggatggcacaccattctggaacctcctaaccgttgcccccataaaggatgaggatggcagggtcctcaagttcattgggatgcaagtggaagtaagtaagtacacggaaggtaacaaagatactgctcttcgtccaaatggattgccagagtcactcatcaaatatgatgcaaggcagaaggatcatgctcgtagctcagtctcggagctcctacttgccctgaaggatccacggtcattgtcagaatcaagaaacaataccttaaaaaggaaatcacaggaatcagcaggttcagctctagttcccggcaagagaagctccgaaactggatcccgtcgtaactcacatagtggaatgagaaactctctacaaaaaatcagtgaggtgcctgaaggagggaataagaccaggaaatctggtttgcgttcttttatgggccttattggtatgggacatgggaatgtagagaagaacattctaaaaccaagggaagatcccctacttgatagcgatgatgagagaccagatagcttcgatgacgatttcaggaagaaagaaatgagaaagggcatagatttggctaccacacttgaacgtattgaaaagaattttgtcatcaccgacccgaggttaccagataatccaattatatttgcatcggatagctttttgcgtttgacagagtattgccgcgaagaaatattgggaagaaactgcaggtttcttcaaggacctgaaactgaccgtgggacagtaaagaagataagagatgccatagataaccaaacagaagttactgttcagctgataaattatacaaagagcggtaagaaattctggaacctctttcacttgcagcctatgcgtgatcagaagggtgatgttcaatacttcattggggttcaattggatggaactgagcgtgttcgagaggctgctgcaaaagatggtgccatactggttaagaaaactgcagacaatattgatgaggctgcaaaggagcttccggatgctaatttgagacctgaggatctatgggctaatcactcaaaaccagtcttgccaaagccacatatgaaggatactgcatcgtggagagccatccaaaaggttcttgagaacggtgaaagcattgatttgaaacatttcagaccagtaaggcctttaggatctggtgatactggcagtgtccacttggtggagttgcttggcacaggtgaatactttgccatgaaagctatggataaaagtgtcatgcttaaccgaaacaaggtccatagagctaccgctgaacgacaaatccttgatatgttggaccacccattccttccgacattgtatgcatcatttcagacaaagacacatatatgtcttattgttgactattgtgctggtggggaactctttatgctccttgataggcaacctatgaaggttctgaaggaggatgcggtcaggttctatgctgcagaagtggtcacagcacttgaatacctacattgccaaggtataatctacagagacttaaagccagagaacattttacttcatagagatgggcacatttcattgacagactttgatttgtcttgcttgacatcctgccgaccacaagtgtttcttccacacgatattgataagaagaaaaagaggaggaagagcaggagtaatcccatattttttgctgaaccaatgcgagcatcaaattcttttgttggtacagaggagtacattgcaccggagattattaccggagctggccatacgagtgctgtagattggtgggcgctaggaattcttctatatgagatgttatatggttatacacccttcagagggaaaacaagacaaaggacatttgctaatattctgcacaaggatatcagatttcctgcgagcatacaggtgagcctggcggcaaggcagctgatataccggttgctacaccgagaccctgcaaataggctaggttcctatgagggcgctatggagatcaaacaacaccccttctttcgtggcataaactgggctctagttcgtgccgccacgcccccagagctggaggctcccctccaggatacattggaggccacactgcctcctcctgcagctgatgcggctcacaccgatatgttctgatcatacattgatccatgatgctgcatgttaatttgcttaaaggaagaaaaaaatattagatgatgaagatgcgtgactttggcatagatgagaacaataatgtatgttaaggactaattatcttgatccatctatgcatgctcacaattagaataaaaaaaaaaaaaaaaaaaaaaaaaa

SEQ ID NO: 230 - DNA, 949 bp, Zea mays
  CDS (85)..(771)
cgctgcaagcaacaaagttctactctgtccacccgtccatctagctctcaagaaccaacccgtaccagcgctatccggccggccatggcggcggcgcgccggctctccctgcccctcgtcctgctggtcgtcctggccgtcgccgggcgcgcggcggcgcaggactacgacttcttctacctcgtgctgcagtggccgggggcctactgcgacaccaagcagagctgctgctaccccaagtccggcaagccggcggcggacttcgggatccacggcctctggcccaaccgcgacgacggcacgtacccgcagaactgcagccccgacaacgccttcaacccgtcgaaggtgagcgacctaatgagcagcctccgcgccaagtggccgacgctggcgtgcccgtccaacgacgggctgcgcttctggggccacgagtgggagaagcacggcacctgcgcagccgacgtcttcgacgagcacggctacttccaggccgcgctgcgcctccgcgaccagctgggagtcctcggcgcgctcacctccgccggcgtcaagcccgacggcggctactacacgctgagccagatcaagggcgccatccgccagggcaccggcttcgagccctacgtggagtgcaaccgcgacgaggccggcaacagccagctctaccagctctacttctgcgtcgacgccgccggcgacagcttcgtcgactgccccgtcctccccagcggcaggccctgtggcaaccggatcgagttcccggctttctaagctaactcactcttcacgtcagttgctgcaatatactgctagtccttttgcttgcattctatgcaagaggataatggaatgttcattccccattcttcattttttttgcaaataaaaggagggcgatcggtgttccatatttattatgttgatcataacatgacattcagagaac

SEQ ID NO: 231 - DNA, 3010 bp, Zea mays
  CDS (210)..(2312)
catctgcctgccccccctcggccgccggcggcggcgatcgcgggtagccgccccaaccggccgaggttgcatagaggtgctggtatcttactctgcttctggttatgctatctgcctatgacttcagcttcccaaacttctccctgcttcttgcccctggttggtaaaaatctgtaacaactgctgccctgactgcaaaagacgcaactatgcgtctttcttcttctcttcaagatttgccgaccttcaccagaattgatgctttggaaaggggttctagcgtaggcagtgatctgagctcagggcgcccaaaacctgtccgcatgcttcaaagagatggtgccgtcgcaagcttttcaaaagaaagaacacccccctcatcgccgacaaatagaaagaaatgcatgagagcagccgggtgtgctattgcattgatcttactggtgttctttgcgtatggttcatggagatattttcatgtgttcctctctgaaggaagatctgaatactatgttgttcttgattgtggcagcactggtacgagagtttatgtctatgaatggcatattaatcataatgacgcaaatgcatttcctattgttttgaaacctttagggaatgctcccaagaagaaatctggtaaattaacccgactatatcagcgaatggagacagaacctggattgagcaagctcgttcacaatgaatctggattgaagaaggcaatagagccccttcttcagatggctgagaaattgatccctagacatgcacacaagcacactccactttttctatatgctactgctggtgttcgcaagctacctagtgcagattcagagtggctcctggataagtcctgggatatcctgaacaattcatcatttttatgtagtagagatagagttaagatcattagtggcatggatgaagcttattatggatggatagctcttaaccacaacatggatatgcttggcacctcatcatctaaaatgacatatggttcacttgatttagggggatcatcattacaggttacatttgagaatgataaatcagtgcaggatgagacaagcattcgtctgagtattggttcagttgaacatcacctcagtgcttattctcttactggttatgggttaaatgatgcatttgataaatctgtagcacatctagtgaaaagactgggaggagttgctagcaatggcaaggttcaagtcaaacatccctgtctacagactggattcaaggaagattatatttgttcttactgccatccattgaaacaagatggaagtcccagtgtcggcgagaagaacagtggcaaagagaagcagggaatagctgttgaactggtcggagcacctcagtggaatgaatgtagtgctcttgcaaaagtaacagtcaatctttctgagtggtccagtgcaagtccagggcttgattgtaacatccatccttgtgctcttgcctctaactttccccgaccatatgggcagtttttcgctatctctggcttctatgtggtttttaaattttttaatttgactgctgatgcgactctaggtgatgttcaaaaaagaggtcaggaattttgtgaaaaaccatggaaagttgcaaagagtagtgttcctccacagccttttgtagaacaatattgcttcagagctccttatatttcatcactactgagagagggattgcagattaaagatagtcaggtgataattggctctggcagtattacttggactcatggagttgctttgctggaggctggtcaagcattgtcttcacgactagatattcaaggataccgaatactgcacagggagataaatccaaatattctcatagtactgtttctgatttcaattgtgttggtcatatgtgccatactatgcgtcagcaattcgataccaagatcattccgcaagtcttatctgccaattcataggcataattctggaggcagttctgttcttggtatgggattgcctttcaaacatttattatggaatcccattagttcaggtgatggtagaacaaagacaccactgagccctactgttgctgggtcagatcctcatccatttgcaggactaggaggcagcagtgtcgagcttatggagtcctcgaggcaatccttgggtgcctatcacagctattctgttgggagcttaggtcagatgcagttttctagcggggtgaggaaccctagccgaggtcagactacacttcaaagtcggaggtcgcaatcaagagaggatctcagttcttcacttgctgatattcattttccaaaagtgtagcactgcatcaaggaatgactagaatgagatccttacatgccataacaaactctgtaaataatagctccagagttcgaactgcttgatttcttctctaatcagaagtcaattttgtctgtccgcttacacttcaatgaggtttaggattcatataaatgaacttatgacttgtgcctatcctggacatgatacatccattcatcccattgtatgtgctcaagaacataccatagcagtgaagttctggtagtgtactggaagatatatttatgccgttcaccagactggttgaccatggctacagcctacaactttatagatcgattgtgctgcaatcagggatgttatttttttgtatctgagacataataaaggtgcatgtggtctcatgtactgttgtaccctctaggctctagtggctctgtgaggttactcttctttcctggaataccttttgataggctactctgtggtatcaactgaaatcatgaaacactgacatcagttctactggattatctagttgcgtactgtgtatacacatctattgagttttttttgttggcatagtatctactttgatgacactgaaaatcagtataggaacatttgggccaatgtttttcctcgttgagctgagtttgatctgtattgcacatttgcttgtggatcaaaaaaaaaaaaaaaaaaaaaaa

SEQ ID NO: 232 - DNA, 1404 bp, Saccharomyces cerevisiae
  CDS (1)..(1404)
atgtttaaatctgttgtttattcaattttagccgcttctttggccaatgcaggtaccattcccttaggcaaactagccgatgtcgacaagattggtacccaaaaagatatcttcccatttttgggtggtgccggaccatactactctttccctggcgactatggtatttctcgtgatttgcctgaaggttgtgaaatgaagcaactgcaaatggttggtagacatggtgaaagataccctactgtcagtctggctaagactatcaagagtacatggtataagttgagcaattacactcgtcaattcaacggctcattgtcattcttgaacgatgattacgagtttttcatccgtgatgacgatgatttggaaatggaaaccacttttgccaactcggacgatgttttgaacccatacactggtgaaatgaacgccaagagacatgctcgtgacttcttggctcaatacggttacatggtcgaaaaccaaaccagtttcgccgtttttacctctaattctaagagatgtcatgacactgctcaatatttcattgatggtttaggtgaccaattcaacatcaccttgcagactgtcagtgaagctgaatccgctggtgccaacactttgagtgcttgtaactcatgtcctgcttgggactacgatgccaatgatgacattgtaaatgaatacgacacaacctacttggatgacattgccaagagattgaacaaggaaaacaagggtttgaacttgacctcaactgacgctagtactttattctcgtggtgtgcatttgaagtgaacgctaaaggttacagtgatgtctgtgatattttcaccaaggatgaattagtccattactcctactaccaagacttgcacacttattaccatgagggtccaggttacgacattatcaagtctgtcggttccaacttgttcaatgcctcagtcaaattattaaagcaaagtgagattcaagaccaaaaggtttggttgagttttacccacgataccgatatcctaaactttttgaccaccgctggtataattgacgacaaaaacaacttaactgccgaatacgttccattcatgggcaacactttccacagatcctggtacgttcctcaaggtgctcgtgtctacaccgaaaaattccaatgttctaacgacacctacgtcagatacgtcattaacgatgctgttgttccaattgaaacctgttccactggtccagggttctcttgtgaaatcaatgacttctacgactatgctgaaaagagagtagccggtactgacttcctaaaggtctgtaacgtcagcagcgtcagtaactctactgaattgaccttctactgggactggaacactactcattacaacgccagtctattgagacaatag

SEQ ID NO: 233 - DNA, 1995 bp, Glycine max
  CDS (105)..(1703)
cacttgttcaattactccttcaaatcagtctggcttgacaagcaggaaaggtatttattgctctctacttaggtaacataagccaacaattttagtagtaattaatggctggagaattgggagttttgaatgcacttgatgtggcaaagacacaatggtaccacttcactgctattgtgatcgctggaatgggtttcttcaccgatgcctatgacctcttctgcatttccctagtcaccaagcttctagggaggctatattacacagaaccaggtgcaccaaagccaggttcacttcctccaagagttcaagcttctgtgactggtgtagcactatgtggcacattagccggccaactattctttggttggcttggtgacaaaatggggagaaaaagagtctatggactaacactcattctcatggtagtgtgctcccttgcctcaggactctcctttgggtcaactccagagggtgtcatggcctcactttgcttcttcaggttctggctagggtttgggattggtggtgactaccctctttctgccacaatcatgtctgaatatgccaacaagaagacgcgtggcgcgttcatagccgcggtgtttgcaatgcaaggattcggaatcctggctggtggagtggtggcattgattgtttcatatgcatatgaccaaaagtacaagcttcctagttatgaacagaatccagaagcatccttggaccccgcatttgactatgtttggagaatagttttgatgtttggtgcagttcctgctgcactcacctactactggcgcatgaagatgccagagacagcacgttacactgcccttgtggccaagaatgcaaaacaagctgctgcagacatgtctaaggtgttgcaagtggaacttgaagctgaagaggagaaggtgaagaaattgacagagaatgagagcaacaagtatggtttgttcaccaaggaatttgtgaaacgccatggcctgcatttgttgggaaccaccaccacttggttcttgttggacatagcattctacagccaaaaccttttccagaaggacattttcagtgcaattgggtggatccctccagcaaaggaaatgaatgcaatccacgaggtgtataagattgcaagagcacaaacactcatagcactatgcagtactgtgccaggttactggttcacagtggcattaattgattacatgggccgttttgccatccaattgttggggttcttcttcatgactgtgttcatgtttgctttggctataccatatgatcattggtctgagaaagaaaacagaattgggtttgtggtgatgtactctttcacctttttctttgccaattttggtccaaattccaccacatttgttgtgccagcagagattttccctgcaaggctaaggtccacttgccatggaatctctgctgctgcaggaaaggctggtgcaattgtgggtgcatttgggttcctatatgctgcacaaagcaaggacccttccaagactgatgcagggtaccctactggtattggaattaagaactcactcattatgcttggtgtgatcaacttcattgggatgttgttcaccttgcttgttccagaatcaaagggaaaatcactggaggagttgagtggggagaatggtgaaaatgatgctgaacatgcagtgtctgctaggacagttcctgtttgattgaagttaagtttgtgttcaacaatgtggttcaacttcaaattgtgatatgtgtacattttaatactgggttttggttgtgacgtgtttacaccaatgatgtagtagttgcacggttcagggtgctagagcttaaaaataattacagtttgtttgcttttggttcttacttttgtttttttttttgtttaaaatagatacctggtaattttacttttgattatttgtaaagttttattgttttgttatttaatcacaatttatgattaatttattgtcttttaaaaaa

SEQ ID NO: 234 - DNA, 1947 bp, Zea mays
  CDS (128)..(1750)
cccacgcgtccggcttcaacaagctaggcagctgcaagcatctcccaaatcccagcctgctgccccgcgcgaacacacttctcttgtcgttgcattgcagggcagctagccggctacagcatccgccatggcgcgcggcggggacggcctgcaggtgctcagcgcgctggacgcggcgaagacgcagtggtaccacttcacggccatcatcgtcgccggcatgggcttcttcacggacgcctacgacctcttctgcatctccctcgtcaccaagctgctggggcgcatctactacacggacaccagcaaggacaacccgggctcgctcccgcccaacgtcgccgcggcggtcaacggcgtcgccttctgcggcacgctggccggccagctcttcttcggctggctcggggacaagctcgggcgcaagagcgtgtacgggatgacgctcatgctcatggtcatctgctccgtcgcgtcgggcctctcgttcggccacacgcccacgggggtcatggccacgctctgcttcttccgcttctggctcgggttcggcatcggcggggactacccgctgtcggcgaccatcatgtccgagtacgccaacaagaagacccgcggcgccttcatcgcggccgtcctcgccatgcagggcttcggcatcctcgccggcggcattgtcacgctcgtcatctccgccgccttccgcgcggggtacccggccccggcgtacagggacgaccacttcaactccaccgtgccgcaggccgactacgtgtggcgcatcatcctcatcctgggcgccgcgccggcgatgctcacctactactggcggatgaagatgcccgagacggcgcgctacaccgcgctcgtggccaagaacgccaagcaggccgcggccgacatgtccagggtgctccagacggagatcgtcgacgagcaggagaagctggacgagatggtcaccgccgagagcaacaccttcggcctcttctccagggagttcgcgcgccgccacgggctccacctcgtcggcacctccaccacgtggttcctgctcgacatcgccttctacagccagaacctgttccagaaggacatcttcaccagcatcaactggatccccaaggccaacaccatgagcgcgctggaggaggtgttccgcatctcccgcgcccagacgctcatcgcgctctgcggcaccgtcccgggctactggttcaccgtcgcgctcatcgacgtcgtcggccgcttcgccatccagctgctcggcttcttcatgatgaccgtcttcatgctcggcctcgccatcccctaccaccactggaccacgcccggcaaccacatcggcttcgtcgtcatgtacgccttcaccttcttcttcgcaaacttcggccccaacagcaccaccttcatcgtgccggccgagatcttcccggcgcggctgcggtccacatgccacggcatctccgccgcctcggggaaggccggcgccatcatcggggcctttgggttcctgtacgcggcgcagaaccaggacaagagcaaggcggacgccgggtaccccgcgggcatcggcgtgcgcaattcgctcttcgtcctcgctgcctccaacttgcttggctttatcctcaccttcctcgtgccggagtccaagggtaagtcgctcgaggagatgtccggggaggctgacgacgccgaggacgacgccgtcggcacccgcgcggtgcggccgtcggggacccagatggtgtagaatcgaacatggcgacgcgtgcacacgggtcctccatcctggggcccgactgggaagacaaggcgcgccggttcaagcctgccgatgctttgctgtgcagaagtagttcgtacaggtgcatgtgtgttataggcgggaaagtaagtgaacttacatgcttgtatttattatatccaaccttacgtacaaaaaaa

SEQ ID NO: 235 - DNA, 1701 bp, Xylella fastidiosa
  CDS (256)..(1545)
taagtttaaaaagcgttacgcacgttaagttgcctatttttttatgtattttgcgattcacgcagattgcgtgagcgctttaaggataacccaagaggcggatctataagcgcttaactattaaggtggtttcctttgcatacatctttttttgtggatgtctgtaatagcttaagcgcattattctttgatacctaacaaccgcccttacggtttgccgtttgggcgtctttccattgttaaggagcccacgctatgtccgatcttgataaggtcacgctcaatgccggtgagacttctctcgttttaccggttttgaaacccacgttaggtaatggttgcgttgatattgccaagttgacaaaggaaaccgggctgtttacttacgactctggttttacggcaactgcaagctgtaagtctgccatcacttacattgatggtgaaaagggtgtgttgttgtaccgcggctatccgattgagcagttagctgagcactccagttttttggaggtcgcttatttgttgatgaacggtgagttgccgagaaaagacgagtttgccaagtttgatgatgaaatcacgcatcacacgatgatgcatgagtcgttgaagaactttcttggcggttttcattatgatgcacatccaatggctatgttggctgcttcggtggcttcgctgtcggcgttctaccacgatacccttgatttgaacgatcttgagcaacgtcgcttagctgcaattcgtttgatcgctaaggtgccgacgcttgcagcagcagcgcatcgctactcgattggctggccgatccgctatccacgaaacaatcttggttatgtcgagcgctttttgcatatgatgttcgaagtgcctagtgaaccgctgcagttgaatccagttgtgaccaaagctctggatttactgtttattttgcatgctgatcatgagcagaacgcttcgacatcaacagtccgcttggtgggttcgactggtgctaatccttatgcatcggttgccgcgggtatcaccgcgttgtggggaccggcacacggtggcgctaatgaggccgtgttaaagatgttggaggagattggtgatgctaagaatgttgacttggttattgcaaaagcaaaaactaaggacaaaaactctccattccgtttgatgggtttcggccatcgtgtctataaacattttgatccgcgtgcgaaaatcatccgtgagatggcacacacagttcttggtgagttaggtgtgaacgatccgctactggaagtggcattaaagttggaagaggcagcgctgaaagatgattactttgtgcagcgtaagttgtaccctaacgttgatttttattcgggcatcatctacaaagccatcaacattcctttggaaatgtttacagtgatgtttgccatcgcgcgtaccgcagggtgggtttctcattggcttgagcagcaagtcgacccggagatgaaaatcagcaggccacgccaaatttacacaggtcatggcgagcgtgactacaaagatgctaggtaaagagtaaagagactcttatatcttccaatgtgcttctcagatgaaggagctattgtggatgcctgacgagatcgcgggtaataacccgaatgaccgaccaggaacagcgcctcaaacaacgtgaggtgctgacaatgtatagatggaccaactcat

SEQ ID NO: 236 - DNA, 1701 bp, Escherichia coli
  CDS (309)..(1592)
taaaagttatgaagtcggtatttcacctaagattaacttatgtaacagtgtggaagtattgaccaattcattcgggacagttattagtggtagacaagtttaataattcggattgctaagtacttgattcgccatttattcgtcatcaatggatcctttacctgcaagcgcccagagctctgtacccaggttttcccctctttcacagagcggcgagccaaataaaaaacgggtaaagccaggttgatgtgcgaaggcaaatttaagttccggcagtcttacgcaataaggcgctaaggagaccttaaatggctgatacaaaagcaaaactcaccctcaacggggatacagctgttgaactggatgtgctgaaaggcacgctgggtcaagatgttattgatatccgtactctcggttcaaaaggtgtgttcacctttgacccaggcttcacttcaaccgcatcctgcgaatctaaaattacttttattgatggtgatgaaggtattttgctgcaccgcggtttcccgatcgatcagctggcgaccgattctaactacctggaagtttgttacatcctgctgaatggtgaaaaaccgactcaggaacagtatgacgaatttaaaactacggtgacccgtcataccatgatccacgagcagattacccgtctgttccatgctttccgtcgcgactcgcatccaatggcagtcatgtgtggtattaccggcgcgctggcggcgttctatcacgactcgctggatgttaacaatcctcgtcaccgtgaaattgccgcgttccgcctgctgtcgaaaatgccgaccatggccgcgatgtgttacaagtattccattggtcagccatttgtttacccgcgcaacgatctctcctacgccggtaacttcctgaatatgatgttctccacgccgtgcgaaccgtatgaagttaatccgattctggaacgtgctatggaccgtattctgatcctgcacgctgaccatgaacagaacgcctctacctccaccgtgcgtaccgctggctcttcgggtgcgaacccgtttgcctgtatcgcagcaggtattgcttcactgtggggacctgcgcacggcggtgctaacgaagcggcgctgaaaatgctggaagaaatcagctccgttaaacacattccggaatttgttcgtcgtgcgaaagacaaaaatgattctttccgcctgatgggcttcggtcaccgcgtgtacaaaaattacgacccgcgcgccaccgtaatgcgtgaaacctgccatgaagtgctgaaagagctgggcacgaaggatgacctgctggaagtggctatggagctggaaaacatcgcgctgaacgacccgtactttatcgagaagaaactgtacccgaacgtcgatttctactctggtatcatcctgaaagcgatgggtattccgtcttccatgttcaccgtcattttcgcaatggcacgtaccgttggctggatcgcccactggagcgaaatgcacagtgacggtatgaagattgcccgtccgcgtcagctgtatacaggatatgaaaaacgcgactttaaaagcgatatcaagcgttaatggttgattgctaagttgtaaatattttaacccgccgttcatatggcgggttgatttttatatgcctaaacacaaaaaattgtaaaaataaaatccattaacagaccta

SEQ ID NO: 237 - DNA, 1523 bp, Oryza sativa
  CDS (105)..(1523)
gaacaatcgctctctctctctctccctccccgattcgattcaattcgcgacgcctccgtgaaattctccaaagccagcttgccctgtagccgcgtgctccggccatggcgttcttcaggggcctgaccgcggtgtcgaggcttcgatcccgcgtggcacaggaggccaccacgcttggtggtgtgcgatggctgcagatgcagagcgcatctgatcttgatctcaagtcccagctgcaggaattgattcctgaacaacaggaccgcttaaagaaacttaaatcggagcatggaaaggtccaacttggaaatataacagtcgatatggtccttggtgggatgagagggatgactggaatgctttgggaaacatcattgcttgacccggatgagggtattcgttttaggggtctctcgattccagagtgccagaaagtgctgccgacagcagttaaagatggggagcctttgcctgagggtctactttggcttcttttgaccggaaaggtgccaaccaaagagcaagttgatgctctatcaaaggaattggctagtcgttcgagtgttccaggtcatgtgtataaggcaatcgatgctctccctgtaactgctcatccgatgacccagtttaccacaggagtgatggcacttcaggtggagagtgagtttcaaaaagcctatgacaaaggaatgtcaaaatcaaagttctgggagcctacctatgaagattgcttaaatttgatagctcgccttccagcagtggcttcatatgtttaccggaggatattcaagggagggaaaactatagcagctgataatgcactggattatgcagcaaatttttcacacatgcttgggtttgatgatcccaaaatgcttgagttgatgcgactatatataacaatccacactgatcatgaaggtggaaacgtcagtgctcatactggacatctggttggaagtgctctgtcagacccttatctttcttttgcagctgcactgaatggtttagctggaccgttgcacggcctggctaatcaggaagtgttgttgtggatcaaatctgtaataggtgagactggtagtgacgttacaactgatcaactcaaagagtatgtgtggaagacactaaaaagtggaaaggttgttcctggctttggtcatggagttctacgtaagaccgatccacggtatacatgtcagagggagtttgctttgaagtacttgcctgaggatccacttttccaactggtctccaagttgtatgaagttgtgcctcctatcctcactgagcttggcaaggtcaaaaacccatggcctaatgttgatgctcacagcggagttctactgaaccactttggattatctgaagctcggtattacactgttcttttcggagtttcaaggagcattggaataggatctcagctcatttgggaccgtgctcttggcctgccgctcgaaagaccgaagagtgtcaccatggagtggctggagaaccactgcaagaaggttgctgcttga

SEQ ID NO: 238 - DNA, 1813 bp, Zea mays
  CDS (56)..(1564)
ctgcatttgcttggctgctgctcccttctcccaccgaccaactcgatcccgcgccatggatcgcgccgaccccgcgcggggccgccttgccgtgctctcctcccacctccgtggtgcaggggccgaggaggcggcggggctggagaggtcgccggtatccgcgccggcgcccgggccccgcgccggcgcgcttgccgtggtggacgggaggaccgggaagcggcacgaggtcaaggtctccgaagacggcaccgtgcgcgccaccgacttcaagaagattaccactggaaaggacgacaagggtcttaagatttatgatcctggttaccttaacactgcccctgttcgctcgtccatctgctacatcgatggagatgagggaatccttcgctataggggttatccaatcgaagaattggctgaaagcagctcgtttgttgaggtggcctaccttttaatgtatgggaacttgcctactcagagtcaattggcaggctgggaatttgctatttctcagcattctgctgttccccaaggactgttggatatcatacaatcaatgccccatgatgctcaccccatgggtgttcttgccagtgcaatgagcaccctttctgtctttcatccagatgcaaaccctgctctacaaggtcaagatctttataaatcgaagcaggtgagggataaacaaattgtgcgagtacttgggaaggcaccaacaatagcagctgctgcctacttgagattagcaggaagacctcccgtccttcctttaaatactctatcttattcagagaacttcttgtacatgctggactctttgggtgacagaacatataaaccaaatcctcgacttgctcgagctctagatattctttttattctgcatgctgaacatgaaatgaactgctccactgctgctgttaggcaccttgcttcaagtggtgtggatgtatttactgctctttctggtggtgttggagctctatatggtcctctgcatggcggcgcaaacgaggcagtacttaaaatgttaaatgagattggaagcatggaaaatattccagatttcattgtaggagtgaagaacaggaagaggaagatgtccggttttgggcaccgtgtgtataaaaactatgaccctcgtgctaaagtcataaggaaattggcagatgaggtgttctcaattgttggacgggatccacttattgaggtggccattgccctagaaaaggcagccctgtcagacgaatattttatcaagaggaagctgtatccaaatgtggatttctactctgggctaatttatagggcaatgggattccctacagaattttttcctgtgctgtttgctattcctcgcatgggtggctggctagcgcattggaaagagtcactcgatgatcctgacactaagattataaggccccaacaggtatacaccggcttctggcttaggcactatacccccgtcagagaacgagtgctatcaagccagagtgaggaacttggtcaggttgccacctcaaacgcaactaggcgccgccgtgctggttctgccctgtagaagctgcagcgtataaacgcaccggcatactcaataaacatcgaccacttttgtgcttgaaaaggccacaaatgctttttagcttggttggagttgtaggccttttgttgtcgagtatataggcaataatgcagtgagaacaccacaccgttacaatgtaaaactgtcacgaggcatcacttgctggtgtacaccccttgcgttctctatgacttaatcacttaacttcccaaaagatgaaaaaaa

SEQ ID NO: 239 - DNA, 1854 bp, Glycine max
  CDS (153)..(1691)
aacaatttcgcttttcccttcaaacttccaagttccaattcaactctgatccttaaattcatttgcatattcagtcctttgaattattccactttcttcaaatcattccaattccacaaccaacgaagaagcatcatcaacacaacacaacaatgtcaaaaacaacaacttcttccgaacaaactgcacgaaaccgtttggccaccctcgcagctcacttgcttccctccgacgccacctccgccgccgcgatcctccacccccaccggctctccgcccccaccggagacttgccgccggcgaacctgaagggcacccttaccgtcgtcgacgagaggaccggcaagaagtaccagatcgaagtcaccccagatggcaccgtcagagcctctgacttcaagaagatatcatctgggaaaaatgacaagggactcaaactttatgatcctggctatttgaacactgctcctgtcatctcaaggatttcttacattgatggtgatgctggaatccttagatatagaggatatcctattgaagacttggcagagaaaagcacctttacagaagtgtcatatctcatactgtatggaaatttgccttctgaaagtcagttagcggaatgggaattcgccttatctcagcattcagctgtaccacaaggagttttggatatgatagaatcaatgcctcatgatgcacatcctatgggcatgcttgtcaatgccatgagcgctttgtctgtttttcatcctgatgcaaatcctgctctcaaaggtcttgatatctacaactcaaagcaagtgagagacaagcaaatagcacgggttattggaaagataacaacaattgctgctgcgattaatcttagattggcaggaaggccgcctgtgcttccatccaacaaactttcttacacagagaacttcctatacatgctagattcttttggcaatcgatcatataaacctaatcctcgactaactcgagcgctggacattatcttcgtcctgcatgcagaacatgaaatgaattgctctacatctgctgtacgtcacctctcatcaagtggtgttgatgtatatactgctattgctggggctgttggagctctatatggacctcttcatggtggagccaatgaggctgtcctcaaaatgttgagtgaaattggaactgttgagaacattccagcattcattgagggtgttaaagccaggaaacggaagctcagtggttttggacatcgtgtgtacaaaaattatgatccaagagcaaaggtcttgaggaaactgacagaggaagtgttttccattgttggccgggatcctcttatagagattgctgttgccttggagaagattgcactgtctgatgagtatttcatcaagaggaagctatatccaaatgttgacttctactctggactgatttatagggccatggggtttcaacctgagtttttcactgttttatttgccatccctcgaatggccgggtacttggcacattggcgagagtccttggatgatcctgatacaaagattatgagacctcaacaggtttatgttggggagtggttgaggcattatgcaccaattaatcaaaggactgcatcaagtaacactgacaaacttggtcaattggctgtatcaaacgcctcaaagaggcgtcttgctggatctggggcttaactagtgaaactgccaagtgctcaataaggtccagactccagagaaaaaattaattttttttctggtacataaaataagtttgtttgtttatgtataaaattatgatatcaaatagataaataaaatcatgaaatcaataagaccatggtttcagtaaaaa

SEQ ID NO: 240 - DNA, 1271 bp, Oryza sativa
  CDS (22)..(1038)
gcagtgcaggtgtcgctggccatggcgaggaggagcagcagcagagcgtgcgcggccatggcgacggccgccgtctttgcgctgctggccgcgacggcgacggcgtcggggctcgtacgggtggagcacccggccaagagcgacgggtcgctgagcctgctcgtcgtcggcgactggggccggaagggcacgtacaaccaatccagggtcgccgagcagatggggaaggttggggagaagctaaatatagacttcgtcatatccaccggtgacaatttctacgaggatggactcactggcgtcgatgaccaggcgtttgaggaatcgtttaccgatatctacacggcaaagagcttgcagaagccatggtacctggtgctgggaaatcatgactacaggggtgatgtgctagcacagcttagcccagtcttgcgaaagatcgaccagcgattcatttgcatgaggtcgttcattgttaatgcagagattgtggatttcttctttatcgacacaactccatttcagctgaaatattggactcgccctaaagaccatcattatgactggagaggagtggcacctcgacaaaaatacataactaatctacttaaggatatggatgaggcaatgaagaaatcaacagcgaagtggaagattgctgttgggcatcataccattaggagcgtcagtgaccatggtgacaccaaggagcttctgcaacttctacttccagttctgaaggtcaatggcatcgacttctacatcaatgggcacgaccactgcctggaacacattagcagcagagacagtcctatccaatacttcacaagtggaggtggttcaaaagcatggagaggagtcttgcagccaaattctgataagctccagttcttttacgatggacaagggttcatgtccctccagataaaccaggaccaagctgacttcatattttatgatgtttctgggaacatcttgtacaagtggagcaagagcaaagcaaactacctccagccctccacctatatcactgaagcatgaggcagatgcaaaaccacaaaacggagaattagcttggctaagatatttgtatcaaatttgaatgcattattgtggcacgcaagggaagaggaccggaaaggaaataggaaagtatttaagcatggcatgtgattgatctactaaagaaatttgagacaaggccgagaccatcctactagactaggaaaagagatgttcagtatggtatccattagatctgattcaaaaaa

SEQ ID NO: 241 - DNA, 1441 bp, Zea mays
  CDS (143)..(1186)
cccacgcgtccgctcgtacgccgtcgcttcctgcggtacgtactctctgtccgcagcgttcctccagctagtagcagtagcagctagctagctagctagcaactggccatcggggctgctagcagcgtacgtacgtggcgcgatggctcctccagctcatgataggctccgccgcctggtgctgctcctcgtcgttgccaccgccgcggcggctttgcttctggcgccgacgacggcggatgctgcgctgccgcgggtgcagcacacgcccaccaaggccgacgggtcgctcgccatcctcgtcgtcggcgactggggccgccgtggacagttcaaccagaccttggttgcccagcagatgggcgtggtggggcagaagctggacatcgacttcgtcatctccaccggcgacaacatctacgacgacggcatcgccaacactagcgaccccctcttcaaggaatcgttctccaatatctacactgccaacagccttcagaagccttggtacctggtccttggtaaccatgactacacgggaaacgcgctcgcgcagctcgaccctgccattcgcaaagtggatagccggtacaccgccattgccaagtccttcattgtcaactcaggggttgcggattttttcctcgtcgacacaacgccgttcattgtccactactggaacaacaccaagttcgattggagaggcgtcgctcctcgagacacctacatcgcgaatctcctcaaggacttgaagtgtgcactgacagcgtccaaggctccctggaagatcgtcgtgggtcaccaccccatcagcagcgcctgcgggcatgggaacaacactgagctcgaggagttgcttctcccggtcctcaggacacacggggttgacatgtacttgaatggccatgaccactgcctgcagcgcgtcagcagcagagacagtcgtcttcagctactaaccagcggcggcgggtccaaggcatgggctggcaagttcaagcccaccctcgacaaggtggagttcctctacgacggccaggggttcatgtcgatgcgcctgagcaggacggaggcccgcctcgcgttcttcgacgtcgctggcagcgtcctgcactgctggaccatgcatgcccaaaaattaaagacgacgacgacgacgactgctgctgctgctgcagccgggcactaaagctttgctggatcggagttattaatgttcgttgctgcctcgcggcggtacgatgagttgatgatgcaattaattatttggttttgtcgtcttttcgtgcgtgagagggaagcaataataattatttgctgctgcttccgttgtgtgcacatgcatgtgagggtgtcaagtatgttcagcctcttgcaagataaaatctctcgtcttctatggaataaactgggaaaagagttttttttggtaaaaaaaaaa

SEQ ID NO: 242 - DNA, 1078 bp, Oryza sativa
  CDS (47)..(814)
gccaagacgacgacgacttgggaattcatttgcatcggcaacgacgatgaagctcgccgtggtcgccgtcgcggcgctcctcctcgccgccggcgtcgcctccgccgatgaattcgacttcttctacctcgtccagcagtggcctggctcgttctgcgacacgcaggctgggtgctgcttcccggacaccggcaagccggcggcggagttcggcatccacggcctgtggcccaactacgccaagtgccgtcccgccgccggcgccgtcgccgacgacgacgacggcgtggtggagatggtggtcgacggcggcgccgccgtcgagcgccaccaccggcggcggcagaagtgctggccggagtactgcgacgacggcaacaagctgcggccgtgggagatcaaggacctcgtggcggagctcgatgcgaactggccgacgctgtcgtgcaagggcggcaagagcttcgagttctggagctacgagtggaagaagcacggcacctgctcgggcatgggccagcacggctacttcgcggcggcgctggagctcaagaagcggcacgacctcgccgccgtcctcgccggcgccggcatcgtcccctccgacgacgagagctactccctcggcagcatccgcgacgccatcgccgccgccacgggcgcggtgcccaacctcgagtgcaaccgcgacgccgccggcgagacgcagctgttccaggtgtaccagtgcgtcgaccgctccgggaagaagctcgtcgactgccaactcccgatgcagggcaagtgccgcgacaaggtcaagctgcccacgttctagctagctagctcccccgtcgccatcgtcgccggcgagagctcgccgtcgccggcatggcggcgcgccggcggctggctggtcttggatgtctgatggatgtcacgtgcgtttgcgttgttgcgtggtgcggttttcagattacgagagattcgaggatttgtccagttggattgctacatgtgtacgttacatttggcactatctgctgacttgctgaacagttgaataataacatatcaagttttaccagttgaaaaaaaa

SEQ ID NO: 243 - DNA, 1145 bp, Zea mays
  CDS (55)..(888)
ttctaggagttgtactgagctgagctgccggaggcagaataggagaggcaggcgatgacgatggcgacgaaggcggcgtgcgtgctggcggtgtgggtgctcgtcgcctcgggcctgtgcgacctgggctcagcgcgcgcgcccctgggcagcaagccgcagcgggagttcgactacttcgcgctctccctccagtggcccggcaccatctgcgcctccacccgccactgctgcgccaccaacggctgctgccgctcggagccgctccagacgttcacgatccacgggctatggccggactacgacgacgggacctggccgtcgtgctgccgccgcacccaattcgagatggacaagatattgccactgaaggaggtgcttgacaagtactggccgtccctctactgctccaaatctggaacatgcttcagcggcaagggactcttctgggctcacgagtgggagaaacatggaacctgctctgcccctgtggttcaggatgaattacagtatttcacccttgcccttgacctctactccaagtataacgttacggaaatgctgtcaagtggagggatacaggtttcaaatggtaaggaatatgcactgagcgatgtcatcgataccatcaaacatgcttttgggggatcgccacaaattgtttgcaagaggggttcaatcgaagaacttaggttatgcttcgacaaagaattgaagcctcgtgattgccttaccacttctttggcgaatggaagtgtatcaaaaagcaagcactgcccgcggtacatcaccttgccaacatatgatccccttgtgcttgccaattcaactgtagagatcatgacacagttcgatgaatttgatgtgcctgcagctctttatacagcttaaaatgcaattgttgcaatagcagaaggtgctcgcgtgagcacctagaaccaggcacatttatcctgggatattcaatcatttgtacatgtacacttgaaagagaactgacatcttttcaacctgaaaatttataagctttatgtaaccgtgaaggtcggatattgcacatgtaattcgctaaatcaaaactgtatcttgaggtagaattttcaagtagtaataatagagatataagaaacttatcgcccaaaaaa

SEQ ID NO: 244 - DNA, 951 bp, Zea mays
  CDS (15)..(770)
cgtccacgttccatatggcttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaagccgaccaccggcgtctcgccggcgcgcgacttctacataacgggcttcaccgtccttaacgcgaccaccgacgctgcagtgacgggatgcagcaacaaagttccttacgaccctaacctgattaccggcatccaaggcctgaatcagtactggagcaacatcaggtgccccagcaacaacgggcagagcagctggaagaacgcctggaagaaggccggcgcctgctccggcctcagcgagaaagactacttcgagactgccctctccttccgtagccggatcaacccactcgttcgcctcaaagccaaaggtatcgagccggacttcgggctctacggcctcaaggcgatcaccaaggtcttcaagagcggcatcaacgcgacgccggtgatccagtgcagcaagggccccttcgacaagtacatgctgttccagctctacttctgcgcggcggggaacggcacgttcatcgactgccccgcgccgcagcagtacacctgctccaaggagatcctcttccaccccttcaagaagtggatgctcaagcagcagctcaaccaggacgacgaccctttccagctgcctggcgtcgccatggacaactgatacaccgtaccgtcgtctctgtttgcgtttctgtcaagtgtgcatggaataatactgtaactgtgtttcctgccgggcaatgcactgtgatatgatgcccaacgaataaatgtcgcttttatttttattcgacttcccccctgtaccgtgtggaaataaacctattataagcaaaaaa

SEQ ID NO: 245 - DNA, 976 bp, Zea mays
  CDS (95)..(781)
tcgatccctgcgctgcaagcaacaaagttctactctgtccacccgtccatctagctctcaagaaccaacccgtaccagcgctatccggccggccatggcggcggcgcgccggctctccctgcccctcgtcctgctggtcgtcctggccgtcgccgggcgcgcggcggcgcaggactacgacttcttctacctcgtgctgcagtggccgggggcctactgcgacaccaagcagagctgctgctaccccaagtccggcaagccggcggcggacttcgggatccacggcctctggcccaaccgcgacgacggcacgtacccgcagaactgcagccccgacaacgccttcaacccgtcgaaggtgagcgacctaatgagcagcctccgcgccaagtggccgacgctggcgtgcccgtccaacgacgggctgcgcttctggggccacgagtgggagaagcacggcacctgcgcagccgacgtcttcgacgagcacggctacttccaggccgcgctgcgcctccgcgaccagctgggagtcctcggcgcgctcacctccgccggcgtcaagcccgacggcggctactacacgctgagccagatcaagggcgccatccgccagggcaccggcttcgagccctacgtggagtgcaaccgcgacgaggccggcaacagccagctctaccagctctacttctgcgtcgacgccgccggcgacagcttcgtcgactgccccgtcctccccagcggcaggccctgtggcaaccggatcgagttcccggctttctaagctaactcactcttcacgtcagttgctgcaatatactgctagtccttttgcttgcattctatgcaagaggataatggaatgttcattccccattcttcatttttttttgcaaataaaaggagggcgatcggtgttccatatttattatgttgatcataacatgacattcagagaacaaaaaaaaaaaaaaaa

SEQ ID NO: 246 - DNA, 1755 bp, Zea mays
  CDS (150)..(1496)
ggcagaggtgcgcttccccgtgagccgggcaactggtgggtgtcgtcctcctctttgcgcagcagagtaatggattaatgctttaagcaaggtaatgaaatgtaccagaagtgacttatggaaaggaaggagcttgttcactgttctgaatgaggaagtttaatctgatgcagtctcaaaagagcagagttttgggagcaatgtcatcctctttgcctattctgccaaatcctttgaaagggagcttcccaaggcctcataacccccagcatattcctatgttgaggcagcttcctgatgactctatgcccttgtgtattgacacacatcagtctgttagtttgcacccaagagctggtgttatcggggtaccatattcaggctacactgctagtccacttgattctgtgtctaaccttgatagccagacaatggctgcaccctttatttctcagtcatccaattttgaagctctccagtctctatctgataataccccagaaacacacactaaggcagcctggttcacatcttctatggatgtttcaccactcaacacagataatattgctgcttctgatgttaatcaaatccatagtatacgtcctgctatgacatctgatgagagtgctacacaaaatgattggtgggcagatataatgaatgatgattggaaagatattcttgacgcaacagctactgattcccactcaaaagccatgattcaaatttccaactcagctacatcactacctgcagtaaatcagtcagcttcatctcatagtagggagatttgtcctgttgctagtcctcccaatagcagcaatgcttcagttgccaaacaacggatgagatggaccccagaactccatgaatgttttgtagatgctgtaaatcagcttggcggtagcgaaaaagctactcctaagggtgtgctaaagcttatgaaagttgatggtttgactatatatcatgtcaaaagccacctgcagaagtaccgcacagcccgctataaaccagacctgtcagaaggtacatcggaaaaaaggacagccactgaagagctggtcctggacctgaaaacgagcatggatcttactgaagcgctgcgccttcagatggaagtccagaaacggcttcatgaacagcttgagattcagagaaaattgcagttgcggattgaagagcaaggaaagtatctgcagatgatgtttgaaaagcagagtcaatcgagcacggagaaagtccaggatccatcctcaagggatacaacagctaaaccgtcatctaatcagagccagtctacaaacaaggatagtggtgcaaccatggacccaaatggaacaggagacatcgcacggactgcagaactgggagaacgttcgtctgaactaggtgtaaaacagaaactcgtagagatcgaatctggtaccgaagtagccacaggcgacagatctaagatctaccaagagaagcggcgcaaactgcaagatagttaacatatcggttgcactattcagacatagctgttcaaaccgtttgcttggtgaaaaattggtaatctgtgtgtcgaattcgactattgatccgtaagtccattggtgagttgtaccgctcttcagttagccatatatatttataaaggatccaaaggaggaccaaaggagaacttcctggcagccgtgtttataacattagcaataagagctatccccgaagttatggggtaaaataaggtcttgaaatttagctttc

SEQ ID NO: 247 - DNA, 1929 bp, Zea mays
  CDS (55)..(1302)
ccacgcgtccggccacgcgctgcccgcagcggaggtgagacacaataatcttagatggagaggttaagcaccaaccagctctacagttctggtgttcctgtaaccgtaccaacatctctgccttgtataccagtctctctggatgagagcttcccgaggcttcccgatgcacagagtgttttgatggagagagaattgaggagcactccactaccacctcaccagacaactgttgctcctatccgtggtctgtttcactccaatactggatctgttggtcctttgtgctcacctccgtctgtaaggttctcttcacattcaaatcctgagcaataccccaaccacaattcatacaattctcaagtaccaagcactgcaagttcctcaacgctgaattatgggtcacaatatggaggctttgaaccatccataaccgatttcccaagagacattgaaccaacttggtgccccgatccagttgagagcattcttggatactctggtgatgtccctgctgggaataatttgactgggaccactgctattggagcttcagatgatcttactaagcaaactgaatggtggacagagtttatgaatgaggattggaaggacatggttgataacccgacttccacagaaactcaaccggttgggcaacctgtgcaatcatccaactcagttcaccaatcagctacccaacaaacagtttcatctcaatctgttgaaccgttggcagttgtggcaccctcacccactgctggctccaatactggcaaggcacgcatgagatggactcctgagcttcacgagcgctttgtggatgctgtcaatatacttggtggcagtgaaacaactcctaagggtgtcctgaagctaatgaaggcagacaatttgaccatttatcatgtaaaaagtcatcttcagaaatacagaacagctagatacagaccagagttatctgaaggctcttctgaaaagaaagtggcatcaaaagaagatataccatctattgacttgaaagggagttttgatctcactgaagcacttaggcttcagttggaacttcaaaagcggcttcatgaacagcttgagatacaaagaagtttgcagctaagaatcgaggaacaagggaagtgtcttcagatgatgctagagcagcagtgcatacccggggcagaaaaggcgcaggatgcttcaaccgctgcagatgaattgaggtcaccttctgagattccagaatcttctaccctcaaggaagttccagaaaacagtcaaaatggatcaaccaagcaaacaaaataagctaagggccgatgaagttgcaagcatgaaatgtgtttcatgatccgattggctgtttccaggcttaaatcaagttgtttttgtccttccgtgggaacagatgaacgctatagttaacttccttgcaaagcctggctaggtgcatgtaactaggagttagttgtatattacctaccctcacggtatcactgaatcccagtgttatgcggatgatgtagtcttcagaagacagcgcaagcacattgtcaggggtttgacttgttttgccccccattacttaggtatcaagtagcgtctcctaggcatttgattatgggctaattcaagtgtttacaataatgtttagcacctgttgtttaaaacatgtcatggtaccaaatatgacgaagatgtattgcatttatatgagagaatgagagatttgaactgctttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaagggatccaattttacttccccgggtttgcaaggtaaaagtttttttttggggcccccaaatttaaattaa

SEQ ID NO: 248 - DNA, 3805 bp, Sorghum bicolor
  CDS (238)..(3633)
cgcatccttccgcgccgggcatgggcaccgcgtcggcgcgcgcccctacccagtcgtcgacttgatgctgctcactcgcactcgtcgcagcgccccacgccccgctatttatgcgtacttgcttgccgggagagtcgctggaggtgggcgtcctcctcccgctccagagctcgctgcttcgctccacccacccttaagcaggagtgatatctggtggtttttcaaaagaagacaaaaatgtcttcctcgaggcctgcccactcttccagttcatccagtaggactcgccagagctcccaggcaaggatattagcacaaacaacccttgatgctgaactcaatgcagagtatgaagaatctggtgattcctttgattactccaagttggttgaagcacagcggagcactccatctgagcagcaagggcgatcaggaaaggtcatagcctacttgcagcatattcaaagaggaaagctaatccaaccatttggttgcttgttggcccttgacgagaagagcttcagggtcattgcattcagtgagaatgcacctgaaatgctcacaacggtcagccatgctgtgccaaacgttgatgatcccccaaagctaggaattggtaccaatgtgcgctcccttttcactgaccctggtgctacagcactgcagaaggcactaggatttgctgatgtttctttgctgaatcctatcctagttcaatgcaagacctcaggcaagccattctatgccattgttcatagggcaactggttgtctggtggttgattttgagcctgtgaagcctacagaatttcctgccactgctgctggggctttgcagtcttacaagcttgctgccaaggcaatctccaagatccagtcactgccaggtggaagcatggaggccttatgcaataccgtggttaaggaagtctttgagcttacaggttatgacagggttatggcttacaagttccatgaagatgagcatggggaggtctttgctgagatcaccaaacctggtattgaaccttatctaggcctgcactatccagccactgatatccctcaagctgccaggtttctcttcatgaagaacaaagtcagaatgatctgtgattgccgtgcaaaatctgtgaagattattgaagatgaggcactctccattgatattagcttgtgtggttcaactcttagagcaccacatagctgtcaccttcagtatatggagaacatgaactcgattgcatcccttgtcatggctgttgtggttaatgaaaatgaagaggatgatgaacctgggcccgaacaaccaccacaacagcagaagaagaagagactgtggggtctcattgtttgccaccatgaaagccccagatatgtcccgtttccactgcggtatgcctgtgaattcttggcccaagtgtttgctgtccatgtaaacaaggagtttgaattggagaagcagatacgagagaaaagcattctgcgaatgcaaacaatgctctctgacatgctgttcaaggaagcatctcccttgagtatcgtatctgggagtccaaatatcatggacctagttaagtgtgatggtgctgctcttttgtatggggacaaagtctggcggcttcaaacggctccaaccgagtctcagatacgtgatattgccttctggctttcagaagttcatggggattccactggcttgagtactgatagcctccaggatgctggatatccaggagctgcttcccttggtgacatgatttgtggaatggcagtggctaagatcacgtccaaggacattcttttctggttcaggtcacatacagctgctgaaatcaaatggggaggtgcaaagcatgatccatctgataaggatgacaacagaaggatgcaccctaggttgtcctttaaggctttccttgaggttgtcaagatgaagagtttgccatggagcgactacgagatggatgctattcactcattgcaacttattcttagaggtacactgaatgatgccttgaagccggtccaggcatctggtttagataaccagattggtgatctcaaacttgatgggcttgctgaattgcaagcagtgacaagtgaaatggttcgcctcatggaaacagcaactgttccgatcttggcagtagatggcaatggattggtcaatggatggaatcaaaaggtagcagaattgtcagggttgagagttgatgaagctataggtagacacatacttacacttgtggaggattcttctgtatcaattgttcagaggatgctatatttagctctgcagggcaaagaagagaaggaagttcgatttgagttgaaaacacatggctccaagagggatgatggccctgttatcttggttgtaaatgcttgtgccagtcgtgaccttcatgaccatgttgttggggtgtgctttgtagcccaggatatgactgttcataagttggtcatggacaaatttactcgggttgagggggactacaaggcaatcattcacaacccaaacccgctcattcctcctatatttggtgctgaccaatttggatggtgctctgagtggaatgtagccatgaccaagcttactgggtggcacagagatgaagtgatagataagatgctccttggtgaggtttttgacagtagcaatgcttcctgccttttgaagagcaaagatgattttgtacgtctttgcattatcatcaacagtgcattagccggtgaagaggcagaaaatgctccattcggtttgtttgaccgcaatgggaaatatattgaatgccttctgtcagtgaacagaaaagtaaatgcagatggtgttgtcactggagtgttctgtttcattcatgttcctagtgatgacctgcagcatgcgctacatgtgcagcaagcctctgagcagacagcacaaagaaggttgaaggctttctcgtacatgcgacatgccatcaacaaacctctctcaggtatgctttattctagggaaacactcaagagcacaggtctgaatgaagagcagatgaggcaggtccatgttgcagatagttgtcatcgccagctaaacaagatacttgccgacttagatcaagataacattactgacaagtcaagttgcttggatttggatatggctgaatttgtgttggaagatgtggtggtgtctgctgtaagtcaagtactgataggttgccagggtaaaggtatcagagttgcttgcaacctgccagagagattcatgaagcaaaaagtttacggggatggtatccgactccaacagatcctctccgacttcttatttgtttcggtgaagttctctcctgttggtggctctgttgatatctcttccaaactgactaagaacagcattggggaaaaccttcatctcatagacttcgaacttaggatcaagcaccaaggagcaggagtcccagcagaaatattgtcacaaatgtatgaggaggacaataaagagccgtcagaggagggtttgagccttcttgtttctagaaaccttctgaggctcatgaatggtaacattcgccacatcagggaagctggcatgtcaaccttcatcctcactgctgaacttgctgctgctccttcagcagttggacaatgaagccatcacatgctctctcagagttcattctgaaagccacggtggtttgcggagaatgggaaatgctgcagcgcgttgcatcaccgaatgcataagaaataagattgacttgtatggttatttgttagggggggaaagttgtactggcatagacgcatagtaagggcggccg

SEQ ID NO: 249 - DNA, 4095 bp, Oryza sativa
  CDS (67)..(3582)
gtgaggtgaggcgaggaaaaaatcggacgcacccgcctaatccggaccaatccacgcatcggcgccatggcctcgggtagccgcgccacgcccacgcgctccccctcctccgcgcggcccgcggcgccgcggcaccagcaccaccactcgcagtcctcgggcgggagcacgtcccgcgcgggagggggtggcgggggcgggggagggggagggggcggcgcggccgccgcggagtcggtgtccaaggccgtggcgcagtacaccctggacgcgcgcctccacgccgtgttcgagcagtcgggcgcgtcgggccgcagcttcgactacacgcagtcgctgcgtgcgtcccccaccccgtcctccgagcagcagatcgccgcctacctctcccgcatccagcgcggcgggcacatacagcccttcggctgcacgctcgccgtcgccgacgactcctccttccgcctcctcgcctactccgagaacaccgccgacctgctcgacctgtcgccccaccactccgtcccctcgctcgactcctccgcggtgcctccccccgtctcgctcggcgcagacgcgcgcctccttttcgctccctcgtccgccgtcctcctcgagcgcgccttcgccgcgcgcgagatctcgctgctcaacccgctctggatccactccagggtctcctctaaccctttctacgccatcctccaccgcatcgatgtcggcgtcgtcatcgacctcgagcccgcccgcaccgaggatcctgcactctccatcgctggcgcagtccagtctcagaagctcgtggtccgtgccatctcccgcctccaggcccttcccggcggtgacgtcaagctcctttgcgacaccgttgttgagcatgttagagagctcacaggttatgaccgcgttatggtgtacaggttccatgaggatgagcatggagaagtcgttgccgagagccggcgcagtaaccttgagccctacatcgggttgcattatcctgctacagatatcccacaggcatcacgcttcctgttccggcagaaccgtgtgcggatgattgctgattgccatgctgcgccggtgagggtcatccaggatcctgcactaacacagccgctgtgcttggttgggtccacgctgcgttcgccgcatggttgccatggccagtatatggcgaacatgggttccattgcatctcttgttatggcagtgatcattagtagtggtggggatgatgatcataacattgcacggggcagcatcccgtcggcgatgaagttgtgggggttggtagtatgccaccacacatctccacggtgcatccctttcccactacggtatgcatgcgagttcctcatgcaagcctttgggttgcagctcaacatggagttgcagcttgcacaccaactgtcagagaaacacattctgcggaccggaacactgctgtgtgatatgctactccgggattcaccaactggcattgtcacacaaagccccagcatcatggaccttgtgaagtgtgatggtgctgctctgtattaccatgggaagtactaccctcttggtgtcactcccacagaagttcagattaaggacatcatcgagtggttgactatgtgccatggagactccacagggctcagcacagatagccttgctgatgcaggctactctggtgctgctgacctaggagatgcagtgagcggaatggcggtagcatatatcacgccaagtgattatttgttttggttccggtcacacacagctaaggagataaagtggggtggtgcaaagcatcatccagaggataaggatgatggacaacgaatgcatccacgatcatcgttcaaggcatttcttgaagttgtgaagagtaggagcttaccatgggagaatgcagagatggatgcaatacattccttgcagctcatattgcgggactctttcagagattctgcagagggcacaagtaactcaaaagccatagtgaatggccaggttcagcttggggagctagaattacggggaatagatgagcttagctcggtagcgagggagatggttcggttgatcgagacagcaacagtacccatctttgcagtagatactgatggatgtataaatggttggaatgcaaaggttgctgagctgacaggcctctctgttgaggaagcaatgggcaaatcattggtaaatgatctcatcttcaaggaatctgaggaaacagtaaacaagctactctcacgagctttaagaggtgatgaagacaaaaatgtagagataaagttgaagacattcgggccagaacaatctaaaggaccaatattcgttattgtgaatgcttgttctacgagggattacactaaaaatattgttggtgtttgttttgttggccaagatgtcacaggacaaaaggtggtcatggataaatttatcaacatacaaggggattacaaggctatcgtacacaaccctaatcctctcatacccccaatatttgcttcagatgagaatacttgttgttcggagtggaacacagcaatggaaaaactcacaggatggtcaagaggggaagttgttggtaagcttctggtcggtgaggtctttggtaattgttgtcgactcaagggcccagatgcattaacgaaattcatgattgtcctacacaacgctataggaggacaggattgtgaaaagttccccttttcattttttgacaagaatgggaaatacgtgcaggccttattgactgcaaacacgaggagcagaatggatggtgaggccataggagccttctgtttcttgcagattgcaagtcctgaattacagcaagcctttgagattcagagacaccatgaaaagaagtgttatgcaaggatgaaggaattggcttacatttaccaggaaataaagaatcctctcaacggtatccgatttacaaactcgttattggagatgactgatctaaaggatgaccagaggcagtttcttgaaaccagcactgcttgtgagaaacagatgtccaaaattgttaaggatgctagcctccaaagtattgaggatggctctttggtgcttgagaaaggtgaattttcactaggtagtgttatgaatgctgttgtcagccaagtgatgatacagttgagagaaagagatttacaacttattcgagatatccctgatgaaattaaagaagcctcagcatatggtgaccaatatagaattcaacaagttttatgtgactttttgctaagcatggtgaggtttgctccagctgaaaatggctgggtggagatacaggtcagaccaaatataaaacaaaattctgatggaacagacacaatgcttttccccttcaggtttgcctgtcctggcgaaggccttcccccagagattgttcaagacatgtttagtaactcccgctggacaacccaagagggtattggcctaagcatatgcaggaagatcctaaaattgatgggtggcgaggtccaatatataagggagtcggagcggagtttcttccatatcgtacttgagctgccccagcctcagcaagcagcaagtagggggacaagctgatatggtgtatgctcgtcgctaacctcgcataactattcggtcaaccaggtgacctgggatcttctgatggagaacccagtttagtttatgagagttccagaaaccaacatttcgtccactctgatgaagcacatctgaactttggaacggcatcggtgattctcggtgtcgaggtggtccctccagtctcctgattcctggcatggcgactgtaagctcagctttggacgatgttgttctattagagttctatggcggcaagcaatgcacactgacggtcatgtaactcgtagcataggcccactatcacttggttgaagtacatatatgttctaaaagctgccatgtatataacatcggttatatatgtactacgtgcataaaggagagctgtgcagctcccagggtggtattttgtagggcttcccaagcctatgacatcttattatatcatcttaacataaaagcatttggtctccttggatgttggcaaaaaaaaaaaaaaaaatatat

SEQ ID NO: 250 - DNA, 8786 bp, Sorghum bicolor
  CDS (429)..(2640), (3333)..(4140), (5819)..(6112), (7491)..(7713)
  unsure (1)..(8786): unsure at all n locations
cagtgcgcttaacaaaaagctgcaaaggtgaaagtatccgcatccacatcagctttcagctggggagttcgtcgtcgtccccagcgcgagcgcaatccattccaaacctgaacccctgcggcccagcctcgatcccccacagccccagtcagtactactaccatccctatcccagccatgccatcgtcatcggcgcatcgccctgcgcgcaatatccttggctccacgcccctgcaacccacttcttattttattatcctcgtgatgatgatgagtcaataagcgcagtgaggagcggtgaagcaaagcgaagctaaccccccagtggagggggcgagcgagtcgacgagccgacggacgagcgcaagaccggccggggccggggccgcctaatccagagagagccccaggacttcttttccgccgccatggcgtcgggcagccgcgccacgcccacgcgctccccctcctccgcgcgacccgaggcgccgcgtcacgcgcaccaccaccaccaccaccactcgcagtcgtcgggcgggagcacgtcccgcgcgggcgggggaggtggaggaggaggaggtggcgggggcaccgcggccacggctacggccacggccacggagtcggtctccaaggccgtggcgcagtacaccctagacgcgcggctccacgcggtgttcgagcaatcgggcgcgtcgggccgcagcttcgactactcccagtcgctgcgcgcgccgcccacgccgtcctccgagcagcagatcgccgcctacctctcccgcatccagcgcggcggccacatccagcccttcggctgcacgctcgccgtcgccgacgactcctccttccgcctcctcgccttctccgagaacgccgccgacctgctcgacctgtcgccgcaccactccgttccctcgctcgattccgcggcgccgccccccgtttccctgggtgccgacgcgcgcctcctcttctccccctcgtccgcggtcctcctggagcgcgccttcgccgcgcgcgagatctcgctgctcaacccgctatggatccactccagggtctcttccaagccgttctacgccatcctccaccgcatcgacgtcggcgtcgtcatcgacctcgagcccgcccgcaccgaggaccccgctctctccatcgccggcgcagtccagtcccagaaactcgcggtccgtgccatctcccgcctccaggcgctacctggcggggacatcaagctcctttgcgacacagtcgtggagcatgttcgcgagctcacgggttacgaccgtgtcatggtgtacaggttccatgaagacgagcatggggaagttgtcgccgagagccggcgcgataaccttgagccttacctcggattgcattatcccgccacagatatcccccaggcatcgcgcttcctgttccggcagaaccgcgtgcggatgattgctgattgccatgccaccccggtgagagtcatacaagatcctgggatgtcgcagccactgtgtttggtaggctccacgcttcgtgctccacacgggtgccatgcgcagtacatggcgaacatggggtcaattgcatcacttgttatggcagtcatcattagcagtggtggtgatgacgagcaaacaggtcggggaggcatctcctcggcaatgaagttgtgggggttagtggtgtgtcaccatacgtcaccacggtgtatcccttttccattgaggtatgcttgcgagtttctcatgcaggcatttgggctgcagctcaacatggaattgcagcttgcgcatcagctgtcagagaagcacattttgcgaactcagacgctattgtgtgacatgctattgcgagattcaccaactggcatcgtcacgcagagccccagcatcatggaccttgtgaagtgtgatggggctgcactgtattatcatgggaagtactatccattgggtgtcactcccactgagtctcagattaaggatatcattgagtggttgacggtgtgtcatggggactcaacagggctcagcacagacagccttgctgatgcaggctaccttggtgctgctgcattaggggatgctgtgtgtggaatggcggtggcttatattacaccgagtgattacttgttttggtttcggtcacacacagctaaagagatcaaatggggtggcgcaaagcatcaccctgaggataaggatgatggtcagaggatgcacccacggtcatcattcaaggcatttcttgaagtggttaaaagcagaagcctaccatgggagaatgcagaaatggacgcgatacattccttgcaactcatattgcgtgactccttcagagatgctgcagagggcactagcaactcaaaagccattgtcaatggacaagttcagcttggggagctagaattgcgggggataaatgagcttagctctgtagcaagagagatggttcggttgatagagacagcaacagtacccatatttgcagtagatactgatggatgtataaatggttggaatgcgaaaattgctgagttgacaggcctttcagttgaggaggcaatgggcaaatctctggtaaacgatcttatcttcaaggaatctgaggagatagtcgaaaagctactctcacgagctttaagaggtattccatttttgtttcttacatggatgctattactttttatattatgttatatgagaattgcggagtgctgttgaggaaaagattatctgttcttggttgtatctcttaaggtatatataaaagaaaggtatatgccataacagaagtgtatggacatgatgtatacatgtttattagaccaaatattgaaacgtgtggtatatatactcttggaaaatggatatttgaaggagctaagcctagctcaattggtcgatggtgtggatgtacgcccaaacccagtcccccggttcaagtttgttgaggcgaatttttgcatgtttcttcttaattaaaaagctcccctatgttggtcaaggttttttaatagatatactcagtttcttagatgcacaaatatatagaaaatggggaccaactagagactaccatcaaatttactcaaccatttccacagtatttttagaatccggtgcttataactagcagataggaatgctcatatctgaaaagtaagcatatgaaacttataccaaaggttgtgttagctagtcacaggagtacattgtttctcgcccaggctgtttgaactattttaatctacttcccaatgcatgtagctaagctatgttagctttgatggatgtgcgattggagagtgctaatttgtaaagttgcttcccatacaggtgaggaagacaaaaatgtggagataaagttgaagacatttgggtcagagcaatctaacggagcaatatttgttattgtcaatgcttgttccagtagagattacacacaaaatattgttggtgtctgttttgttggacaagatgtcacaggacaaaaggtggtcatggataaatttatcaacatacaaggggactataaagctattgtacacaatcctaatcctctgatacccccaatttttgcatcagatgagaacacttcttgttcagaatggaacacagccatggaaaaacttacaggatggtcgagaggtgaagttgttggtaaatttcttattggagaggtgtttggaagtttttgtcgactcaagggcccagatgcattgacaaagttcatggttgtcattcacaatgctataggagggcaggattatgagaagttccctttttcatttttcgacaagaatggaaagtatgtgcaggccttattgaccgccaacacaaggagcaaaatggatggtaaatccattggcgccttttgttttttgcagattgcaagcgctgaaatacagcaagcctttgagattcagagacaacaagaaaagaagtgttatgcaaggatgaaagaattggcctatatttgccaggagataaagaatcctcttagtggcatccgatttaccaactctctattgcaaatgactgatttaaatgatgatcagaggcagttccttgaaacttgctctgcttgtgaggaacagatgtccaagattgttaaggacgccactctccaaagtattgaggacgggtcagtactaagtttaccccttctgctcacccattctctaatatttgcattgaatatttacatttgatcattcatattcgtttaacttgagcctggagtagccttgatctaaattttaattggcgctaatcttgactggtagaggtacaaaatcggagtaggaattagagaagttcatcagtcattagactatcacagtttgttctactgtctttgcagttctttaatattttcccttgcacctaagttattgccaacattagacgtagatccttgttttttgtaccaccctttaagacacctttgttgaagggcgggcctggtgcaggcggtagagtactaccgactgtgaccagatcaccagaaggtcctgggttcgagccgcaccctccttgcatttgcacattgcaagggtaaggcttgccgctgatacccttccccagaccccgcacagtgcgggatgctctcagcactgggtacgcccttcctttaagacacctttgttattatcccttatggcacttctgtggactgcttctctctcagccaatatctgaaactgtgtaagatcagcaacatttgccaacatatattgttgcaaatgtgaaggcagtccagattgctgtacttcaaaagatgcattggtgttttagaagcttcagcatatcctactgtagtactgtgcttaaaaatactcctatgcgtttggaacctctttttatttgaaacaaagtaccataccatcatactgtacagtaactggcatgcgtctggctgattatgtacattgttatggttgtaattatctaatggttgacgatatggctactaaaccagaaccaagccagatttgatggttttcacagtttccagtggaacttggtgaatctggtgtctttttctccatttttttcaaggatagcatgaatactacacaagtacatacaataactactgtatatactgaatatgtcaaattatgttaaaaaagtcaacttctgtaaaaacaaaaaaagtgcatagtgggggttttctgcttaccaatgttagcatacttattactaccaggattgtgaaactttgtgcttcaaatgctatatcatggatttttgttagaattaaaggaatagccttgtgaactgataaccttaccacattttagaggggtgtcaccaaagttcaagcagctttgtctaacatgcctctgcctgtagttttgtttgaggagcttcataaattatttggagatgctgtatttcatttgcttgcacggaaactcaaatcccttctggttgatttttatacacttggtcaggtccatctgtcttgctattggtaatgaattcccagaaagtgacttaaggcatgttcaagatattagttgcttctcatttggcaaagtctaaacacaaacttaccaagatatcacttggaatagctacttacacaatcctatattattactgtcacattatttgcttgacctcattatctaaagaaggtatttgcttgacctaattttcatttaggttcattggtccagtgtttagactgtagacagtagtgttttctcacttctttgtaacctaagacataagtttgaatgctgctgttatttgccttatttccacgattgattaactgaaaatttgttgaattgtttctctttatgtaacagctctttggtacttgagaaaagtgagttttcttttggagacgttatgaatgctgttgtcagccaagcaatgttattgttgagggagagggatttacaacttattcgggatatccctgatgaaatcaaggatgcatcagcatatggtgatcaatttagaattcaacaagttttggctgacttcttgctaagcatggtgcgatctgctccgtccgagaatggctgggtagaaatacaagtcagaccaaatgtaaaacagaattctgacggaacagatacagagcttttcatcttcaggttagctgcttgctctttgattataattcgtcacaaaatgtttttttttgtttcttcaaggaatatttgttgatgaattttggttgaagacaagtaacatgaattacttcaacctttggctggttggccgcatatgtggtgtgatacctttcaaatatacaacaacaaagccttttagtcccaagcaagttggggtaggctaatacctttcaaatatacatccgtgagaatttcgagagaattatcctgtttgcgtcatgctatatttttcgttttcttctgtcgacttaatttctttaacttaggccttgtttagttacacccaaaaaccaaaaacttttcaagattccccatcacatcgaatcttgtggcacatgcatggagcattaaacatagataaaaataataactaattacataatttgcttgtaatttgcgagacaaatcttttgagcctagttaatccataattggacattaattaccaaatacaaacaaaatgctacagtaccccaaaaatttcaccccaacaactaaacaaggccttagtgtactgtttggctgtgggatttgatggtaacataaacagtatcagaaggcaacagtaatggaaaatagagaaacgaatactgacattatttggttgagctcacacattggatttatactgcagcttatacaaagtcgttacagctcctgattgaactgggttcaagtgtgtaacctacctccgtcccactaatatatattttaaattgctctcatatgatgtaccaactaatagatatcacctttttttttggttccaaaccaatttttaaattagcataggcaaatacaaatccggacctatttgattagtactttaggatgtccgttacatacccaaactgctgcctgccatagagcattggtgagagaaactgagaattgacgaccttacctattgaagttcaaaactgtcctgtaatggtgccatggactgtaaatctgtaatcatctggatcttttagatgaattttactattttagtgtgctggcctaacttgagcaaaagtgattttcttttctgcaactcatattatttcaacaacctacattttttttaaaaaaaagagagaggaaaagacctctgcttttaagaaagcaacatcattcagtacaatactgggaacaaccagtttaacaagaaaagttcaaaagtcgacgttaaagcctattacagacaacaacctacatttgttgcattgtgcattaggtgattctggagaatcagcttccaaatgctaacaacggaaaactcaatgcctctattgggacttgagagtaccaataaatggaactaagtgatttccttttgatttttgtatgtccgtaggtttacctaccctggtgagggccttcccgctgacattgtccaggatatgttcagcaattcccagtggtcaacccaagaaggcgtaggactaagcacatgcaggaagatcctcaaattgatgggcggtgaggtccaatacatcagggagtcagagcggagtttcttcctcatcgtcctcgagctgccccagcctcgtccagcagctgatagagaaatcagttgatatatgttaagatctgcactgaccccacctaacttctcggtcgattaggtaacttaggtccctgataagagggtgcctaatttacaagaagcctggaaacaaatcaaagctgccatggcaattcagtgattgaatgttgttgaggatgttttcggtgcgccgcttaagtttgagtatccatgctgtggtttcaagatcagaatccatggcgggtggttatgtacaaatgcggcaaatgtggttcttagtgtaggttcatgaccagttccacgtagtacatatagcttatatgtatatataaatctgttctgtactatgcataaggagttgtttcagctcccacggttgtattttgcaggcctttctaggtctactgcaccctaatctagatttggttcctcgcttgaaaatcgccatcttagagcaagtattatagcaagctgtaagctagctaaatgctaaggtggagaagaaagagtaaaagcgggttgtaagcttagagcaagtattatggtgggctgtaagctggctaaatgctgaggtggaggagagaagtgatgagagagtgtagaaggactgtaaactttcttacagtcagcttaggcacaagaaccaagaaactttgtgagagagataagtgggccatgtattaatagtgaagagctaattattgtatggtgggctgggagaaagctgaaatgggctatattattaaacttgctcttatagccggtttagacacaaaaatcaagaaagtctgtgagacagatatatgagtcatgtattaatagtgatgagttaaccattatatgagtgggctgtaaaaagactataaagaaatcttactctgtattataatacttnacatcctgtcgatcccttgtgtgtgggcatgggaactacccggtggcgaattttctcacgtcccgtgatccttgtggatcgccggccggcatgggaactactggtacgatcatccccgtcttcctcacgtcctggtcctcatcaccggtggctatggggtgtgacagttggtggaggcgttggcgatgctcgacccccacctgcccggc

SEQ ID NO: 251 - DNA, 6755 bp, Oryza sativa
  CDS (1036)..(3100), (3205)..(4021), (4418)..(4711), (5272)..(5509)
cgagtcaatactacagaccgccaggtcgacaacagttagataggctaccctaaatattgtactggtatgattatggtgaataagagcaataccggcttcggccaacaggatgtagggttattacctgacaattcaggggcccgaacttgtataaaaatcctcgtcgtcatctcttttacctaagtctcacatatatcttagtaccaacgatccccatgttatgcaaataccggaaccgcgacatcaaacgtcgaccgacaacgtggtacagtataaaaaagtttttaaatatttttaggtctgatcaaaccatcgaatccaatcaatacagggcctactctaccaaagttctggcctttgggaagcatttccccattttttttagcacttaccacgagtggaaaaggacggacttctgcgcgaggaagaagaaccggatgacgttgtacggctttcctctctcggtttcccgacgcgaccgcctctgccgccatcgccgcctctcctcacctcgccgcgccgcgccgccccgcctcggccgcgcgcgtcccctcttccccgcctaagccccgcatcccgctcacccaccccacgcaccaacccccgcctcgcctcgccgtcgtcgtcgccgtcgccccctcgcctcgccgcctctgcgtggtggtgaggtagtaatcgctgttgcttcggtttccctttggttgggaggtgggaggaggaagacgaagagagggagagagagagggagatattatcttgggctgccttgccgtgcagtgtggctcgctgtcccactcaggtgcggcgctattccaatccgtgcttatccccggcagaatccaatccccctcgcggcttttctccaaaagcgctccgccttctcgcctatttcgctcgctgccgcggccatgattccccgctgatacctccgcgcgcgtcctcctcgccgaatcccccttcgcagccggtggttctagttgaggaggaggaggaggggatttggttgggggcgagggggaggagggggttgtggagatgtcgtcgtcgcggtcgaacaaccgggcgacgtgctcgcggagcagctcggcgcggtccaagcacagcgcgcgggtggtggcgcagacgccgatggacgcgcagctgcacgcggagttcgaggggtcgcagcgccacttcgactactcgtcgtcggtgggcgcggccaatcggtcgggcgccaccaccagcaacgtctccgcctacctccagaacatgcagcgcggccgcttcgtccagcccttcgggtgcctgctcgccgtccacccggagacgttcgcgctgctcgcctacagcgagaacgccgccgagatgctcgacctcacgccgcacgccgtgcccaccattgaccagcgcgaggcgctcgccgtcggcaccgacgtgcgcacgctcttccgctcgcacagcttcgtcgcgctgcagaaggccgccaccttcggggacgtcaacctgctcaaccccatcctcgtccacgccaggacctccgggaagcccttctacgccatcatgcaccgcatcgacgtcggcctcgtcatcgacctcgagccggtcaaccccgtcgacctgcccgtcaccgccacaggcgcgatcaagtcgtacaagctcgctgccagggccatcgccaggctgcagtccctgcccagtgggaacctctccctgctgtgcgacgtgctggtccgcgaggtgagcgagctcactggctatgacagggtgatggcgtacaagttccatgaggatgagcatggtgaggtgattgctgagtgcaagagatctgatttggagccgtatcttggcctgcactacccagccactgacattcctcaggcatccaggtttttgttcatgaagaacaaagtgcggatgatatgcgattgctccgcaacgcctgtgaagatcatccaagatgacagcctaacacaacctataagcatatgcggatctactctcagggcaccccatggttgccatgcacagtacatggcaagcatgggctccgttgcatcacttgtgatgtcggtcactataaatgaggatgaggatgatgatggagacactgggagtgaccagcagccgaaagggaggaagctgtgggggttgatggtctgccatcacacaagcccgaggttcgtccctttcccgcttaggtatgcttgcgagtttctcttgcaagtatttgggatacagatcaacaaggaggtggaactggctgctcaggcaaaggagaggcacatcctccgcacgcagactcttctctgtgatatgctccttcgagatgctcctgttgggatatttacccaatcacctaacgtaatggatctagtgaaatgtgatggtgcagcattgtattaccaaaaccagctttgggtgctaggatcaacgccctctgaagcagagataaaaaacattgttgcttggttgcaggagtaccatgacggttctactggattgagtaccgacagcttagttgaagcaggttatcctggcgctgctgcacttggtgatgttgtgtgtggcatggcagctataaagatctcttcaaaagatttcatcttctggttccgatcccacacggcaaaggagattaaatggggaggagctaagcatgaaccaattgatgcagatgacaatggtaggaagatgcatccacgatcttcattcaaagccttcttggaggtagttaaatggaggagtgttccttgggaggatgttgaaatggatgctatccattctctgcagctaatattacgtggctccttgcaagatgaagatgccaacaagaacaacaatgcaaagtccattgttacagctccatctgatgatatgaagaagattcaggggctccttgaactgagaaccgttacaaacgagatggtgcgcctaattgagacagcaactgcgcctatcttggctgttgacatcactgggagcataaacggatggaataataaggctgcagaactcactggattacctgtcatggaagccatagggaagcctctggtcgatctcgtcatcgatgattctgttgaagtggttaagcaaattttaaattcagctttacaaggttggctctatgttgaacttggcctttttgtaccatccaacttaatcataatgtgtccattattttttgggtgactaacttaggtcttctttcttgtatttcaggaatagaagagcaaaatctgcaaattaagcttaaaacatttaatcaccaggaaaataatggacctgtaattttgatggttaacgcctgctgcagtcgtgacctttcagagaaagttgtgggggtttgctttgtagcacaagatatgacagggcagaacattatcatggataagtacactcggatacaaggggactatgttgctatagtaaagaacccttcggagctcatcccccctatatttatgatcaatgatcttggttcctgcttagagtggaatgaagctatgcaaaaaattactggtataaagagggaagatgcagtagataaattgctaatcggggaagttttcacccaccatgagtatggctgtagggtgaaagaccatggtactctgaccaaacttagcatattaatgaacacagtgatatctggtcaagatcctgagaagcttctttttggtttcttcaacaccgatggcaagtacatagagtcactgatgacagcaaccaagaggacagatgctgagggtaagatcactggcgccctttgctttcttcatgtggccagcccagagcttcaacatgctctgcaggtgcagaagatgtctgaacaagctgctatgaacagctttaaggaactgacatacatacgtcaagaattaaggaacccactcaatggcatgcaatttactcgtaatttgttggaaccttctgacttgactgaggagcagaggaaacttctagcatcaaatgtcctctgtcaagaacagctgaaaaagattttacatgacactgatctagaaagcattgaacagtggtgagtgccgtttgttccactgtagtctgacatatagatatttgccaacttttattctgagcccttccattgttcttgaaatcacgctttaatgatttttaaccatagcaaatttagatggtcttgcaggttcagaactgaaatcaccactgtttcatgccttttctccaattatatagtctatatgtagaacaacatgatatgtaaaaaaggaaactttctatttagtggttggaattaacctatacacggaaaattccattggtaccataacagttccagcactacaaaataagttcatataaagctgtataatatgcctattccatttgcttttttcacgcacaagaagatctgatagaatacgtattggttactaactctgtgctcccacagctacacggagatgagcaccgtagatttcaacctggaggaagccctgaatacagtcctaatgcaagccatgccccagagcaaggagaaacaaatttccattgaccgtgattggcctgcagaagtatcatgtatgcacctctgcggggacaatttaaggcttcaacaagtcctagcagacttcctggcatgcacgcttcaatttacacagccagctgaagggcctattgtgctccaagtcatccccaggatggaaaatattggatctggaatgcagattgctcatctagagttcaggtaagccacccatttgccttgtggaacttatagtgatgtttcttgaactgcgagtacagctttactggtaatagaaccaacttaaactttgcatgcaatgacctaatttccattactccaactcaacttctctggggagaaatctgtttgttaacatgcgttcagtaagtactagaggcgcactattgagttctagacacctttattcctgcagcttgtgtttactgtccatcttatcaatagaggcaggacactcagtagtcacataaaaactgacggttcaaaatagcccttccatattatctcaacataaacatagcataaacataaaatgcaatatcgtaacatctgagtaatgactatataaccaattcaatgatgcaacccttacaactatttaagataacggataacccggccgacaacccttacaactgtggagtaaaaggagattgattagatgatgcgaagctttagattgttcgacgagcttgctggggcacaaccccacttaacagaagcgtaatcttaacatctgcccaacggttggctccatgcaggcttgtccatccagctccgggcgttccagaggctctgatacaagagatgttccgccacagcccaggtgcatctcgagagggccttggcctttacataagccagaagctcgtgaagacgatgagcggcacggttcagtacctccgggaagcagagagctcgtcgttcatcgtcctggtagagttcccggtcgcccagctcagcaccaagaggtgcaaggcttccacgagtaaattctgaacttagggctatggccaaaattcttgtgggtgctgtattgttgttgttgctgctgctgctattagcagatcaggcagtctgaggagtacgttagctgaagatgtatcagatgtgtgtagcttgtgaaagtgaaggtagtggttggatagatgtattggtcacgttgatgtctggagagctagtgagcgagctactaggtgttagtgtaatttaaccggcaaatgtatgaacgaattatgaataaaatcttcacttgtgttgtcatgaataaaatcttcacttgtgctgtcattatttccgaaattattcatcaaattcgaaaaaaaaagaagtgaactatttatatattttatcggacaaatacacaaaaatcttagaattatatcgagttgtgtgtgaattagattgcgaataggcccttggtaaaaatgaaaaaaaatatggggggtttcagtttttacaagcccatttggtcaatactgggctagccgttgttggcccgaccgccggaggctcactcgcagcggtcgatcatggcggggagggagaagaggcggcgggtggcggcgctcgacggcgaagagcggcggcggcggcaggaggaagcggcgaccctcctccacaggatcagaggtgcactccccctccctctcgtgatcaatcgcctaaaaaacttctgaatccttcatcaaccgaagtaaacacgcgtccctcgttttttgcgcagggttggtgcgctgggtcgtcgccgaggtcgccgccggccgctccccgtccgtcgcgctccaccgctaccagaactactgctcctccgcctccgccgccgccgcgtccccatggtcggtttccgcgtctcgccctaccctaccatctcatcggccgtttcaaattctcaccccgctgtatgcgcttgcagcgcctgcagctacgacgtccccgtgggcacagatgtactctcgctcctccaccggggctcccacgcctcccggctcagtacgcgtcgttgatttttgtctcaacctgcgtatctacgatcatgttaatgttaatcagtttgggatgttttaatcgatgtgcagatgtgctcctcagggttcttctcgtcgtgcagcaactcctgcagcagaacaagcactgctccaagagggacatctactacatgtacccctccatattccaaggtctgcataggttccatgcctccgcttctgcttttgtttcctgctgtgtgtgacaattggaattc

SEQ ID NO: 252 - DNA, 3755 bp, Sorghum bicolor
  CDS (303)..(3710)
ctgccccgcgcaagccggctcgctgtcccactcgcgcgccacgcctgacgcctcggacccggaggtgtattccctcttcttcccccgtgcttatccgcggcggaatccaatcccctccctcatcacgtccttctcccaggcaaagcccctctttttgggcgtatgcccccgctggcgcgcctatgattcccgccgattcatccgcccgctcggtccagcaacccttgctgctgcagtgctgcggctagttcggtggcggggaaggaggaggaggagggatcttgcagtggggcgaagcggagatgtcgtcgccgttgaacaaccgggggacgtgctcccggagcagctctgcgcggtccaggcacagcgcgcgggtggtggcgcagacgcccgtggacgcgcagctgcacgccgagttcgagagctcccagcgcaacttcgactactcctcgtcggtgagcgccgccatccgaccgtcggtcagcaccagcaccgtctccacctaccaccagaccatgcagcggggcctctacatccagcccttcggctgcctgctcgccgtccacccggacaccttcacgttgctcgcctacagcgagaacgcgccggagatgctcgacctcacgccacacgcggtccccaccatcgaccagcgggacgcgctcgccgtcggcgccgacgtgcgcacgctcttccgctcgcagagctccgtcgcgctgcacaaggccgccaccttcggggaggtcaacctgctcaaccccatcctcgtgcatgccaggacgtcggggaagcccttctacgccatattgcaccggatcgacgtcggccttgtcatcgaccttgagccggtcaacccagttgacgtgccagtcactgctgcgggtgcgcttaagtcgtacaagctcgccgccaaggccatctccaggctgcagtcgctgcccagcgggaacctgtcgctgctgtgcgatgtgcttgtccgtgaggtgagcgagctcacgggctatgaccgggtcatggcgtacaagttccatgaggatgagcatggtgaggtcatttccgagtgcaggaggtctgatctggagccgtatcttggcctgcactacccagccaccgacatcccgcaggcgtccaggttcttgtttatgaagaacaaagtgaggatgatatgtgattgctctgccactctggtgaagatcattcaggatgatagcctagcacagcctctcagcctctgtggttccaccctcagggcttcccatggttgccatgcacagtacatggcaaacatgggttctgttgcatcgcttgtgatgtcagtgactataagcaatgatgaggaggaagatgttgataccgggagtgaccaacaaccgaaaggcaggaaactgtgggggctggtcgtctgccatcatacaagcccgaggttcgtccctttcccactaaggtacgcttgcgagtttctcttgcaagtatttggcatacagctaaacaaggaggtggaattggctgctcaggcaaaggagaggcacatcctcagaacgcaaacccttctttgggatatgctcctgcgggatgctcctgttgggatatttacccagtcacctaatgtgatggatctagtaaagtgcgatggagttgcattgtattaccagaaccagcttttgttgctcggatcaacaccctccgagtcagagataaagagcattgccacatggctgcaggagaaccatgatggttcaactgggctgagtactgacagcttagtggaagcaggttatcctggtgctgctgcacttcgtgaagttgtgtgtggcatggcggctataaagatctcttccaaagattttatcttctggttccgatcgcacacaacaaaggagatcaagtggggtggggctaagcatgaaccggttgacgcagatgacaatggcaggaagatgcatccacgatcttcattcaaggccttcttggaggtggttaaatggagaagtgttccctgggaggatgttgaaatggatgctattcattctttgcagttaatattacgtggctccctgcaagatgaagatgccaacagaaacaatgtaaggtccattgtaaaagctccacctgatgatacgaagaagatacaggggctacttgaactaagaacagttacaaacgagatggtccgcttaattgagacagcaaccgcccctgtcttggctgtcgacattgccggtaacataaatggatggaacaataaagctgcagaactaacagggttacctgtaatggaagccatagggaggcctctgatagatcttgttgttgttgattctattgaagtggttaagcggattttggactcagctttacaaggaattgaagagcaaaatctggaaatcaagcttaaagcattccatgaacaggaatgcaatggtccaataatcttgatggttaactcctgctgtagtcgggacctttcagagaaagtcattggagtttgctttgtaggacaagatttgaccacgcagaagatgattatggataagtatactaggatacaaggagactatgttgccatagtaaagaaccccagtgagctcatccctcccatatttatgatcaatgatcttggttcctgcttagagtggaataaagctatgcagaagattaccggtatacagagggaagatgtgatagataagttgttaattggggaggtcttcacccttcatgattatggctgtagggtgaaagatcatgctactctaacgaaacttagcatactgatgaatgcagtgatttctggtcaggatcctgagaagctcctttttggtttcttcgacacagatgggaagtatattgaatccttgctgacagtgaacaagagaataaatgctgagggtaagatcactggcgctatttgctttctgcatgtggccagtccagagcttcagcatgctctccaggtgcagaaaatgtctgaacaagctgccacaaacagttttaaggaattaacttacattcatcaagaattaaggaacccactcaatggcatgcaatttacttgcaacttattggagccttccgaattgacagaggagcagaggaaacttctttcatctaatattctctgtcaggaccagctgaaaaagattttacatgacactgatcttgaaagcattgaacagtgctatatggagatgaacacagtagagttcaaccttgaggaagctcttaatacggtcctaatgcaaggcattcctttgggcaaggaaaagcgaatttctattgaacgtgattggccggtggaaatatcacgcatgtacctttacggggacaatttaaggcttcagcaggtcctagcagactatctggcatgcgcccttcaattcacacaaccagctgaaggacctatcgtgctccaggtcattcccaagaaggaaaacattgggtctggcatgcagattgctcatttggagttcaggattgtccatccagctccaggcgtccccgaggccctgatacaggagatgttccggcacaacccagaggtgtccagggagggcctcggcctgtacatatgccagaagctggtgaaaacgatgagtggcacggtacagtacctacgagaagccgatacctcatcgttcatcatcctgatagagttcccagtcgcccagctcagcagcaagcggtccaagccttcgacgagtaaattctgacactcatgctcctggaactgcagtgagagttcgggcggccgcgaa

SEQ ID NO: 253 - DNA, 953 bp, Oryza sativa
  CDS (35)..(676)
ttctctccccctgttcacaccacgcctcactcccatggcgaccgaggaggacgcgtcgaccatggcggcggccgaggcggaccccaagcccgccgccaccccgtcttacccggagatgatactggcggcgatcgaggcgctggacgacaggaacgggtcgaacaagacggcgatctcgcagcacatcgaggggaagtacgaggggctcctcccccccgcgcacccgtcgctcctcacagcgcacctcgcccgcatgaagcagaccggcgagctcgccttctccaagaacaactacttccgcggcgacgacccgtccctcccgcccaagcgcggccgcggcaggccgcccaagcccaaggacgccgccgccgccgccgctgcaccggcgcccgcgcccgcggcgccggcggcctcctcgccgcgcccccgtggccgcccgcctaagcccaaggaccccctcgccgaggcggtcgcgaaggccaccagtggcatgccccgcgcgcgcggccgcccgcccaagaaggccaaggtcgaacaggaagaccccattggcgctcccgccgcagcttcggctcccgccgcggcggctgaggccgcgccgcctgtcaagcgcggccgtgggcgcccgcccaaggtgagacccgccgcgccggtcggggagccagccgctgcttgattagctccgattctccgcatcgccgcgatggcgacgatggtaagctcctttaggttgtaacgtagtcttcagattatgtctcgtactgattggaggcgcggctcgggttgctgcttattgtaagttaatcggatggtgggaggtttaggtgtgctggatggatcatccgttgctgagagttgtgattgaattcgtgttatcgcgtgctgattattatggtaatgttggtgactttcgtgtcgtttgtgttaattctagattggtggctgcatttagt

SEQ ID NO: 254 - DNA, 2957 bp, Oryza sativa
  CDS (58)..(2271)
agctggtgggcgttcagggcggagaagtagaggcggcggtgccgtggggcggcgcccatgcagcagcaccagggtggcgggtcccagtacggggccgtgccgccggacatggggccgttctcgccgacgcatcatgcttcggcgccggcccccctgccgctgagcacggccaccgccgcggcgttgtctcagccaccgccgccgcagcagcagcagcagcaaccgaggacgagctacgacgagctggccgccgcgaccagcgccggcgcgggcggcttccccgacgacgacatgctgggcgacgccggcggcagcggcggcggcggtgggtcgggagcggccggcaaccggtggccgcgggaggagactctagccctcatcaggatccggtcggagatggacgccaccttccgcgacgccaccctcaagggtcccctctgggaggaggtctccaggaagctcgcggagttgggctacaagagaagcgccaagaagtgcaaggagaagtttgagaacgtccacaagtactacaagcgcaccaaggaagggcgcgccgggaggcaggacggcaagagctaccgcttcttcactgagctggaggcgttgcatgccgctgcgccgcagacgccccagccgcagcagcagcagcagcagcagttgccgccggttacaagcagcgcacccgcgatgcacgccttcgcgccgccggttcccgcgccaccgccgatgagcgcaatgccaccgccgccggggccgatccagccggccccgatatcttctgcggctcccgcggtgcccctggagctgccgccgcagccgcccatcaacctgcaaggcttaagcttctcgtccatgtcggggtccgagtcggacgatgagtctgaagacgacgagatgacggcggagaccggcggcagccaggaccgcctcggcaagcgcaagcaggccccggcggcaaaaggctggcgactttcttcgaggggctcatcaagcaagtcgtcgacaggcaggaggagatgcagcggcggtttctggagactatggagaagcgagaggcggacgcacggccgggaggaggcgtggcgcaggcaggaggtggcccgcctcaaccgcgagcaggagcagctcgcccaggagcgcgccgcggcggcctcccgcgacgccgccatcatctccttcctccaacgcatcggcggtcagtccgtacaggtcccacccgccgccaccgtcatccagatgcccacaccggtgcagctccagacccctccgccggtcaagcaacctgccaggcagcaccagccacagccaacgccgccgccgccgcaggcggcgccaatcccggccgcgcccctccagcagcaaccgccgcagccgcagcacaaggagacgattcaccacgaggcagtgacgccgcgcagggcgccaccgacgtccggctcatcactcgagctggtgcccgcggcggagcagcacgtcgagagcgggctaggaggaggggagggcgggtcggcgtcgtcgtcgcggtggcccaagacggaggtgcaggcactcatacagctgcgcatggagctcgatatgcgctaccaggagaccgggccgaagggcccgctctgggaggagatctcgtcggggatgcggcggctggggtacaaccggagctcgaagcggtgcaaggagaagtgggagaacatcaacaagtacttcaagaaggtgaaggagagcaacaagaagcggcccgaggactccaagacatgcccgtacttccaccagctcgacgtcatctaccgcaggaagcacctcaccggcggtggcggcggcggcgcttccgcggccaatgtcgccgccacggcaatcgagcaccagaacccgaaccggcacgagatagaggggaagaacataaacgacaacgacaagaggaagaacggcggaggcggcggcgcgcaggtgcccaccagcaatggcgacacggcaccgaccacggccacgttcgacgtcgatagcggcatgaagaagccagaagacattgtgagggagctgagcgagcagccgccccgggagttcacaacggacgagaccgacagtgacgacatgggcgatgactacaccgacgacggcgaggaaggcgaggacgacggcaaaatgcagtacaggatacagttccagaggccgaacccgggcggcgccaacaccgcacctccgccggcgacaaccccggcgtccgcggtgccaacctcgactccgacgagcaccttcctcgccatggttcaataggcgcgcgaacgatgcatcaccaagtacgtacttgttcaaagaaaaaaaatcaaagcatcgccatcaccatcgcatcctctcactacaccaccaccaacacaaacaccatgcatgcatcagcaatcagcaaccactctccttcgagttgggatctctcctgtaatgcatgtgcggtaagtgccaatgacatgtgggcccggaataggtgggacccacatgccagtgacaccagtacagcagtggatttgcatccctctccttcaccttgtaattctcccgtgccattccattatttattgatttctctgtgtaataagagccctccctgatctcaccttaacccgaggaagcagagggggtggtagagaaaatgagtccgggtaactttatctctataggtcacctcgtcgtggtaaaggaagaattgtacatcgatgtaacagtccctgatgtctctgttttttttttctctctctctttttctccttcctccggcgacggcggtatacaagttgtatacgggtatacaacaattacatacatttccagcaatttggagcagaggtcagaaggtgtcttgtttttgtttcttttctttctttgccgtggggaattttgtctccttttaacccgttttttttgcagtggtataaaacgttgttactgtgcaaaaaaaaaaaaaaaaa

SEQ ID NO: 255 - DNA, 995 bp, Synechocystis PCC6803
  CDS (9)..(992)
aaggtactatgtctgaaaattttgcagttgctacgccggtgcgggtcggaattgtcggtactggttatgcggcccaacgtcgggcggaagttttccggggcgatcgccgtagtcaattggttagtttttggggcaatagtgaagccaatacagctaaatttgccgatacttttggagttagaccccagcaatcttggcaggcattaattaatgatccagagatagatttagtgctcattgccaccattaaccaactccatggggcgatcgccgaggcggcattgcaagccggtaaacatgtggtgttggaatatcctttagcgttaacctatgccatgggcaaaaaactacaacagttagcccgggaaaaaggtaaattactgcatgtggaacatattgaactattggggggagtacaccaagccattcgccagaacctaggcaaaattggtgaggttttttacgcccgctatagcaccatcatgggacaaaatcccgctccccaacgttggacctatcaccatcagcaatttggctttcctttagtggcggccttgtcccgcatcagtcggtttacggatttattcggtacagtacagcaggtggatgcccaatgtcgtttttgggatcagcctaatccggaatattttcgggcttgtttagccaccgcctatctccagtttaataatggtcttaaagcggaggttatctatggcaaaggggaagtttttcaccagaatgaacggatttttaccctccatggcgatcgaggcaccttaatttttgtcggggaaacaggtaggttaattcagggacaaacggaaactgaaattaccgttggtagtcgtcgaggactgttcagacaagacacggaagcagtgttggattatctaaccactggtaagcccctttatgtggatttagaagctagtttatatgctttagaagtggcggatctctgtgcccaagcttgtggatataaggttgaaaattag

SEQ ID NO: 256 - DNA, 9979 bp, Oryza sativa
  CDS (4626)..(6690), (6913)..(7729), (8011)..(8307), (8410)..(8617)
gaattcccacaggagctaggatcagatcacgcgatgaattgtgcctgatcccagtcttcaaaagcggaaaagaaaaaaagaaaagccaaaccccgttgcgagccgaaagcatccgagagccccagacgcgggggcatgggcgttcacgtgcgggtcacatggccatgtccgcaagtggaaagccccaaataccaaacccctaggagggccacgggtgcactgtcacccaaaagtagtaagaaattcttttgcagctaacgaaaaaggaagtcgaaaaagaaccaaagcccaaagagcaagtgcaactccaactcttggccactgctccctcgctctacttaattaaaccccaattagatgatggtgataatgatggcactaacgctaatctcgatctataatctagtaatctctactaaccccgagctgttcgtccaatagagtatcatggccactggtgtacagctgcgtactattactaaatttgtaagtttgttgggagtttttctatgcgttcttctgtcccaatcagcttacggattgtgcttaaagaagggaggagtactagtttactacgcaggctattgggttaagcaggacaggttaaacagttttgctaagtcacttttttctattacgtgattacatttttttaggagctattaagtgattattactaggactgagttcggtagacccgctgagttagcttggattttggacgtcatgcgaaaaaaacatattagtgcataattaatcgattattattataaacttggaaaaaatatatttattttttaaaaaatcacatgaaatacgctatttaattgttcaggaaacgtgattaaaaaagaagaaagataccgtttaccgaactcagcctaactctctcttgtatgtactccatgtttcatatctctttctcattaacttttctatttatgtgtggaagttacactagcaatttttccaaggattttaagtacataagcaagtactgaagtttcgtaagatttaaaaatcaggctataaatatttaaaatttatattacactacatataattcatagtgtaaatatatacagaaattttggtgtcctttaataaaaacacggtcataaatataacggccaatttatttggtcttattgttaaaaaatccacgaagtaaaaaaaatcatcttattgatacatttattatcacgtaagatggtattttacacctcacgtatccatcttgcaatggtattttctaaattttatttttcctaatacaaacttattagtatattttgagattgaacacgtcatctactacttaaaaaagtaattagggtgtgtttggataatgaaaaatagggggtgggattgggattagtaaatgaacgaagggttaggattaaatgaaagagagagaatgaatgattaagatttaaatatatcttttggtgggtgggaaatcatttccctatcccattagccaaacattgctttagtcataggtgaatagatcccactacaagaaactcaatcagttgatctacgtttattttacatgttttctaaattttgctcttcgtattatatatatatatatatatatatatatatatatatatatatatccccctaggttaattattggcggtaattaactccaggttggcgtcgaggtaaatccgcgacacctcacctccccacggcgaccccatccgcgccggccggtgatcggggtgatgggggaaggatggggccggtgcgtgcgtgcgatgcgacgcgagccccggcctaagcacagcacagctgactagctgagcccccacaccatcacaggctaggctatttatttattcagctcgccactgccacccgagtgcggctgccttggctttgtctcgtcccgtctcgtctgcctcctcctcttcttcccgcacagtccacacgtccgccactactggagcagagctgagctgagccgagcaggtaccccggtcgatccctcctcttcccccatctttgctgctcttcgcttgtatggttggatgctgccttagctagcatcatctgctgcttgttcgtttcttggagaggaacgggctgtgctgccctgtagtgtggtgttctctttctctgatgattttgggggggacaagagatgtggtgagagatgtttgggagttggggactggagggtcctcttgtttagttcgtattttttgtgatcagggcttagcatctttgagcttaacaaaaaaacttgaacttgtatgcgagtgtgatgaactgatgattgatgattcagaaatcccctttcctggggtttgtgatggatggcaagcaaagaggataaaattcggtgcttgtctctgttgagatgggtttttttaggatttgtttagtggtggatttcttggactttgggtgccactgggtggttcttggtagagggggtactgcttcagtgcttctatccatgtgccacgtcagtgtccactgactcacccccaagccttggtacaggaagaggataggaacaaagatgaggggtagtggaaagcagcaggaacaacttgctgatcctggagaagtgtgctgttgcagaaatattgagaagatttaatctggctttgcttagttgttgttttttattgtcagaaaagccataactcaaaatccccatatgttgggagaaagagaaaacaaaatgatgagttcaattgaaaatgttgctacataagagcctactattggaggagtgagtagtccaaactccaaacgatgttgctcgtcctgttaaggggttttgctccaaatttggacttgcaaacaagttaagccacaagttgtttttttagccactgttgtatgcacagcaaagacttataaaacctgtttcagtaatataataagcggcttcagtttttttttagataagcgactcttttatgctttctataaaaccttccaaatgataaaaatgcacttgatgctgatcattcgtattagtccatcatactaatttcatggacatgctaagttcagctgtttagagcaagtccgtcttctgtgatgtctgtgaacttccattcagctaagatatttcacctttttattagtaactacaactgaatatggtttgtagtttctttttggtaaaaaatatagttccatgagatttttagataatgggaaatccgggtctttgcatcagcagatattacaacccaccattacaaaatttgcagcacgtctggctgaaagtaacaaacaccaagaggacaagaaaaccatacgaaaacattgacataaggactaattaaaagaatcaggaatcaatcatatttctaaatctccatccacggcgaagatttgcatgatcattgtctcaaaagtccgccatgcaaactggatattgtccttgtcctcacacttttgcaactggtcctaaaactgatcccagtatgtggcccagtatagtaccttcatatgagatttagttggggttttggtccatgagactagtgaaagtgcagcctccgtgagtccaaggtacctttgacggcttatttcaattattattttaaatgaaaccctttaaaaattatattactttggaaaatttttttccctaacagatctattgttgctgtttttacagcgccaatctaaatagttttatgtatagtggtgaaagactcgaagttgtattagattaccatttaccatgcccatgtcagagtggcatacatgtgttaacagagggaatattaggctgaaaaagagtaaatctaaacatcaaactagcagaatttccaagcaattatgcagttagatactaataacatgtttgtatcgaaactaatatgcaacagtgtttcttatgaaatagctctaatatatatcctattaatctcccacactataatctagatccaccacaataagtataatggatatgttttagcgttcctccaatcaactagtagtaatttatagaatgtggaagctttccttttatactgtttttagaatgtaaacttgatttcctgcatttcatgcctttgaaaatcttaaagactggccatgtaatgccaatgaaaatcagatgaatgacaaatacaaagtagagaatatcttatcacagattagtgaaggaagttcctcagaaaggttttggctttacaggagatgtcatgcttatttgctaacacaagtgcctgcagttgtatttggacaaactttagtcctctaatgctctaagatttgttgaccgttcttcaatagcatctttaacattgtattattttacttcgtcaactgttcttacctcatccatcgagttctagcagggctaactttttatatttctcaagctcttgaaagacaaaaacatttctcttttctgaactgctcaggcaacaaggaagtctaatcatgtggttttaggcattgatcaaagttgatagtccacatttatccactagattgaggcatctattgatattagtggattgctatacttttttgttttactgattgatgttttcaacttatattatcttgttcagcaggagtggtatacagcagataagactcttgagtgattcaggtaatcaaggcagaagatgtcttcttcaagacctactcaatgttccagttcatccagcaggacccgccaaagctcccgggcaaggatattagcacaaacaactcttgatgctgaactcaatgctgaatatgaagaatatggcgactcctttgattactccaaattggttgaagcacagagaactactggacctgagcagcaagctcgttctgagaaggtcatagcttacttgcatcacattcagagagcaaagctaatccaaccatttggttgcttgttggcccttgatgagaagaccttcaatgttatagcgctcagcgagaatgcaccagagatgcttacaactgtcagccatgcagtgccaagtgttgatgatcccccaaagctacgcattggcaccaatgtacggtctcttttcactgacccaggtaccacagcactgcagaaggcactgggatttgctgatgtttccttgctgaaccctatcctagttcaatgcaagacctcaggcaagcctttctatgccattgttcatcgggcaactggttgtttggtggtagactttgagcctgtgaaacctacagaatttccagcaactgccgctggggctttgcaatcttacaaacttgctgccaaggcaatctctaagatccagtcactgccaggtggaagcatggaggtgctatgcaatacggtggtcaaggaactctttgacctcacaggatatgatagagttatggcttataagttccatgaagatgaccatggtgaagtctttgctgagatcacaaagcctggtcttgaaccttatcttggcctgcattatccagctactgatatccctcaggcagccaggtttcttttcatgaagaacaaagtccggatgatttgtgattgccgtgcaagatctatcaagattatcgaagatgagtcgctccacttggatattagcttatgtggttcaacactgagggcaccacacagttgtcatcttcagtatatggagaacatgaactcgattgcatcccttgtcatggctgttgtggttaatgagaatgaggatgatgatgaagttggggctgatcaacctgcacaacagcagaagaggaagaaactatggggactccttgtttgccaccatgagagccccagatatgttcctttcccattgcggtatgcctgtgagttcttagcacaagtgtttgctgtccatgttaacaaggagtttgaattagagaggcaagtacgcgagaaaagcatattgaggatgcaaacaatgctctctgacatgcttctcagggaatcctctcctctgagtatagtatcagggactcccaacatcatggaccttgtgaaatgtgatggtgctgctcttttgtatgggggaaaagtgtggcggctacagaatgctccaactgagtctcagatacgtgatattgccttctggctgtcagatgtccacagggattccactggcctgagtactgatagcctacatgatgctggatatccaggagctgctgctcttggtgatatgatttgtggaatggcagtagctaaaataaattccaaggatatcctgttctggttcaggtcacatacagctgctgaaatcagatggggaggtgcaaaacatgatccatcagacaaggatgacagcagaagaatgcaccctaggctgtccttcaaggcattccttgaggttgtcaagatgaagagcttgccttggaatgactatgagatggatgctattcactcattacaacttatacttagagggacactgaatgatgacatcaagccaacaagggccgctagtttagataatcaggttggtgatctcaagcttgatgggcttgctgaattgcaggcagttacaagtgaaatggttcgtctcatggaaacagcaactgtcccaatcttggctgtagatagcaatggattggtcaatggatggaatcagaaggttgctgagttgacagggttgagagtagatgaggctattggaagacacatacttaccgttgtagaggaatcttctgtaccagttgtccagaggatgctgtatttagctttgcaaggtgggtaaattagctatagtggtttttgtctattcccccagtatttttcaagtttctgcttatttggcaattcgatttatcaaaaaaactttggggttgctttctaatgttcaatgcctagcttgttatatgtacatttgattgtcatgctcatacattaatacttgacattcagctgcgttgtgggttgattgatttctaaacatttctttgattgatcaggcaaagaagagaaggaagtgaaatttgaggtgaaaactcatggctccaagagagatgatggccctgttatcttggttgtgaatgcctgtgccagccgggaccttcacgaccatgttgttggtgtgtgctttgttgcacaagatatgactgttcataagttggtcatggacaaatttactcgggttgagggagactacaaagcaattattcacaatccaagcccgcttattcctcccatatttggtgctgacgaatttggatggtgctctgagtggaatgctgccatgacgaaattgaccgggtggcatagagatgaggtgatcaataagatgcttcttggtgaggtgtttgatagcaccaacgcctcctgtcttgtgaagaataaagatgcatttgtaagtctctgcattcttatcaacagtgcattagctggtgatgaaacagaaaaggctccattcagcttcttcgaccggaacgggaagtatatcgagtgccttctttctgttaacagaaaagtaaatgcagatggtgtcatcactggagtattttgtttcattcaagttcctagtcatgagctgcaacatgcactacatgtgcagcaagcctcacagcagaatgcactaacaaagttgaaagcttactcctacatgagacatgcaatcaacaaccctctctcaggtatgctttactctaggaaagcactgaagaacacaggtctgaatgaagagcagatgaaggaggtcaatgttgcagatagttgtcaccgccagctgaataaaatactttctgacttggatcaagatagcgtcatgaacaagtacttttcttaccaagtattctaagttactctcttaggctcttgtatttactttcagctacctttgttcttcatcaattgtcagacctaacaggtcgatggtgttgctcttatagtcttatgtgtttgtattatcttcaagtggtcaattttgctctctcaaaatgaaagaatttgttgcaccaagtcccagtggttttttactcattactcagtacaaaccttatatatatattattagttattatcttcaaactaatttcctgctgctgtgttcacaggtctagttgcttggatttggagatggttgagtttgtattgcaagatgtgtttgtggctgctgtaagtcaagtactcataacttgccagggaaaagggattagagtctcttgcaacctaccggagagatatatgaagcaaacagtctacggggatggtgttcgactacagcagattctctctgacttcctattcgtctcagtgaagttctctcctgttgggggttctgttgagatctcttgtagcctgaccaagaacagcattggggaaaaccttcatctcatagacctagaacttaggtatgttagtcatgacatttgcacgcttactcttctttctgttaagacagtcttgaggtataaaatgatgtgtattaactcttgtggatcaatgtttttcaggatcaagcaccagggcaaaggagtcccagcagatctgctgtcacaaatgtacgaggatgacaataaggagcagtcggatgaaggcatgagtcttgcggtttctagaaacctgctgaggctcatgaatggcgatgtccgacatatgagggaagctggcatgtcaaccttcatcctcagcgtcgaacttgcttctgctccagcaaaataatcatgaaatggtatgtgaaattacttaattgactgtttaggctgctcagtttgttttgcttgagaccctgtttagatgggacaaaaactttcaagtccctatcacatcggatgtttggacgtactaattataaatattaaacgtagactattaataaaacccatctataatcttggactaattcgcgagacgaatctattgagcctaattaatccatgattagcctatgtgatgctacagtaaacattctctaattatggattaattagggcttaaaaaatttgtctcgtgaattaggctttcatttatgtaattagttttgtaagtagtctatatttaatactctaaattagtgtctaaatatagggactaaagttaagtctctggatccaaacaccacccgagtccactgctgaaactgcgtcttttcctgactcgtgctctatttaagcggctacaagagtgcctatagaaccaccatgtcctgtaggcttcgcttcttccattctgattttttttagctacaaacatatttttctaccatttctgaaatacattggcttatgacatcctcttaatctgtacactttgtcacttggtacagatgactagcaaatatgatttatctaaattgctgtccattttagagataaaactacaaacaattgatttcatatatttatttctcttgcgaacaacttccactttttcaaagtaccagtgtgatacttttgctaaagagttgtgttttctgcagttcgttcgtatagccacgacggtcgttgtgcttaggattggacgtacttgcagactgaagattcactggctgcagataaatggttgactctacagataaatggtcgtatggcacatttggttatgtactgtcgtcttcttcaccatgctaatgtcagtatgtgtaatcttctaagttgcaaatgcgtgctgttgctcgcctgaactcattaagattggaagtgaaaacaccaatctgtaatatgctgtatcttgatgctgagagcattcaagttactactacatgaataaaatatggtttgactttactcactagttcgaaaagtagaatctaataaagcttttcttacttagggcctgttcttgattaaggtacggatttcacattggttttcgttagcacgttttctaaacctgctaaacgtcctgttttttgcaaaaaaaaaaaatctatatggagattgcttttaagttaaaataattaaaattttattaatcatgcgctaatcttcagtaaactcaaatgggacctttacaggccaagtggccaactaggaagtaagggcctggttgtgggagcttctggcagctggagattcttctaga

SEQ ID NO: 257 - DNA, 1012 bp, Zea mays
  CDS (60)..(725)
ccacgcgtccggtgctgtgctctgctctgctctcgcctcgcacggactcgtggtaaaggatggagaccatgtcggctctcgcgaggacggcgccgccccttgctgggaccattcgccggccctcatgcgcgctgaggccgacggcgtccctctccttcgccgccgcttcaacgacgccccgcggccggctcgggctggggctgagcacggcgccggcggggagcgggagggcggccagggctcgcgccgtcccgcggcgcatcgtcgcctcctcggaggttgagcaaagctacattatgatcaaaccagatggtgttcagcgtggtctggttggagagattatttctcgctttgagaagaaagggtttttgttgaaaggcttaaaacttttccagtgccccaaggacttggcgcaggagcattacaaggatttgaaggataaacctttctttcctaagctgatcgattacataacttctggccctgttgtctgcatggcctgggagggtgatggtgttgttgcatcagctcggaaattaataggagctactaacccccttcaagctgaaccagggactataaggggtgatcttgcagttcaaactggaaggaacgttgtccatggaagtgatagtcctgataatggcaagcgtgaaattgaactgtggttcaaagaaggcgaggtctgccaatgggaatcagttcaagcaccgtggcttatagaataactattgctaatcatttccagagttgtattcaatgtttttttttgtgttcgtcttgattcaaggagccatgcaagagtgtatgagtttagttcggctaagtaattagctcatgagggcttgaattatcggttctttttgaggattgaggatttgtgcaactgaaacctttgatcagttgctcatgttgagaagctaatttcttgtcatatttacatgtaataaagtccctctactacagtaataaattagtatttcctctggtccaattaaaaaaaaaaaaaaag

SEQ ID NO: 258 - DNA, 1137 bp, Zea mays
  CDS (103)..(816)
attcggctcgagctcgagccgaatcggctcgaggcgaccgcaccggcacggcgcccatccatccatcgccatcctctagcccagtccaaaggaaccctagccatgagcgccgcctccaagaagctcttccaggccgccaggtccctcgtcctctccgcttctaaccgctccgtcctcgccgccgagggccgcaccgccgcgctcgccacgctcaccaactttggcaggaagaccctccccaccgcctacttatcctaccacaagcagggatcccaccatgccgcgtcggggtggggagccatcgccgccgcagtcccagctgcagtttacatgctccaggaccaggaggctcatgctgcagagatggagcgcaccttcattgccatcaagcctgatggtgtccaaagaggcctgatttctgagattatgagccgatttgagagaaaaggctataagcttgttgccatcaagctgattgttccatccaaagaatttgctgagaagcactaccatgatctcaaggaaaggcctttcttcagtgggttgtgtgattttctcagctctggccctgtgcttgcaatggtttgggaaggagagggtgtcatcaagtatgggagaaaactaattggtgccacagacccacagaaatctgaaccaggaaccatcaggggtgatcttgccattgttgttggaagaaacatcattcatggaagtgatggcccagagacagcgaaggatgagatcgctttatggtttgaacccaaggagctggtctcttacaccagcaatgcggagaagtggatctatggggtgaattaacgagagagtcaatctgttttttttccttcttttgatctcggttttcacataattgccgacagacctaggcacaaggatgtaataaagtcgctaccgtcacttctgagttggattgtgaccttcaggtgtagtaaggcacaaggaaggatggaaaggaaaggaatataccgtgaaatatagagcgtgcactgagtagtcgcgatgttcaaatcaaactatatatcaccgtcactggagtcatgtaatccaagatggtgatgcagatgtttctttggatctatttctctagatatccctaccaaaaaaaaaaaaaaaagg

SEQ ID NO: 259 - DNA, 658 bp, Zea mays
  CDS (49)..(495)
aaaaccagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccggatctcgcctccaagcccttcttccagggctcgtggactacatcatctctggccctgtggtggccatggtctgggagggcaagagcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggagattgccctgtggttccccgagggccctgctgattggcagagcagccagcacccctggatctacgagaagtaaacatggaaagtttcacatcaaaccttgagagccagaggaagcatgtcaccatttgtgctttagcaatgttttcgaaaagattatgatctgtatcttggaaccttatttcaatggaccaaatttctttctttgccaaaaaaaaaaaaaaaaaaaaaaaaag

SEQ ID NO: 260 - DNA, 910 bp, Zea mays
  CDS (162)..(608)
ccacgcgtccgcccacgcgtccgcccacgcgtccgcccacgcgtccgcgcctctcctcctctcctcccccacccgtccatcgcccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagcagcactacgctgacctttccgacaagcctttcttccccgggttggtggagtacatcatttccggccccgtggtggcgatggtgtgggaggggaaggacgtcgtgttgactggccgcaggatcattggggccaccaggccttgggaggcagcccccggtaccattcgtggggactacgccgtggaagtcggcaggaatgtcatccatggaagcgactccgtggagaacgggaagaaggagatcgctctctggttccctgaaggtgtggcacagtggaagagcaaccttcatccctggatctacgaggcttgagcagttgagcttggatgccttgcctgcttccatggaaaccagagttttgtttgagtattatctgttggctctggctgaagagtcataatttagcgctctgtgtgttacaccagagttaagtctgcctgaacttatgtggcatttgtttgagtttctaccttcgtgccctgttttctaatgtaccgtggttgtgaaccggtcaatgtgatctgaaataaaacattgcgtgccaagtttgtgttacaagtttgatgcactgggaatgccaggcaactaatgtggtaaaaaaaaaaaaaaag

SEQ ID NO: 261 - DNA, 2500 bp, Oryza sativa
  CDS (216)..(2093)
actagttgcttgcctcttcccacctcacctcgcattgcaatctcgcatcgcctcttccttctctttttccccttcttctccccttctcatccaacctcgcttcccaaccctggatccaaatcccaacctatcccaaagccgaaaccgaggagaggaaaaaggttacgcgcaattattactagctatagctaggtaggtttgggggaggcgagatcatgaagcgcgagtaccaagaagccggcgggagcagcggcggcgggagcagcgccgatatggggtcgtgcaaggacaaggtgatggcgggggcggcgggggaggaggaggacgtcgacgagctgctggcggcgctcgggtacaaggtgcggtcgtccgacatggccgacgtcgcgcagaagctggagcagctggagatggccatggggatgggcggcgtgagcgcccccggcgccgcggatgacgggttcgtgtcgcacctggccacggacaccgtgcactacaacccctcggacctctcctcctgggtcgagagcatgctttccgagctcaacgcgccgctgccccctatcccgccagcgccgccggctgcccgccatgcttccacctcgtccactgtcaccggcggcggtggtagcggcttctttgaactcccagccgctgccgactcgtcgagtagcacctacgccctcaggccgatctccttaccggtggtggcgacggctgacccgtcggctgctgactcggcgagggacaccaagcggatgcgcactggcggcggcagcacgtcgtcgtcctcatcgtcgtcttcctctctgggcggtggggcctcgcggggctctgtggtggaggctgctccgccggcgacgcaaggggccgcggcggcgaatgcgcccgccgtgccggttgtggtggttgacacgcaggaggctgggatccggctggtgcacgcgttgctggcgtgcgcggaggccgtgcagcaggagaacttcgcggccgcggaggcgctggtcaagcagatccccacgctggccgcgtcccagggcggcgccatgcgcaaggtcgctgcctacttcggcgaggccctcgcccgccgcgtgtaccgcttccgccccgcggacagcaccctcctcgacgccgccttcgccgaccttctgcacgcccacttctacgagtcctgcccctacctcaagttcgcccacttcaccgcaaatcaagccatcctcgaggctttcgccggctgccaccgcgtccacgtcgtcgacttcggcatcaagcaggggatgcaatggccagctctcctccaggccctcgcccttcgtcccggcggccccccatcgttccgcctcaccggcgtcggccccccgcagccggacgagaccgacgccttgcagcaggtgggttggaagcttgcccagttcgcgcacaccattcgcgtcgacttccagtaccggggactcgtcgccgccactctcgcggacttggagccgttcatgctgcagccggagggcgaggcggacgcgaacgaggagcctgaggtgatcgccgtcaactcggtgttcgagctgcaccggctgctcgcgcagcccggcgcgctggagaaggtcctgggcacggtgcacgcggtgcggccaaggatcgtcaccgtggtagagcaggaggccaaccacaactccggctcattcctcgaccggttcaccgagtcgctgcactactactccaccatgttcgattccctcgagggcggcagctccggccaggccgagctctctccgccggctgccgggggcggcggtggcacggaccaggtcatgtccgaggtgtacctcggccggcagatctgcaacgtcgtggcgtgcgagggcgcggagcgcacggagcgccacgagacgctggggcagtggcgcaaccgcctcggccgcgccggcttcgagcccgtgcacctgggctccaatgcctacaaacaggcgagcacgctcctcgcgcttttcgccggcggcgacggctaccgggtggaggagaaggagggctgcctcacgctgggctggcacacgcgcccgctcatcgccacctcggcatggcgcgtcgccgcggcgtgatcgcaaagtttttgggacgctgcaccacgtgtttgccgccgatcacggcgcgacccccccccccccccctctctctctccccggctcaccggcggcacaattgaagcttgacgtcaacgaacgctcaattgcagcgaccgatcgggcttacggttctcgccggcgtgaagagatcgacgactggactccgaccagaccgacggcttgttcgttctcctttcccaattaccccgttccttggtcctcctagcccatctattatgtttaaatgtcaattattatgtgtaatttctccaatcgctcatattaaataaggacgaaccgaactggatttcattagctccaatgagaattttgtatacaaggcaccgatctaaaaattgagctatatgttcatgagttaaaaa

SEQ ID NO: 262 - DNA, 828 bp, Zea mays
  CDS (91)..(624)
ccacgcgtccgcccacgcgtccgacttgagcagactagcaaggccttcagaccgggagggctccctgtcctgtcccccgcgccgccgcggatggccggagccaccacgccggcatcaggcgccctcgtcaggctctgcctgccttcgctcctcctctttctgtaccgatgtgaggctgttgagatggagagaacccttgcgatgatcaagcccgatggtttgtcaggtaagtacacagaagcaatcaaggaggtcatcttggattctggatttcatatcgtcaaagaaaccgaggtccagcttgatgctgagagggcatctgtcttctatgcggagcattcccagagaagcttctttgacagcctagtcaagtacataacaagtggtccagttcttgctatggttctggaaagacctgacgccgttgcgcaatggcgcactttgattggaccaactgatgcaaaaaaggccaaaacctctcatccaaacagcattagagcaatgtgtgggctggactctgagaaaaattgcgtgcatggttcggattcaccagaatctgcagacagagagatctcatttttcttcggagaagctgaatccgtaactgtggaacatgatgagctatagacgccacactggtatcaggcaagtcagcaaactgaattttgatgtgtctttgaactcttaggctatctcctgtagcttcttactcgtacccgtttcttattattttaaaagttattatgtaaacagtataatttatagtgcaaaacagtgtcttgcatggccatatgcttgtggcttcaaaaaaaaaaaaaaaaaaaaaag

SEQ ID NO: 263 - DNA, 2959 bp, Zea mays
  CDS (358)..(2613)
ggtgagcgagacagattccacagcaatttgctcctcttccacgcacaggcaagactgctccccagaaaagattgtagttttcatcgatttagccggtttctgcccggggggatcgctgctggagatctcagagaaccgggaggctccgagcttttgctccgtttgcgtcgaatctgcctcgggagcggagaaaggagcggccttccgagctcgtaggggccgtccctgagaaggcgagaggggacgcggcggcggcggagtcagctctagggcgctcgtggaagtcggtgatgccggtggtttgaggacgaggcggcctcggtggttttgaggaagccagcctctgccgcggcaaggatggactccagcggggaggaactcctgaagaagatccgggaactggaggttgggcaggcgcagctcaagcaggagatgtctaagctaatacccggcgctggggagcgtcggcgctcgcaatccgtctcgccgcggcgcggcgtgccggtgccgccgccaccgccggccaaggcgaaggcgggggcgccaggtaggcggctgtccggggggtttgagggcgggcagcgcgcgtgggcccgtgggtcggcgtctttcccgcactcatcaccgctgcagcgggagggccgcgcaggcgctggagacgctagcaccagcgctaggctgccggagaggcagtactccagggtgcttcagtcaatggggcagtccgtccacattcttgacctcgacgggaggatcatatactggaatcagtctgcggagaatctgtttggctatcctgcatcagaagcccttggtcaggatgccctcatgcttctggttgattcccatgaccacaatgcggtaaataacatcttccaacgtatttctatgggtgaaagttggactgggaagtttccagttaagaacaagcaaggacatagattttcagctgttgccaccaatacacctttctatgatgaagatggcagtttgatgggtttcatttgtgtttcaagtgattcccgccaattggagcagatattttgtaagcctccgacctctgcaaggtcccagtcagaatcatctatgacatcttgtgatgggagttgcagcaacactagtcacagaatcaattcgttgaatagaagttcttttgattctaatctacccctgcaaagcactttagcatccaagataacgaatttggctaccaaggtcacaaataaagttcgttctcgggtcaggacagacgagaatgacgatggtggcagtggtgagagccattgcttggatcgtggtgcaaaggaagagccaacatctagcggaacaagcacaccaagaggggatgcaccacatggtccctttgctacagaagagaactcacctgggaaatcaacgaacccaaacagcgacgaatcagaaggaaaagtaggtctgcacaagattttgggttctaaggcagaggcactattgaacaagaaagggatatcatggccttggaaagggcgcgagaatgagggacctgatgaaagaaaccatgtgatattgccgtggttgcatggtggccaagagaatggtgtgaatcatcagaaggtttctgattctagtatatctccagacgcccaaggcgctgaacacaaccaacctagcaaaaatgaggcatcaggttcctggtcctctttcaacaataacagcacaggcagtgcaagcagcacgggaagcactaatagcagtgctctctacaaagtagatcatgaagcagattgtctggattatgagatcctgtgggaagaccttgtcattggagaacaaataggtcaaggctcttgtgggacagtatatcatgctttgtggtatggttcggatgtggctgttaaagttttctccaagcaagaatattcagaagaagtgatactgacctttcgacaagaggtatcccttatgaagaaattgcgccatcctaacatactgctcttcatgggtgcggttatgtctccacaacgcctttgtattgtatcagagtttctcccccgtggaagcttgtttcgcttacttcaaaggagcgctaccaagttggatgtgagacggcgtgtccacatggctttagatattgtaaggggcatgaattatcttcaccattccagcccgcctatcattcatcgagatttaaaatcatctaaccttttggtcgacaagaactggattgtgaaggtggcagactttggtctttcacgtctcaagcgtgaaactttcttgacaacaaaaacaggaaaaggaacaccccaatggatggcgcccgaggtgttgcgcaatgaaccttccgatgagaagtctgatgtgtacagttacggggttatcctgtgggaacttgttactcagaagataccctgggaaaatctgaactcaatgcaggtcattggtgcagtgggttttatgaaccaaaggttggatatcccaagtgaagtagatcctcagtggaaatcaattatcctgagctgctgggaaagcgacccgcagcaacggccgtcgttccaggagcttcttgagaggctccgggagctgcagaggcactacgccatccagcaccggaacacaaagaacagcatcgaggagtaaagaacacaatgcgacctctcagagcggcttgcttcgaagcattttgcgagcgaacgaacgaagaaccccaggtctctagaagggcctggaccctcctgtactgtatggttttgcttctgcggaacagccaaggctggaagaagtttgttgtacagacgggggtacgttcttctttgtttgacagggcaattgtgactgtaatctctgggtcctgacacccaagggtagggtagagactatagagtgagtagtgactgagctccggattgctggcgcatttgggttcttctgattcgtggcaatgcaaatgcgtggttaacaataacaaaaaaaaaaaaaaaaa

SEQ ID NO: 264 - DNA, 1645 bp, Zea mays
  CDS (32)..(541)
cccacgcgtccgcccacgcgtccggccccgcatggcaccccaggggcggagagcgacgaggagatacggcggggtgccagagatgggcggcgcgtcggcgtcggcctcgtcgggcgccggcgcggacgagcgtcccaagggggaggacggcaagcaggggcaggtggcggcgggggcgcagcctccagcgggcgggaagaagcgcgggcgcacggcgggggacaaggagcagaaccggctgaagcggctgctgcggaaccacgtgtccgcgcagcaagcgcgagagcggaagaaggcgtacctgacggagctggaggcgaaggccaagggtctggagctccgcaatgcggagctggagcagcgggtgtccacgctccaaaacgagaacaacacgctccgccaggttatagatgttagtggaaaagaattcaaattcacctgggcatctggacgtggcgaattgtgtgatatttatgaagaacgtcagagtggagaggatggaaatgggttgcttctggagtgtggctctacttggcgcaagtgaaccctatagcctgggcagttcctacaaaacatgagggtgatgccagtgaagaagcttctctcgccgatgagacacttgcatcagaagtagtgctaacccggaagaggaaaataggaagctctttgtcagtagagccaaaccatctctctgatgaacttgaaccaaagttggaggatgcttagaacggggagacgtctaactgaaaagtaaaagtgggcagcatcgtgatgccaacttacccccctgccatggttttattggtcctctgcttgtttctcgttttccttgggagtcagcttctctgttttatgtggtcgcacacggccttatttgtagtattacaccacagaagctggctgacccccactgagggagaggtgattgatgcaagcattgtgtatgatccttggacaagggaatcgcgggggtttggttttgtcaccatggctgctactaaggaggcagatcactgcatcaaatatctggattgttctgtgttgcaagtactctacacagaacattttattgttttgtcttcaccaccgagaatccgagatcgcctcccatagcctccacatccataaggtcctgcttgactgcgacgacgtccaggctgatgccctcatcgtggatcgactcgcctcgctctagaaggagtggcccctctggagttgaatatgcagttataaccaatttttaccccttttatcctagaagagttgccaagacacggtataagaccatgataatagactaagagaggatttggctctaattactatatgttttatttatgcagtcccatgagaactttgagtatttgcagattgctttattaatttattaaagttaaagattgtatgtgttgagtatgtatccactcttgttggaagtgtcttgcaattccaatccaaggatgtataaaatactgcatgggctaagtatgtgttttttcatgtatttggagtatatatactttttgttgcttgagaacatgtatgtacactagaagcttgtcaattgtgtgaacttgagttgatccctgtctaacctgagtatatatatatatatatatatattttgttgcttgagaaaaaaaaa

SEQ ID NO: 265 - DNA, 2358 bp, Zea mays
  CDS (295)..(1929)
cagtgaggcacccctctcctggcctcttctcgccttctccgtttccgcgaacccagctgcctcgtagccccaccacaccgccgagcacgcggtctcccgcgccgccttccacccaagcgaagctacccctactcgacccagaattatcttctaccagcgctagtccgctccgcctctctactggctgccgtggagtggggatccgtccggacttccttctttcgctgttgatgtcatcatgctgagcattttgtggtagagacgatcatctctttgggttccagcatataactcatgcccataaaatttgcactagaaaatatgtcgacacaagcctctaaccggtcatacagatatccagacagaacccaactgccgtaccacaatggcaatccaatgcatgttgggggcaatggtaattactgtgtgcaacaaaatcacgatgatgttaactacatttcctctgatgatggatcacagagcagtagttctagagttcaagattttcaagcacagttttgcaccctagattcgtcttcggccaattgtgtttatcctgcacatagttctacctcttctcagagcataagtggaagccctctgtctcagcaggagagccactctgatcatgcatatggttcctctccaagtgcatcgtgcatcactcaggttcccacctggacacttaaggatctagaaaatgtgatgcttggacccgattctgacataggtagccctgacagttcctttctgcttgacactgccttgcatggaaataactggagagaacttttgggaattcaaactggggatttgaggcaggtaattgtagcatgtggtaaggctgttgacgagaatgctgtctatatggatgcattgatgtctgagttaagggagatggtttctgtctctggtgaaccgatgcaacgtctgggagcttacatgttggaaggcctcattgcgaggctttctttcactggacatgccttgtataaatctctgaagtgcaaagagcctgtggctacgagttctgagctcttgtcctatatgcatcttctttatgagatctgtccattcttcaagttcggttacatgtctgccaatggtgccatagctgaagcggttaagggggaagacattattcacatcatcgattttcaaatcgctcagggtagtcagtggatgactatgatacaggcccttgcttcaaggcctgggaggcgaccatacctaaggatcactggcatagatgactcgaattctgctcatgcccgaggtggtggactggatatggttggacagaggttgcacagaatggcccagtcatgtggtctgcccttcgagttcaatgctgtgccagcagctagtcatgaggttgtgtttgaagatctttgtctaagatctggggaggccatcgttgtcaattttgcttatcagctgcatcatactcctgatgagagcgtgggcatagaaaaccatcgtgatagaatactgagaatggtcaagagcctctctcctaaggtggtaactcttgtagagcaggaggcaaacacaaacacagcacctttctttcttagatacatggagactcttgattattacacagcgatgtttgaggcaatagatgttgcttgccccagggatgataagaagcgcattagcacagagcaacactgtgttgcaagggatattgtcaatttaattgcttgtgaaggtgcggaaaggatagagagacatgagccttttggaaagtggagggcaagacttgtaatggctggttttagaccatacccgttaagtccagtggtgaacagaaccatcaaaacactgcttgacagttaccacagccattacaggcttgaggagagagatggcatcctttatcttggctggaagaacagaaagctggtcgtatcttctgcctggtgctgatatttccaacttcttctaagaagcattgttaagattctttcgtggcttggggttcaggcgttcagcacatgaatccaaggtggaacctaaacttcagtatgaagactgcacaatcaaaaaaacaagctggttgcttccttactatttgttgcccagccttgaaactctcccacgctcactatcatcgctgatgtacttaccatgactcagttccatccttatatataggtgcaaacaatggtcttaatattgtatattggtagaatctggtggtattagcttccaaatctggattgctgaatcgtttgtgttactacatttagccaggatttgacagtagacacaaggagtgctgtaagatcctgtatgtacaacgtgcttcagttggtgtattgtacgtacttgggtgctaaaaaaaaaaaaaaa

SEQ ID NO: 266 - DNA, 2470 bp, Zea mays
  CDS (153)..(1934)
cgtagctatagctggctagcttcctcctcctggctagctgctacccttcccggttctcaccgcgctgccattaaaacccccttccttgttaccacttcgaccttgagcaagcgcactcttcatgttgccgcctcgccgcagtagcagcttacatggatacgctgtttaggttggttagccttcaagcctccgaacagcagcagcagcagcaatcggcgtcctacaactcgaggagcaccacgtcgagcggctccaggtcgtcgtcgcaccagaccaacgcatcctacaactactactaccacagcaacagcagcggcggcggcggcggcgggcagtactactacggtcagcagcacccacagcagcaccagcaccagcagtactacctggagccgtaccagcaagaagaatgcggcaacacccaccacctttacatggatgaagacttctcctcctcgtcctcgtcgaggcagcatttccactcgcacggcgcggtggtgcagccgccgacgtcgtccacggccacgcccacggcgccgacgccctcgctgtccacgtcgtccacggccgctggggcggcgcacgcgctgttcgaggcggccgacctgtcgttcccgcctgacctcaacctcgacttctcatccccggcctcgtcgtccggcgggggcgcggcctcgtcggcggcggtcgggggaggtggcgggggaaggtgggcgagccagctgctgctggagtgcgcgcgcgcggtggcgggccgcgacagccagcgcgtgcagcagctgatgtggatgctcaacgagctggcctcgccgtacggggacgtcgagcagaagctggcgtcctacttcctccaggggctcttcgcgcgcctcacggcgtccggaccgcggacgctgcgcacgctcgcggcggcgtccgaccggaacacgtccttcgactccacgcggcgcacggcgctgcggttccaggagctcagcccgtggtcgtcgtttgggcacgtggccgccaacggcgccatcctggagtcgttcctggaggccgccgcggcgtcgccggagccccagaggctccacatcctcgacctcagcaacacgttctgcacgcagtggcccacgctgctggaggcgctcgccacgcggtccgccgacgacacgccgcacctgtcgatcaccacggtggtctcctccgcgccgtccgcgccgacggccgccgtgcagcgcgtgatgcgggagatcgggcagcggatggaaaagttcgcgcggctgatgggcgtgcccttcagcttccgcgcagtgcaccacgccggggaccttgcggggctcgacctcgacgcgctcgacctgcgcgacggcggcgccaccaccgcgctcgccatcaactgcgtcaactcgctgcgcggcgtggtgccgggcggtgcgcggagacgggacgcgttcgccgcgtccctccggcgtctcgatccgcgggttgttactgtcgtcgaggaggaggccgatctcgtggcttttgaccccggcgcgcccgaggaaagcggcgacacggaggcagcgttcctgaaggtgttcggcgagggcttgcggttcttctcggcttacatggactcgctggaagagagcttccccaagactagcaacgagaggctggcgctggagaggggagccggacgtgccattgtagacttggtctcgtgcccggcgtcggagtccatggagcggcgggagacggcggcttcatgggcgcgccgcatgcggtcttccggcttctctccggtggcgttcagcgaggacgtcgccgacgacgtgcggtcgttgctccgtcggtatcgggaaggctggtcgatgcgggacgccggtttagacgactcggcagccggagcaggcgtcttcctggcgtggaaggaacagcctctcgtgtgggcgagcgcgtggaggccatgatagagatccccgtcgacgcaagatgcaagctcggtggagtacgcgcgtacgtggaacatcatgaaccacaggagaagcaagggcgccatccgccatacctagccggcgcgtggatgcaatgatccatgcagtggatcgggcgcacgtgcatgtgtatggcgagctgaatggcgcaacgcatctagggttttggagcagtagtagggattgctagttcacgcacacatggttgtatgcagcaaggtgatccaggaggaggtatggtcgatggttttaggttttagacttgcatctatttcaaatttggatcatcgatcgccacaagctcttggcgtgatgattccgattttcttgcttctttgtttttttttttttgtcacatttctctgtgtttcttcatgtaattcaaggttaacgactttcttccctctggagggatttacgtgcatggttttgtcatactttctctcattcctctgtttgcatttgcattgcatggttgttgagatgtcgcttcctaaaaaaaaaaaaaa

SEQ ID NO: 267 - DNA, 2537 bp, Zea mays
  CDS (520)..(2145)
ggccgcgaattcgcccttcgcggatccgacactcgtttgctggctttgatgggcgagctggaaggacggggttcgggcttaggctccagtgcctgttcggtggtcgcggtgctgatggcgatgaatgaacactgtggcactggaattagtccagcacgaacccaagttccaccagagccacacgttttcactgctcccacgaaggcacaccgcacacagccgcggcctgcaggcgacggtgacggcggcggcggcgctccatcctccgccccttcccttactcgcgttcggcacgcaggcgacggtgacggcggcggcgctcaggatcgggctctcagcgacggcggcggcggttttccctcccggctctcgccagtcgcctcgcgttctcgcctccggtcctccgaacgccggccggtgaccctgctggatgacatgagcacactaaatacaatcctgatgaagatggcaggattagcttcctgctgagttttgtcctacaagattgcaaagggcagaatgtcagctagggattctaatcattcatataaatgttcggatgattctcaaatgccgtactacaataactcagcacctgtaggagaaaatggtaggatccatatggcagaaaacagtctaggacatcattactcatcctccgatattggatcacaaaggatcaacaattccaaccctcaagtatttgaagcacagtactgcactctggaatcatcctcagcaaatggtgtttatcctgcacaaagctccacatcttctcatagcatctcccctttaagtgggagccccctgtctcagcatgacagccactcagaccacacatatagttctcctccaagtgcttcctgtctaactgaggttgcaggtctcctgattaaacaaaaagaattagagaattccattgttggacctggactggacattagttctgactgctctcggagcttgttgcaagcccatgttccagtgagaccagacaactggagacaacttctgggaattaatggaggagacttgatgcaagtagtcatagcatgtggtaaggctgttgcagagaatgatgtctttgcaacagaactgttaatatctgagcttggtcacctggtatctgtatctggagatccaatgcaacgacttggagcctatatgcttgaaggaattgttgctagactttcttcctccggcagtatgctatataaatctttgaaatgtaaagaacctacaagctctgagctcatgtcatatatgcatctcctttacgagatctgcccattctacaagtttggttacatgtcagcaaatggtgccattgccgaggctattaagggcgagaactttgttcacataattgatttccaaattgctcaggggagccagtgggttactctgctacaggcccttgctgcaagacctggggggccaccatacattagaatcactggtatagatgactcaaattctgcttatgccagaggaggcgggcttgatatagttgggaggacgttgtgtgatgttgctaattcatgtggtcttccttttgagttcaatgccgttccagctgctagccatgaggttgagcttcagcatcttgctataagacatggggagattattgctgtgaattttgcctatcagctacatcatgttcctgacgaaagtgtaagtacagaaaatcatcgggataggattataagaatgatcaagagcatcaatcctagggttgttactctcgttgaacaggagtcaaatacaaacacagctccattcttcccaaggtacatggaaactctcaactactatacagccatgtttgagtcgatagatgttgctctcccaagggatgataggaggcggatgagcgcagaacaacactgtgttgcaagggatattgttaatttaatcgcatgcgagggtgctgaaagggttgagaggcacgagctgtttggaaaatggaagtcaagatttgcaatggctggatttagaccgtacccactgagttcagttgtgaacaacactatcaacacattgttgcatacctacaacagctactacaggcttgaggagagagatggtgtcctttaccttggatggaaaaacagagtattggttgtatcttcggcatggtgttgacatttcctctgcaggttccatcgcactttggcctccatctgacgtttctaaggcaccattatgcttgtctggtatactcagtatatgcttgtatgtaatttgcaaccataccttacccaatggttatcttaccaactagatcttcatggcaaggtgaagtgtcacttaaaatctagaagttgtaactgtcgtgttgacgctagatatagatagttctgctttggtttgacatatgcagatgtgctgtaatgctcaggggttatgctaggcaggcccaagagggtgcctgtttgttatctatcaggctactgtgttgccgcctgctttgtgtgtgcatatatatttggaatgctactgtcctttctcaaaaaaaaaaaaaaaaaaaaaag

SEQ ID NO: 268 - DNA, 2385 bp, Zea mays
  CDS (131)..(2020)
ccctcccctaccctttccttccccactcgcacttcccaaccctggatccaaatcccaagctatcccagaaccgaaaccgaggcgcgcaagccattattagctggctagctaggcctgtagctccgaaatcatgaagcgcgagtaccaagacgccggcgggagtggcggcgacatgggctcctccaaggacaagatgatggcggcggcggcgggagcaggggaacaggaggaggaggacgtggatgagctgctggccgcgctcgggtacaaggtgcgttcgtcggatatggcggacgtcgcgcagaagctggagcagctcgagatggccatggggatgggcggcgtgggcggcgccggcgctaccgctgatgacgggttcgtgtcgcacctcgccacggacaccgtgcactacaatccctccgacctgtcgtcctgggtcgagagcatgctgtccgagctcaacgcgcccccagcgccgctcccgcccgcgacgccggccccaaggctcgcgtccacatcgtccaccgtcacaagtggcgccgccgccggtgctggctacttcgatctcccgcccgccgtggactcgtccagcagtacctacgctctgaagccgatcccctcgccggtggcggcgccgtcggccgacccgtccacggactcggcgcgggagcccaagcggatgaggactggcggcggcagcacgtcgtcctcctcttcctcgtcgtcatccatggatggcggtcgcactaggagctccgtggtcgaagctgcgccgccggcgacgcaagcatccgcggcggccaacgggcccgcggtgccagtggtggtggtggacacgcaggaggccgggatccggctcgtgcacgcgctgctggcgtgcgcggaggccgtgcagcaggagaacttctctgcggcggaggcgctggtcaagcagatccccatgctggcctcgtcgcagggcggtgccatgcgcaaggtcgccgcctacttcggcgaggcgcttgcccgccgcgtgtatcgcttccgcccgccaccggacagctccctcctcgacgccgccttcgccgacctcttacacgcgcacttctacgagtcctgcccctacctgaagttcgcccacttcaccgcgaaccaggccatcctcgaggcctccgccggctgccgccgcgtccacgtcgtcgacttcggcatcaaacaggggatgcagtggccggctcttctccaggccctcgccctccgccctggcggccccccgtcgttccggctcaccggcgtcgggccgccgcagcccgacgagaccgacgccttgcagcaggtgggctggaaacttgcccagttcgcgcacaccatccgcgtggacttccagtaccgtggcctcgtcgcggccacgctcgccgacctggagccgttcatgctgcaaccggagggcgatgacacggatgacgagcccgaggtgatcgccgtgaactccgtgttcgagctgcaccggcttcttgcgcagcccggtgccctcgagaaggtcctgggcacggtgcgcgcggtgcggccgaggatcgtgaccgtggtcgagcaggaggccaaccacaactccggcacgttcctcgaccgcttcaccgagtcgctgcactactactccaccatgttcgattctctggagggcgccggcgccggctccggccagtccaccgacgcctccccggccgcggccggcggcacggaccaggtcatgtcggaggtgtacctcggccggcagatctgcaacgtggtggcgtgcgagggcgcggagcgcacggagcgccacgagacgctgggccagtggcgcagccgcctcggcggctccgggttcgcgcccgtgcacctgggctccaatgcctacaagcaggcgagcacgctgctggcgctcttcgccggcggcgacgggtacagggtggaggagaaggacgggtgcctgaccctggggtggcatacgcgcccgctcatcgccacctcggcgtggcgcgtcgccgccgccgccgctccgtgatcagggaggggtggttggggcttctggacgccgatcaaggcacacgtacgtcccctggcatggcgcaccctccctcgagctcgccggcacgggtgaagctagacgtcattgagcgctgaatcgcagttagcgaccgggccaaggttctcgccggcgtgatgagatggaacactttgactcccgcggccggatcggcctgtgttcgttcttgtttccgatctcccttctctttcccgttgcttcgatcccgtcaagtatggtagaccgtagcctattgttatgtttaaatgtcaattattatgtgtaattcctccaagcgccgatatccaataaggacgaaccggattttcgttaaaaaaaaa

SEQ ID NO: 269 - DNA, 2315 bp, Zea mays
  CDS (266)..(1948)
cgtttccgcccgcgtcctcgcctcttctttcttcgcctcttctgcaccgcgctctcgctcgcccctccgccgcttggcctccaccctcccgctgccggctccgccgactggacttccgcccgtcgctggccgtcggcgcgcccgttcctcgcaggtgaattgttcaggctgaattgatcggtggaagctgtgcattgactatttttttaatctcagaatcaaagagagaaattgaactgggaggctgctaattgcgagagaagtgatgtctttcgttaggcaagcagacccatcagtgtcctgtgccgagaccacttacatccacaaatttgtgccaccaggaccagttttcccagcacagagatttgtctctggcaccgacttgcttcaccacgggcctcaaccatataatgctgagggctacaagcagtctggtttcaatggcacagcgcctcatgcatttcagagcttttacaatactgatagctatgctgaatctcactttaatgaagcaccatattctcctgcaatcttcgatatatctcagcagaactctcaatctttatcagacaaccaggcctctgatcttgtagagttcgatgaggatgagatgagagtaaagcttcaggagcttgagcatgctttacttgacgatggtgatgagatcttttttgacttgtcagggagcattaacgatgagtggaatgataacattaagacaaacaatgaatgggtcaataccatgaagaatattgtgagccccgactctccaaaagaggcatcacctgagtcaagcatctgctgtctcgacaacaatgttggagaagcgcggaacccgaaacagttgctttttgactgcgcagaagcgatatccgaaaatagcatcgatgaagcacagtcaatcatagcagaactacggcagaaggtggcaattcaaggagaaccttctcagagacttgcggcctatctcgtggagggccttgctgccacactacagtcttcaggaaagggcatctacagggccctgaggtgcaaggaggcccctactctgtaccagctttcagccatgcagatcctcttcgaaatctgcccatgcttcaggctaggcttcatggctgctaactatgctattctcgaagcctgcaaaggcgaagatgtcgtgcacatcattgactttgacatcaaccagggtagccagtacataactcttatccagttcctaaagaataacagtaacaagccacgccttttgaggataactggtgtcgatgatccagagtcagtgcacagagctgttggaggactgaatgttgttgggcagcgactagagaagcttgcagaggactgtgaggtacggtttgagttcagggcagtggctgctaacattgaagatttgacgcctggaatgctaggtcgccgtcccggagaggccctcattgttaactttgcattcctgctgcaccaccttcctgatgaaagtgtctcaattatgaaccaaagggatcggcttctccgtatggtgaagggtctccgaccaaaactagtgacgttggtggagcaggacgcaaatactaacaccaccccattcccttccaggttccgggaggtctatgactactattcggcactttttgattcactggatgccacccttccaagggaaagcccagatagaatgaacgtggagcgccagtgcctcgcacgggaaatcgtcaacatcttagcttgtgaaggtcctgaccgtgtggaaaggtatgaagtggctgggaaatggagagctagaatggcaatggcgggctttgtgtcgtccccatttaacagcggcgcgattgatggcataagatctctactgaaatcgtactgcgataagtacaggttcgagaaggtccaggacggtctccactttggctggggcgacaagacgctcgtcttctcttcggcgtggcaatagaagcttgcttgtactattgcctatctgagcactttccagcgtttttaggagcatctggggcaagggctgtaaagagatttctgtcgccgtattgttgacctaccatataagtacactcgtagctaaccttagcgtgctgcctgcctgtaggcttgtgacttgtgaggtctacggtttacctagtttcttagatgaaagtatgttgtgcattgtacacctactgaactacatgtagactgtagagtcgcgggtgtatttaattttgcccttcttttggaggggcagaatcacaatacgcgtgattggatacctggccgcgtgcgtctgggctctccacattccgttaaaaaaaaaaaaaaaaaaa

SEQ ID NO: 270 - DNA, 988 bp, Zea mays
  CDS (202)..(756)
ccaggccatcaggttatcgagaaagctctcgtctcttccatttctaggctagcctaggtctggaccagttaggcacgcaagtatcaatcgattcataagaggaggaggccattgagggagccaagtagaaggcagtcacggcaaaccacgtatcttgttgttagaaagctggtgagcaactttgtcaagcctcaagagctcatggaagatggcagtgctccaagacggtctactccacccgcccgcagaagcagatctgctgagttccacaatttttcagaaaggaggagaagggataagatcaacgagaagctgaaagcattacaggagcttcttccaaactgcaacaagaccgacaaagtttcgatgctagacgaagcaatcgactacctaaaatcacttcagctacagcttcagatgctggtcatggggaagggaatgtcaccagtggttccacttgagctgcagcaatacatgcattacatcacggctgaccctgcgcagttgcctccgttgcgcccctccggccagcagcaccggcaatttcagataactcaagccaatccccagagacaatctaacgtcgagtcggatttcttgagccagatgcagaacttgcactcttctgagccgcctcagaactttctcaggccaccgaaattgcaactttatacaccggaacagaggggtggcctacccagcacgagccacaacactggatggatttctgggagttcctcgtataacttcatggagtgatgtgctcctaatgacaaaatttgacacggcaagcgtgcaggcgtgcagccttgtactggcaagagattattcagtttgggacctgcagcatggttcacctgagagaattccatgaatgtgtagtactagttaactagctagctagttgtgttattaaataaaacgttgtgattgtgatgctgctcaaaaaaaaaaaaaaaaaaaaaaaaaaaaaaaaaaaaaaaaaaaa

SEQ ID NO: 271 - DNA, 2396 bp, Zea mays
  CDS (441)..(2102)
aacaattcgcccttactactatagggctcgagcggccgcccgggcaggtgccaccactaccagcctgcccgtgccgtgcccacgccccactgcacagcgcaccatccgcgcctcttctcttctcttctcctccccaaggccaagccccagccccagctaccgcgccccctcctgtctgttccaattccaccagcgtcggcctagctacctggccgtcccctctccgagtacggtcggaagcctcagctgaaggatctggacgacgggacaggttctgtttggtcttcataaagtagagcactagctagaagacatattcacacgcatcagctatcaaattgcaagcttagaattgacctcaaagttgggacatgcttgtcttaccagaagcaactgatagcttggagttgtagtccgtccggactgtctgctggaccagtatggctgacactccaacttcccgcatggtgcacccctttggcgacgtcccaaggcagactcccaagcaattcctgtattctggcaacccgcagcacctctgccatccgtaccagtcagctccggacacccatgtcgtgccgcagcgctgttacaccgtgaggtctcagtctcactcgccaaataatgctggttctcaagaccatgagactcacaagcagtacacgctggagtcctcggcggcttccggttgttcaaggcatggttctccctccagccaaagcgtccatgccgggagtggcagccctgtgtctcacgacgacagccactccggctccacgaacggccatggatcacctgtgagcgcgtcgtgtgtcaccggcgaggaccctactgatctcaagcagaaactgaaggatcttgaggctgtaatgctggggacgtctgagactgaccccgagatagtcaacagtctcgagatctccgcggcaaaccaactctcgttggagcccgaggagtgggagcacatggtgagcatgcccagagggaacctgaaggagctgctgattgcctgcgctagggcagtggaacgtaacaacagctacgccattgatctgatgatcccagagctgaggaagatggtttcggtgtccggcgagccgcttgagaggctgggagcctacatggtggaaggtcttgttgccaggctcgcggcctccggcagctcaatctacaaggctttgaagtgtaaggagcccaggagctctgatctcctctcctacatgcacttcctgtatgaggcctgcccctacttcaagttcggctacatgtcagccaacggcgcgatcgcggaggccatcaagggagaggacaggatccatatcatcgacttccacatcgcgcaaggggctcagtgggtctctctcctccaagcccttgcagccaggcctggcgggccaccgttcgtgagggtcaccggcattgatgattcagtctcagcttacgctcgaggcggcggtctggagttggttggcaggaggttgacacatattgctggcctctacaaggtgccctttcagttcgacgcagtcgctatctcaggcagtgaggtggaggaggagcatctaggcgtcgtcccaggcgaagccgtcgccgtcaacttcacccttgagctgcaccacatccccgacgagaccgtgagcacggcgaaccaccgggaccggatcctgaggctggtgaagggcctgtcgcccaaggtgctcacgctggtggagcaggagtccaacaccaacacggcccccttcgcgcagcggttcgcagagacgctggactactacacggccatcttcgagtccatcgacctggcgctgccgagggacgacagggagcggatcaacatcgagcagcactgcctggcccgggagatcgtgaacctggtggcctgcgagggcgaggagcgggtggagcggcacgaggtgttcggcaagtggaaggcgcggctgatgatggccgggttcagcccgtccccgctcagcgcgctggtgaacgccaccatcaagacgctgctgcagagctactcgccggactacaagctcgccgagagggacggcgtgctctacctcggctggaagaacaggcccctgatcgtctcatcggcatggcactagtgttgacttcagagaatgttgacctgatggagaatgtttcttgtaaccttcgaagtacctcttagtggtttagatatgtttggctggtcactggaactatctataggaagcctatggtgatagatactgagttgtagtagaacacatatagcctaaatgcctaatgctgtgatggcagtcactaccagcctagcctagaacaggttgatgatgtgtagtagtaagtttgggtatatgtttcagttaatcagtttaaaaaaaaaaaaaaaaaaaaaaaaaaaaaaaaaaaaa

SEQ ID NO: 272 - DNA, 2181 bp, Zea mays
  CDS (191)..(1900)
ccatcctaatacgactactatagggctcgagcggccgcccgggcaggtacacaaacgctagagagagagagagagagctggtggccggtgggacgtccgtggtggtggtggagttggatcggctgtgcttgttcctcgcttcttgctggatcagaggaggtcatgatcaactaatgcctattcatttattatggacttgcaccagttgttaaagtacagattaactggtgctaacgtctactacgaatttcctacagagaacaacttagcaaacactccttggccagctagtccactgaagtctgagttcagcagctcatcatacactcctctttcatcccagcttgagtgtgataatttgtctgcgctcagcaatactccagataaccagagctccacagaaaccatttcagcacaaccaatatcaccactggaagtagacagctcattcaaacaggcagctatccttcgggagaacacccaagtgagacctgatccattgtacacaacatcaaggcataatatgcaacacgctttacgagaaatagagactgttctgatggcacctgatgctgatgatgcagccactagcaccaagcatgaaattgaggaacataaacctgctcagctgatgaggcagcggtcaaggacatggagtcatgaatctaggcagccatcaccaggagttgtacggacacaacttgcatctggataccccacagcaagctatgagttccgcccagagaaacggctaagggagttaagggaggatccgcagagcatggtgaagcagctattaaccaagtgtgctgaagcattaagtgaggagaggatagaggagttccttaaccttgttcagcaagctcgtggagttgtatcaattactggggagccaatccagcggttaggtgcttacctccttgagggtttggttgctagacatgcaaactcaggtacaaacatatatcgtgccctgaagtgccgtgagccagagagtaatgaactcttgtcttacatgaagattctgtataacatctgtccgtactcgaagtttgggtatatggctgccaatggggcaattgcagaggcattaagaaatgaggacaggatccatattattgatttccagattgcccaagggacacagtggataacactgatacaagcgctagctgcaaggcccgggggtccaccacacgtgcggatcactggaatagatgacccagtgtcagagtatgcccgtggtgaaggtctggaccttgtagggaagatgttgaaaagcatgtctgaggaattcaggatacctttggagtttacccctctgcccggtatttacgcaactcaagttacaaaagaaatgctggacattaggtcaggcgaagcacttgctgtcaacttcactctgcagctgcaccacaccccggacgagagcgtggacgtgaacaacccacgggacgggctactccggatggtgaaaggcctgtctccgaaggtgaccacgcttgtggagcaggagtcgcacaccaacacgaccccgttcttgatgcggttcaccgagaccttggactactattcggccatgttcgagtcaatcgacacgaacctgccacgggacaacaaggagcggatcaacgtggagcagcactgtcttgccaaggacatcgtgaacatcatcgcctgcgaggggaaggaccgggtggagcgtcacgagctcctgggcaaatggcggtcgaggctgaccatggccgggttcagaccatacccgttgagctcgtacgtgaactcggtgatcaggaagctccttgcctgctactcggacaagtacaccctggaagagaaggatggcgcgatgctgctcggctggaagaacaggaagttgatatctgcttctgcttggcactgacagtaacgttttcagaagaccggaagtacacgtcaactcttacatatatgtatgtatgtatgtataatgaattacctggtctgctttccgcaaaaaaggacgccctttgttgtacatgtacatgatgctgtacccttagttttcctgaagtgcagaccagagaagagaatattgacattagattgtagctgctaagctgtatggtaattacagtttttcttttgctctcatgtattcacccctgtcatggacttcaaaaaaaaaaaaaaaaaaaaaag

SEQ ID NO: 273 - DNA, 4014 bp, Zea mays
  CDS (133)..(3495)
acgagcgcatgactccccgccgctgaactgaatcggtcctgggctggttttcggcttttgcgcgactgggcccgtgcgccgtgaccttattgcgcgggcgccgcgcggtttgcgcagggtaggtttggtgcgatggaaggggcggcggcggcggaggtgggcggcggcggcgaggatgtgcagatcaagggcgccaaggagagtgggcagcccgcggcggcggcgcagcagccgccgccgctgccgtccggcagcgaggcgctggagatgccggccacgccgcttccgcgggacatggactggtccgagcacttctccttcttcacctcgccgggcgggttcgcgggcagctcggagggcgcgaggggcctcgccagcgtcggcctgtccaactccgagtccaggccggacagcgtgacgcagcgcggcgtggaccacggcgcggaagagagggtggaggagctcacattgaagaactgcattagcgctgatgctgcccagcccgaagcctctgctggtgggagcacgagcggtggggataggcctgctgttattaagggcctgtggggtaacttcacacggatggcccggagaaccagctatttggccagcagggaaaacgccgcactgagctatggcgacattgcaagctcgagggctggtgatgcttctagcagggaaaatctggcgacgagccttgccaacaatatcatctcaaggaacaacgatgtgtctggcaatgaggcacctacgagtcgtgtcggatatgtgaataatgagttcaagacgccatttcacagccagcagattctcttgtccccttggtctaatcaggacaacgctcttaaagtaagcagcttctcgaataggattcttgatcagatgagaagtaagactgtggcacccccatctggggttctagggtcaccgcttaaaagcaaatcaaaaggtaaaggggttgcataccaacgtgcacgggaggagatccgagtgcaagctaatgcaagacccagagaccctctggacaagatcccgacaattcctacctcaattcatgattctgtggccagagtggacatgcttttcagtactagtggagatgtttcaaaatcccactctgagggaactagcctgagggaactgattaagcctgggcggcaaacgatgtccaagtttgagaaattgcatttgtttaagcagatccttgatcttgtggataactgtcatgcacagggttttactttacaacatttgcgaccatcatattttacgatcctatcttcaaatcaagttaaatatatcggttcttataccacacaagatttgccaacatcaatcaaacaagagtttgctagagaagatcttgtgagtagaaaaagagcttttggccatagaattgattaccaagactctaatggccatggaaatttgatgctgaagcatcaaaaggttggtgagcaaggcttagttgctgtcaggcggctggcaaatacatttttgactgacaaaatacgcgacaatcaaattgaagataacgatccaggtatttcaaggcaagaaaattttagttacactaccagagaacattttaagttcgtcgaatcatatggcagcaatatgtccagtgctcagcatgtatctagttctggaacccaacaaccagcatttgaattgaggaatattgaggaaagctggtacaaaagcccagaggagctcagtcaatttaaaggcacacccccatcaaacatctatagccttggggttcttctatttgagctcttttgctgttctgagacatgggagatgcactgtgctgcaatgtcaaatcttcgccaacgcatccttcctccaaattttctttcagaaagtcccaaggaggctggcttctgcctttggttactgcatccagatccttgttcaagaccaaaagcaaaagagattcttggatgtgacttgataaatgagggtcgggatttgtccttgttagataagtcaccagtttccatcagtgaagatgacactgaatctagtttgctacttaacttcctttctcaattgaaagaagaaaaggagatgcaggctgccaagttatcggcagagcttggaagcttacaaacagatatcacagagattgacagaagacactcagcaggaatgagattgagtttagaggatatggatgtactgccaagttctagtttgccaggagcttctgtgagtgccctacagggtgcattgctgtcaggtttgctaccggcatcgtgcaagtcgagcatatatgaggagagggtaatgaggaatttggtgcagcttgaaaatgcttactactccatgaggtcctctgtggacacctgtgaaactaatgtaatcaaacgtccagataacgaggctttgagggtccgtgaaaatttccatcagcgtcacagtgattctgatgcaaagggagagaaaacagaccgtcttggatgcttttttgatggtttatgcaaatatgcccggcacaataggtttgaagtacgaggaattttgaagaatgcagatgtacttagctctccaaatgtcatctgttcattgagttttgatagggatgaagaatattttgctgctgctggagtttcaaagaaaataaaaatatttgaatttgatgcactcttaaatgatcgtgttgatattcattacccactggtagaaatgcctagcaagtccaagctgagctgtgtctgttggaacagctatataaagaactacctggcatcaacagactatgatggtactgttcagctatgggatgctggctctggtcaaggattcacacagtttacagagcaccgcaaaagggcttggtctgtgagtttttcacaagtcgaccctactaagttggcaagtggcagtgatgattgttgcgtgaaagtatggagtattaatcagaaaaactctattgatacaatccgaaacgtggccaatgtatgctgtgtacaattctctccatactcctcccgcatgctagcttttggttcagctgattacaaaatatactgttatgatctgaggaacacaaggataccttggtgtactatttcgggacatggaaaggctgtcagttatgtaaggttcttggatccagaaacacttatctctgcatcaaccgacaacacattgaagatatgggatcttaaccagactaattgcagtggattatctgctgattcttgcagcctgactctgaatggtcatagcaacgagaagaattttgtagggctatctgttcatgatggatacataacttgtggctctgaaaccaatgaagtgttttcttactacaaagatttccccatgccaataacttctcataggtttggttccattgacccgataactggacaagtgacaaatgaagacaaccagcagtttgtgtcgagtgtttgctggagagggaagtcaaacatggtagtggctgccaactccagtggcagcatcaaagtgcttgagcttgtgtgaatgatccaacgagagtgtcatattggagagaagaaggttctagggttgccatgcgggcctgtgatgctctcgtgccctcggtgatgctccaatggccctgcttatccggtgtctgcatcctcaatggaagcactaagcgaactgggtacctcttctaggtctgcatttcactgttttgccagggcactaaaagatgcgactgctctgtgcaagcaacctacagcaccgatcattggtcattattggaagctttgcttgaaactcccaagcgaaccaaagaaaaataaaataaaatcaagagtatgttgtgtttggaaatctctggcattttggcacggtaccttattcatcatcgtaaggagggccccaggtctgtacagaattagggggccatggggctgatgaaatagaacatgtgatcatgcaaacttcttttgggctagagaggctgacggacgccgtggcgccttactgaatcagttgggaatttaactcagttttgatgtgcgccggact

SEQ ID NO: 274 - DNA, 1455 bp, Zea mays
  CDS (173)..(856)
ggcgccaacaaaagaggaagagtcaggccgaatgttctgcaagtcaagacgatgtaagcagaggatctgagatagggagtcggtggtatgtggctacgcacaccttgtacttactgctaacaattcgtaaaaaaatggttttgttcaggatcttgatgatgagtctggtgggatgcgaggatcaggcggcagaggtacgaagcgcagccgcaccgcggaggtgcacaatttgtccgaaaggaggagaagggacaggatcaatgagaaaatgcgcgccctgcaagagctcatccccaactgcaacaagattgacaaagcctccatgctggatgaagcgattgagtacctcaaaaccctccagcttcaagttcagatgatggccatgggaagtggactgtgcattcctcccatgctgctgccgcgagccatgcagctgcaaattccttcaattgctcatttccatcatctcggcatgggattgggttatgggatgggtgtcctcgatatgaacagcacagcggcagttccatttcagcccatccctggcgctcactatacttgtccgatgatcccaggcacgccaccacaaggtcttggaattggaatgcctggcacaaacacgatgccagtgtttggagtccctgggcaagcaatccatccctcagcgtctagcgtacagccattcccatcgttggcgggtcttcctgttaggccaaacctggcacctcaagtcccagccgtcatggctaacatggtgcaggagcaacagcaaggcgtagcgactcagcagcagcagagtctgaataatgaagctcaacagaaagcaaataccggagatccacaaatactacaaaaatagatgaagagatcttcgccagtaatcagtttctggatggtggtggcaacaggactaatactataggggaaaatgaggctgaaacattaaaaacggtcagcaagtgccagtgtgtaacctgactcgagctaaacttgacacaaatcatggaacttggcagagcgttattatcctaatagataacatggctgatgattttcaggtctcgactaacaagctgcaggtgtgaatatcagcaccaactcatcatggaagagcttaacaagtttcatgattcacgaagcagatctatcacttgaaaaaggtccaatcaatcaagatgtatttggtggcgggatgtctagcttagcgagataagatgctccaaagttttgtgtaaaatgtagatggaaccttgttacaagtaacatttcttgacagcggtgccgttttcaggtgtttttttttttgcttcactgaagttttcttgagtcaatatatcttattttcccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 275 - DNA, 1355 bp, Glycine max
  CDS (78)..(932)
attcggctcgagtctcactcttcttgcagcatctctctccattaccttcataactcaatctcccattattattagagatgacggttgaaaaggaagatttgggtttgagtctaagcttgagcttccctcagaaccccccaactcatcttcatctcaatctcgtttcctcttctccttccagccacaaccctcagaaaccctcttggaacgaccctttcacttcttcagctggatcatcattccttcgaggaatcgatgtgaaccgtttaccttctgtggtcgattgcgaagaggaagcaggtgtgtcatctccaaacagcacggtttctagtgtcagtggaaaacgtagcgagagggaagaagccaatggtgaagaaaacgacacagacagagcttgttccagaggcatcatcagcgacgaagaagatgccgaaacctctagaaagaaacttagactctccaaagaccaatcaattatcctcgaagagagcttcaaagaacacaacactctcaaccccaaacaaaagttggcgctggcgaaacagctgggtcttcgagcgagacaagtggaggtgtggttccagaacagaagggcaaggaccaagctgaagcaaacggaagttgactgtgagtttttgaaaaggtgctgcgagaatctgaccgtggagaacaggaggttgcagaaggaagtgcaagagcttagagcactgaaactttccccgcagttctacatgcacatgaccccacccaccactctcaccatgtgcccctcgtgtgagcgtgtcgcggttcccccctcctccgccgttgatcctgccatgcgtcaccatcacgtgcctcctacacaacctcgggccttccccattggcccatgggccaccgctgccgccactatcccgcacaggcccttcgatgccctccgtcgcagatcttgactcgtcgaaacaaaatgacaaaatttgaaaaaaagaaaacggttgtaatagtaggaagccatgaattatgtgttcaaagtgtggtctaagatatggtggttaggaaaactgattttgtgggtctctaatgttttgtactagtttgacccttcgtctttgttttgggtttcggagcatgacctggtttagttagttagaggtttttttagtttgtaatacttactgcgttactctcatttctcatgattaaatcggagattctgtaaagttcagtagtcttaataaatattatatattacatataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 276 - DNA, 2527 bp, Zea mays
  CDS (44)..(1954)
cccacgcgtccgcttcactcccaatccgaatccagatccgcgaatgctggggcgggcggcggcactgtccgcgccacggtggcgcggcggggtgccagaccttcgcgccgcgctgcggtcggggggcaacctcctcttcgcgctcttcgtggcggccgtgctcgcattcacgctcctcgcggcgttccacagccccgacgatccgctcctccacccgtcctctcaccagctcaccgatttcctcacctccgccacttccacctccaccttcctcactgacgactccgtgctgcgcaccggggaggacttcaactcctcgtccaccggcgccgccggcgaggtcgccgctgggggtgtcgaagtcgtcgcggaggccgtcccgttcatcaagctctccgaagttggcgccgaggccgagaagacggagcccgagacggagcgggccgtcaccgtcgacactgatgcggccacgggcgagggtgcagcggtggcggaggaaaccgccgttgcggaggcggtttcctgcgacacggaggcgcccgtggactgcacaggagacagggaactcttcaacctgctcatgcgcgcggccatcgagcggttccccgacctccacttctaccgctttggccgtcccgtggcggtgccggggagtcccatggagtgtgacctcgcgtggcgcttccgccccgctgccgacgccatcggcaccggccggaccacatactacaaggactaccgccggttcacgcttacccgcgacgtcaacacctgcagcctcgtcgtcgacaccgtgggtgaataccactcgggtgtgggtgccaagcgcaatggacggcgcaaggggaagaaagggaagaagggaaagcaggatgcacctgtgactgacttcgtgccggttaagacacagattaggctggacgagaacaccgccaacaatgaggctgctggggctgcagcggagccggtgtttgttgttggtgaggctgtcaatgacagcttgccagtggttgcttctgagtctgatttcagccgtggtaagtaccttatttacattggtggtggcgagaggtgcaagagcatgaaccatttcatttgggggttcttgtgtgcccttggtgaggcacaattcttgaaccggactcttgtcatggacttgaatgtctgcctcaatgcacggtatacttcgagtggcaaggatgaagaaagagatttcaggctctactttgattttgagcatttgaagcaatctgcgtccgtgattgaccagagccagttctggcaagattggggacagtggcacaagaaagataggctcaagaacttctacactgaagacatcaggatgaccccaatgaaacttcgtgacatcaaggacacattgatcatgaggaagtttgggaatgttgagcctgataactattggtcacgtgtgtgcgagggtgagactgagggaataatcaagcgcccatggcatttcctgtggaaatctcgtcgcttgatggagattgtatctgccattgcctcacggatgaactgggactttgactcggtccatgttgtcagaggggagaaagcgcagaacacacaactttggccaaaccttgacagagatacctcaccagacagtctccttatggcacttaatgataaggttggtgctggccggtatttgtacattgctaccaatgaacctgacaaatcgttctttaacccactcaaggaaaagtataaaacacacttccttgatgatttcaagtacctgtgggatgagaatagtgagtggttcactgaaactaaggagctgagcaatggtcagccagtagaatttgatggctatatgaggattgcagttgacactgaggtattcttgagggggaagaggcatgtggagacattcaacgagcttacacgtgattgcaaggatggcgtgaatacatgctcagcttcttcctgaacatttggtgggctaaggaaccttggagaggactagtaaggacttgggaaaggccaagatgtcaaggacgagaagctaggatattcacaacaagagaaatccaagtctgactcaacttcgtctccacctcgaagtctaggactagtctacactaaaacagacgcccaagatgcatccgaactccgattaggttatgctttatatggatggaaacctaaggagatacgctttccaacccaactggaatcaccttaaaattcatccggagtcaacaggaatcgtcgaaacaagttagcgttcagattctgttttagtgttgcaacaccgtatgttgggctgttgggccatgtatcgtgttggagcatattagggatgcaaccaaaggtcatgcacgcccctaatctctattttatcagcaaccaccaccatattagtgtttgggttttgcttagatcatatttgtcatctaagaatttgtcgttcatcagtttgtgataccccaactcgtaatcaacacagttttggttgtgttctttcaaaaaaaaaaaaaaaaaaaaaaaaaaaaaaaaa

SEQ ID NO: 277 - DNA, 2016 bp, Glycine max
  CDS (42)..(1820)
cctcaatttaattcccattccctctctcagaactcatcatcatggccgttgattctgaggtccctcgtgccgagaggagcgcaaaggctcttcagttcatcgaggaagttacaaaaaacactgactccgtccaggagagagtcctcaccgagattctcacccaaaacgccgagacggagtacctcaaacgcttcggcctcaacggcgccaccgaccgtgacactttcaagtccaaggttcccgtcgtgacctacgaggatctgcaacctgatattcagcgcattgcaaatggtgacagctctcccatcttgtgctctcacccaatctctgagtttctcaccagttctggaacatctgccggcgagagaaagttgatgccaaccattcatgaagaaatggaccgtcgtcagttactgtacagcctgctcatgcctgtgatgaaccaatacgtgtctgatttggacaaaggcaaggcgcttcacttcctgttcattaaggcagaggccaagacacccggcgggttagtggcgcgtccagtgctgacaagctactacaagagcgagcaattcaggaaaagaccattcgacccttacaacgtcctcactagccccaacgaagccatcctttgccccgattccttccagagcatgtacactcagatgctctgcggcctcatcatgcgccacgaggttctccgtgtcggagccgtcttcgcctccggccttctccgtgccataaggttccttcagctcaattgggaacaactttcccatgatatcctcaccggaaccctaaacccaaagatcactgaaccttccatcaaggaacgcatgtccaagatcttgaaacccgaccctcaactcgccgctttcattaaaaacgaatgctccgtggaaaactgggagcgtataattgtgaggatttggcctaacacaaaataccttgacgttatagtcactggagccatggctcagtatattcccacactcgattactacagtggtggcctacctaaaccctgtaccatgtacgcttcttctgagtgttttttcggcctcaacctcaaacccatgtccgaaccctctgacgtgtcttacaccattttacccaacatgggttacttcgagtttttaccccatgatgattcctctcctgttactctctccaaggactcaccgcctcgcttggtggaactcgctgacgtggaacttggtaaatactatgaactcattatcaccacctattcaggtctttgccgttacagggtcggtgacatactccaagtaactggtttccacaactccgaccctcaattccgtttcgtgaggcgaaagaacgttttgctgagcattgactcggacaaaaccgatgaagcggaactgcaaaaggccatcgagaatgcctcggagttgctgaaggagttcaataccagcgttgtggagtacacgagcttcgctgacacgaaatccattccggggcattacgtgatttactgggagctcatgatgaaggactcgtctcaccctccaacgaaccaagttctgaaccagtgctgcttggtgatggaagagtcgctgaactcggtttatagacaagggagagttgcggataactctattgggccgttggagatacgagtggtgaagaatggaacgtttgaggagttgatggactacgctatctcgcgtggtgcgtcgataaaccagtacaaagtgccaaggtgcgtgagcttcacgcccataatggagctacttgactctagggtggtttcttttcattttagcccagctgcaccgcactggaccccagaacgtcgtcgttgaaggaagctagggtaacgtacagcaataacatgcagtagtcatgcataagatctagtataataataaagagagaaaaaatgggtgacagaaaagggtagttgttcattgttgttgttatattatcactgccaaacccgaaagtgtctgtatttgttgatttgatatttccaatgagcttgtttttttcaaaaaa

SEQ ID NO: 278 - DNA, 2768 bp, Zea mays
  CDS (104)..(2467)
gcggagcagtgcatggaggtggaggaggtgcgggaactcggcgaaatcggaaggtgatcccggtcatgggatagagtggagtggagggggttgagtgtgtggtatggagccgtcccgtggcggtgttggcggcggcgggcggcggtggggggaggcggagggtgatgcggcggaggaagggagacgaggggaggacgggggcgaggtgagcctgcgggagtggctggaccggccgggccgagcggtggaggcggcagagtgcgtgcacgtgttcaggcaggtggcggaggcggtggccgtcgcgcacgcgcagggggtggccgtgggcagcgcgcggccgtcgtgcttcgtcgtgtcgccgcccttcgcgcgcgtcgccttcatcgagtccgcctccggctccgacgcctcgggctcgtgctcgggctctgacgcctccgaggacgccgacggcgacccggacccggacccggacgcctcgcctccgctgcggcgacgcgacagcgccgtccccggcgaggagcgcgcggggaggtcgttcccgctcaagagcgtgctggccatggagctcagctggtacaccagccctgaggatgcggacgacagcgccgctaccttcgcctctgacgtctacagactgggtgtgctcttgttcgagctgttctatacattcgaaacgatggaggacaagatgcgggcaatggcgaatctgcggcaccgggtgttgccaccgcagttgctgttcaaatggcccaaggaagcatccttctgccagttgctaatgcaccctgtgccagaaaccagaccgaagatgagtgaggtgctgcagagtgagttccttaatcagtcaaggaatagcttggaagagcatgaagcggcacttaggttacgcgaagagatagaagaacaagaattattgctggattttcttcagcagttgcagaaaagaaagcaagatatagccgacagtttgcagggcactattgctttcctctcttctgacatcaatgaggtaccccaccagcaatctgcaattggccactgtgagaacttcttatccgattgggataaagaggtgtgctctggaactgttgaagaacagagtgattgtggatccaggaagcgttttagacctgagctgcaaggtgttgatatggaggaaaataatcgtagtgttgaagaatgttccagaacagtaccatcctctgagttaatccaggaaagtgttctgtctaaaagctccaggttgatgaagaacttcaaaaaacttgaaacagcctattttctaacaaggtccaagttgatgaagcaagttggcagccaaataagtagctgtgatcgagttgttaagaacactactggttcagctgttgggactgagggaagttcattagatgatttttcactggaaaggcaatatggtacaaggcaaagaggttgggtaaactcttttcttgaaggattgtgcaagtatttgtcattcagtaagttgaaagttcaggcagaactgaagcattgtgatttgctgaactcgtcaaacttagtatgctccgtagggtttgaccgagatagagagttttttgcaactgcaggtgtaaataagaagataaaagtgtttgagtataatatgattgtaaatgaacaccgtgatattcactatcctgtagtagagatgtctaatagatcaaagttgagttgtatttgctggaacagttatatgaagagtcatattgcatctagtgattttgagggtatagtacaggtttgggatgttactaggagtcaagtttttgttgggatgagggagcatgagcgacgcgtgtggtcggtggacttctcaattgtggacccaacaaaattggtcagtgggagtgatgatggatctgtgaaactgtgggatatgaatcaggctgggagtattggcactattagaacaagagcaaatgtgtgttctgtacaatttcaacctgatactgctcgctccattgccatcggctctgcagaccacaaaatttactgctatgatctacgtaacatacgagctccttattgtacactagttggccacacaaagactgtaagctatgttaagtatctggatgcatcaacaatactatccgcatctactgacaactcattgaagctttgggacttatcgatgaatccaggaaggataattgacagtccagttcaaacatttacagggcatacaaatacaaagaacttcgttggtctttccatatctgatggttacattgctactggctctgaaacaaatgaggtttttgtctaccacaaagaatttcccatgccagtgttggcttataagttcagcgtgacggaccctatatcgggacaggagattgatgatcagtcacagttcatttcatgcgtctgctggagagggcagtcttcaactctactttctgcaaattccagcggcaacattaagatcttagaaatggactgaggagtttgcatctgtttgagtctcagctataaatagaccgacttcttaggccgtgctcaacaaatcatgcatatagccgtggtagatgtcactgtctagggagtggagttttaaatgggagattggatgggtaatgctgctagagatagcttaccaagttgtgcgcgtgcgtggcttcaaaattcgtggcgattaaatccagagttgccaacggtgcagcttaatccgagttgcagagttgggaaaggtagtagctgtagcagatttagcgtggttttataggattacagattagcgt

SEQ ID NO: 279 - DNA, 7974 bp, Saccharomyces cerevisiae
  CDS (302)..(7714)
ggtaccattgtccatgacaacagcgggattgtttaagtatgacattgaatcctaatttcttgctcaatcgtgaggccttacggtagggccaattcttgattaaactactctcatatatttttgtttgaaacttttgaaaaggggttctcgccattttgaagccgcggacaccgggtgactactgaaagtccttatcgaagggtcttcttgagcttacgttaaaaaagagccatagtagcttcacgagagagtcattggtaaagtgaaacatacatcaaccggctagcaggtttgcattgatatggaaccgcatgaggagcagatttggaagagtaaacttttgaaagcggctaacaacgatatggacatggatagaaatgtgccgttggcaccgaatctgaatgtgaatatgaacatgaaaatgaatgcgagcaggaacggggatgaattcggtctgacttctagtaggtttgatggagtggtgattggcagtaatggggatgtaaattttaagcccattttggagaaaattttccgcgaattaaccagtgattacaaggaggaacgaaaattggccagtatttcattatttgatctactagtatccttggaacatgaattgtcgatagaagagttccaagcagtttcaaatgacataaacaataagattttggagctggtccatacaaaaaaaacgagcactagggtaggggctgttctatccatagacactttgatttcattctacgcatatactgaaaggttgcctaacgaaacttcacgactggctggttaccttcgagggctaataccttctaatgatgtagaggtcatgagactcgctgcaaagactctgggcaagttagccgttccaggaggtacatatacctctgatttcgtggaatttgagataaagtcttgcctagaatggcttactgcctccacggaaaagaattcattctcgagttcgaagccagaccatgctaaacatcgtgcgcttctgattataacagcgttggcagagaattgtccttatttactctaccaatacttgaattccatactagataacatttggagagcactaagagacccacatttggtgatcagaattgatgcgtccattacattggccaaatgtctttccaccctacgaaatagggatcctcagttaactagccagtgggtgcagagattggctacaagttgtgaatacggatttcaagtaaacacattagaatgcatccatgcaagtttgttggtttataaggaaatcttgtttttgaaggatccctttttgaatcaagtgttcgaccaaatgtgtctaaattgcatagcttatgaaaatcataaagcgaaaatgattagagaaaagatttaccagattgttcccctattagcatcgttcaatcctcaattatttgctggcaaatatttgcaccaaattatggacaactatttagagattttaaccaatgctccagcaaagaaaataccacatctcaaagatgacaaaccacagattttaatatcgattggtgatattgcatatgaagtcgggcccgatatcgcaccttatgtgaaacaaattcttgattatattgaacatgatttacagacgaaattcaaattcagaaagaaatttgaaaatgaaattttctactgcatcggaagattggcagttcccttgggccccgttctaggtaaattattaaacagaaatatactggacctgatgttcaaatgccctctttccgactatatgcaggaaacgtttcaaattctgactgagagaataccatcactaggccccaaaataaatgacgagttgcttaacctagtctgttcaaccttatctggaacaccatttatccagccagggtcaccaatggagataccatcgttttcgagagaaagagcaagagaatggagaaataaaagcatcctacagaaaactggtgaaagtaacgatgataataatgatataaaaatcattatacaagcttttagaatgttaaaaaatatcaaaagcagattttcgttggtagaattcgtgagaattgttgcactttcttacattgagcatacagatcccagagtaaggaaactagctgcgttgacatcttgtgaaatttacgtcaaggataacatctgcaaacaaacatcactacactctctgaacactgtatctgaagtgttatcaaagcttctagccattacgattgcagaccctttacaagatatccgtttagaagttttaaagaatcttaatccatgtttcgatccccagttggcacaaccagataatttgagactcttgtttattgcactgcacgatgagtcgttcaatattcagtcagtagcaatggagcttgtcggtaggttgtcttccgtaaaccctgcatacgtcatcccatcgataagaaaaatactactggaactgctaacaaaattaaaattctcaacttcttctcgagaaaaggaagaaactgccagtttgttatgtactcttatcaggtcgagtaaagatgttgcgaaaccttatatcgaacctcttttaaatgttcttttaccaaaattccaagatacctcttcaacggttgcatcaactgcactgagaactataggtgagctatctgttgtagggggcgaagatatgaagatatatcttaaggatttgtttcctttaattatcaaaacatttcaggatcaatcaaactctttcaagagagaagctgcacttaaggcccttggtcaacttgcagcctcatctggttacgtgatagatcctttactcgactatcccgaattattgggtatattggtgaatatattgaagacagaaaactctcaaaatattaggagacaaacagtcactttgataggtatactgggagctatcgacccatatcgccaaaaagaacgtgaggttacctctactaccgatatatctacagaacagaacgccccgcctatcgacattgctcttctcatgcagggcatgtctccttcgaatgatgagtattataccactgttgtcattcactgcctgctaaaaatcctaaaagatccatccctatcatcttaccacactgccgtgatccaagcgattatgcatatttttcaaacccttggtctaaaatgtgtttcattcttggaccagatcatcccaactattttggacgtaatgcgtacatgctctcagtcactattagaattttacttccaacagctttgctctttgattattatcgtaaggcaacacataagacctcatgtcgattctatattccaggctatcaaagatttttcttcggttgctaagctacaaataacgcttgtaagtgttattgaagcaatatcaaaggctctggagggtgaattcaaaagattggtccctcttactctgaccttgttccttgtaattttggagaatgacaagtctagtgacaaggtcctctccagaagggtattgagactgttagaatcgtttggtcctaacttagaaggttattcgcatttgattacacccaagatagttcaaatggcagaattcaccagcgggaacctacaaaggtctgcaataattactattggcaaactggccaaggatgttgacctttttgagatgtcctcaagaattgttcactctttacttagggtactaagttcaacaacgagtgacgaactctcaaaagtcattatgaatactttaagtctactgctaatacaaatgggcacatcctttgctatcttcatccctgtcattaatgaagttttaatgaagaaacatattcaacacacaatatatgatgacttgacaaacagaatattaaacaatgatgttttacccacaaaaattcttgaagcaaatacaacggattataagcccgcggaacaaatggaggcagcagatgctggggtcgcaaaattacctataaaccaatcagttttgaaaagtgcatggaattctagccaacaaagaactaaagaagattggcaggaatggagcaaacgtctatccattcaattattaaaagagtcaccctcccatgctctaagagcttgttcaaatcttgcaagcatgtattatccactagccaaagaactttttaataccgcattcgcatgtgtttggaccgaactttatagccaatatcaagaagatttaattgagtcattatgtatagccttatcttctcccttaaatccaccagaaatacatcaaacattgttaaacctggtagaatttatggaacacgatgacaaggcattaccaataccaactcaaagcctgggcgagtatgctgaaagatgtcacgcctatgccaaagcgctacattataaagagattaaatttattaaagagcctgagaactcaactattgaatcattgatcagcattaacaaccagctgaatcaaacggatgctgcaattggtatattaaagcatgcccaacaacatcattcacttcaattaaaggagacatggtttgaaaaattagagcgttgggaagatgcactacatgcttataatgaacgtgaaaaggcaggtgatacttccgtgagcgttacactcggtaagatgagatcccttcatgcccttgcggaatgggaacagttgtcgcaattggcagctagaaagtggaaagtttcgaagctacaaactaagaagctaatagctcccttggcagctggtgctcgtgggggttcgggagagtgggatatgcttgacgaatatatcagcgttatgaaacctaaatctccagataaggaattttttgatgcaattttatacttgcacaagaatgattacgacaatgctagtaagcatatattaaacgccagagatttgcttgtgactgaaatttccgcgttgatcaatgaaagttataatagagcatatagcgttattgttagaactcaaataataacagagtttgaggaaatcatcaagtataaacaattgccacctaattccgagaaaaaacttcactatcaaaatctttggacaaaaagactgctgggctgccaaaaaaatgtcgatttatggcaaagagtgcttagaataagatcattggtaataaagcccaagcaagacctgcaaatatggataaaatttgcaaatttgtgcagaaaatctggtagaatgagactagcaaataaggcattgaacatgctactagaaggaggcacgatcctagtttaccaaatacggtcaaagcctcctcccccagttgtttacgcgcaactcaaatatatttgggctacaggagcttataaagaagcattaaaccacttgataggatttacatccaggttagcgcatgatcttggtttggatccgaataatatgatcgcgcaaagtgtcaaactctcaagtgcaagtactgctccgtatgttgaggaatacacaaaattattagctcgatgttttttaaagcaaggtgaatggagaatagcaacacaaccgaactggagaaacacaaatccggatgcaattcttggttcctatctattggctacacatttcgataaaaattggtacaaggcatggcataattgggccttagctaattttgaagtaatatccatggttcaggaagagactaagctcaacggaggtaagaatgatgatgatgatgacacggcagttaataatgataatgtgcggattgacggtagtatcctaggaagtggttctttgactattaatggcaacagatacccgctagagcttattcaaagacatgttgttccagcgatcaagggcttttttcattcaatatctctattagaaacaagttgtttgcaagacacgttgaggttatcgactcttttatttaactttggtggtattaaagaagtctcacaagccatgtatgaaggcttcaatttgatgaaaatagagaactggcttgaagtcttaccacagttgatctctcgtatacatcagccagatcctacggtgagtaattcccttttgtcgttgctttctgatttagggaaagctcatccacaagctctcgtgtatcctttaactgtcgcgatcaagtctgaatctgtttcaagacaaaaagcggctctttcaataatagagaaaattaggattcatagtccagtcctggtaaaccaggcagaattagttagtcacgagttgatcagagtagccgttctatggcacgaattatggtatgaaggactggaagatgcgagccgccaatttttcgttgaacataacatagaaaaaatgttttctactttagaacctttacataaacacttaggcaatgagcctcaaacgttaagtgaggtatcgtttcagaaatcatttggtagagatttgaacgatgcctacgaatggttgaataactacaaaaagtcaaaagacatcaataatttgaaccaagcttgggatatttattataacgtcttcagaaaaataacacgtcaaataccacagttacaaaccttagacttacagcatgtttctccccagcttctggctactcatgatctcgaattggctgttcctgggacatatttcccaggaaaacctaccattagaatagcgaagtttgagccattattttctgtgatctcttcgaagcaaaggccaagaaaattctccatcaagggtagcgacggtaaagattataaatacgttttaaagggacatgaagatataagacaagatagccttgttatgcaattatttggtctagttaacactttgttgaagaatgattcagagtgtttcaagagacatttggatatccaacaatacccggctattccattgtcgcctaaatctggtttactaggatgggtaccaaatagtgacacattccacgttttgatcagagaacaccgtgatgccaaaaaaattccgttgaacattgaacattgggttatgttacaaatggcccccgattatgagaatttgactcttttacaaaaaattgaagtattcacgtacgctttagataatacaaaaggccaagacctttataaaatattatggttaaagagtaggtcgtcagagacatggctagaacgtagaacaacttatacgagatctttagcagttatgtccatgactggttatattctgggactaggtgatcgccatccaagcaacctgatgctagatagaatcaccggtaaagttatccacattgatttcggcgattgttttgaagctgccatcttaagagaaaagtatccagaaaaagtgccatttagactaactaggatgttaacatacgcaatggaagttagtggaattgaaggcagtttccgaattacttgtgaaaatgtcatgagagtcttaagagataataaagaatcattaatggcgatcttggaagcttttgcgcttgatcctttgatccattggggattcgatttaccgccacaaaaacttactgagcaaactggaattcctttgccgttgattaatcctagtgaattattaagaaagggcgcaattactgtcgaagaagcggcaaatatggaagcagaacaacaaaatgagaccagaaacgccagagcaatgcttgttttgagacgtattacagataaattaacgggcaatgatatcaagaggttcaatgaattagacgtccctgagcaggttgataaactgatccaacaagccacttctattgaaaggttatgtcaacattatattggatggtgcccattctggtgactgcggtgtcatttttcatttcgtgctttgtttactatttattttttttgtattacgcatttgtatacgtgtgcaagtattgtgtattattattattattattatcattatttttgtaatatctcgtcattatgtgaaatgaaggatgatataaggtacataaattgttgaaatcaacaccatttaaaacaactttattggatagatggcacatcggtacttttcacaataggtattgacaatatcagtccatttgttat

SEQ ID NO: 280 - DNA, 20001 bp, Arabidopsis thaliana
  CDS (1462)..(1626), (1850)..(2188), (2267)..(2341), (2519)..(2691), (3060)..(3158), (3442)..(3634), (3703)..(3846), (3984)..(4153), (4233)..(4437), (4511)..(4699), (4907)..(5059), (5528)..(5649), (5735)..(5837), (5912)..(6007), (6309)..(6439), (7148)..(7250), (7326)..(7508), (7583)..(7675), (7914)..(8012), (8096)..(8194), (8247)..(8451), (8764)..(8888), (8999)..(9051), (9493)..(9616), (9734)..(9904), (10380)..(10532), (10599)..(10751), (11235)..(11306), (11414)..(11548), (11625)..(11686), (11819)..(11916), (12172)..(12281), (12358)..(12531), (12647)..(12712), (13059)..(13127), (13235)..(13345), (13685)..(13825), (13917)..(14045), (14168)..(14333), (14421)..(14629), (14795)..(15001), (15165)..(15278), (15383)..(15613), (15896)..(15976), (16081)..(16155), (16234)..(16300), (16400)..(16560), (16707)..(16880), (16967)..(17095), (17187)..(17270), (17379)..(17440), (17521)..(17593), (17678)..(18001), (18086)..(18385)
tgagttattttgtgtcattttaactcttttttaaatagtactcttagttgtagtttattaatttggagagaaaagaacaccaatattttcaccgacattcttgtcacgttatgggattgcgcaacgttaacacttggaccctgtctattcaccatccttgatgtgtacgatgaaaccaagcgatgctatagcctcccacaagccacaactcttttgaaattttatgttggatgtgcttcgtttaattttcgaatgtaatgcttattttgtcatacacaatcattgtgattattttcgttgtaacaacggagaaacacgaactatattttggaggagccatttctttagtttttcctatacatatgaatatgaatactacttaacatacaagcaaaacaaaaatttaccattggagaataaataatgatttctatgatttagaatttttatgaatagaaaaacaaagtttcatcacatctaacaattcaaatccactccataccaaaaaaaagaaaaacaattcaaattaactgaatgatatgattcacatttcatcaatttttcaatatatgatatatcgattaccatacaactattttacaattctactattatttgacattttttattcaaaatttgactaatattcgatatttttttgtatagatattattcctcttatttatttaatttgttgacaaacttaaccatatgcattcaattgaattttttcattttccccattatttttgttcgtaatgactactaattacaacaaaactatagtttattattttcctacaatttaatgatcattttaaaaactccttatctgcttaaaagcataattggaaataataataataaagtgaaatgacaataaaagaaaacttattcaagaaactacaaagttattccttgacaaaaaaagttattctattgtccagtgaacaaatatgagtttttgactattttttttttcacaagtaattttttttctttgacaagtgtatattaaacattctaaacattacatagcccaaacaaagaccctttcagggttttaagtaattaatcagtgacaaaaaaaaatgaaaatattgtatttataagtttttgatagacaaacataagttttacaattttccaaggaaaaagtcatattttcctagtaaaaacctttcgggttttccaatttatttaccaaagataattggtctctgaaagaacaaagcaaaacctaagaaagctaaaaagacactcagcgaattgaatttgtaaaaaaataagagaaaaaatcttgatttcttctgcgatcttcggttctcgacgcatcatgtgttgaagattcttctatcttcctctgtacatactctctctctgcccaagtgttgttgaaccaaaaaggggtcagatttagggtttttggaagatttttgtggctggactggccctgcagcgatgtctacctcgtcgcaatcttttgtggctggacggcctgcatccatggcttccccttcgcaatcgcaccgcttttgtggtccctcagccaccgcttctggtggcggaagctttgacactttgaatcgtgtcatcgctgacctttgcagccgtggtaatcctaaggtaatgaagaacattgtaaagtattctccctttttatgctttagtagaaacccatataacccttttgcttttattgcttatctgacggaatctctctgttctggttaatggaaaattcgaagttttagttcttataggtctggcaatttgtgggttttgatctattgttgttggtttccatcaagtatgcgactttgtttatgatttttggttgttgtattaggagggagctcctttagcgtttaggaaacacgtagaggaagcagttcgtgatcttagtggtgaagcttcctctaggttcatggagcaattatatgacaggattgctaatttaattgagagcactgatgtggcggaaaacatgggtgcactcagagccattgatgagttgacggagattggatttggtgagaatgctactaaggtttctagatttgcgggttacatgaggactgtgttcgagttgaagcgtgatcctgaaatcttggtgcttgctagtagagttttggggcaccttgctcgggcaggtggagcaatgacttctgatgaagtggagtttcaggtaagattgtttgtttccctccccttcctatcactgtctcggctcatagttgctcaattcttgatctcgttttcacagatgaaaacagcttttgattggcttcgcgtagacagggtggaatatcgtcgtttcgccgccgttttaatattaaaggtatcctgatttcagctgcccgatcctttagataagcagatcattttttcttttagttactcagaaagaaacttctgaactaataaattggattatagatgtttgaaaaatgatagtgatgataactttccaatcctaagttaatacggatatggatgttttcttgcaacattgcaggagatggccgaaaatgcttctactgtctttaacgttcatgtccctgaatttgtggatgctatctgggttgcacttagggacccccagttgcaagtgcgagaacgagctgttgaagctttgcgtgcatgccttcgtgttattgagaaaagggagactcgatggcgagtgcagtggtaagtattctcttatccttgaaaatgataatgtctgaaatgttttccttaggttatgtatttggtatgatatttttgatgcaaggcttttctttgtgttgttgcaatactttcatttgcaatcaccctcatttaagtactactttgtatattttattgtgtaaatgcaacttatattagctttttatgctgtggtcccccccccccccccaaaatggatgatattcgaatatatattcttcccatggtgatacgttttgcagactttctactgcatttatatatatcattgccaatgcaatgtttcaaattatcaataggggtttccatctttattaactgatcttctctcaatttggcttttacaggtactatcgaatgtttgaagctacacaggatgggttgggcagaaatgctccggttcacagtattcatggttctttacttgccgtgggggagctgttgaggtaaatgcagaagtggttatctattttgaaagcatccctttcttttagtcagacactcaagtttgattctggaatatttccgtagaacaacttgtttgtccccatgatgctcgggttgttttgttagtttgtcttcgtattgtagtttacatcattaaaaaagtaggcaattcatgtatattcctccactctcagtgtatacctgaacaaaagactcttgacgacgaaaattacgttgttttctgttataagcagattgatttcatggcatattgggtgttagagtttacagcttaatgctagagttcgtttgcaggaatacaggtgagttcatgatgtctaggtatagagaagttgccgaaattgtcctcagataccttgaacatcgtgatcgccttgttcgccttagcatcacctcgttactgcctcgcattgctcactttctccgtgaccggtttgtgacaaactatttaacggtaagtgactgagagattcttaaaaccaaaaaatttctggaaacgtgacacgaattactttcttgcagatatgcatgaatcatattcttactgtgttaagaataccggctgaaagagccagtgggttcatcgcccttggggaaatggctggtgctttggatggtgagcttatccattatttgccgacaattatgtctcatctgcgggatgcggtgggtcaaattttatttatttatttatttattttgtaattacgttttactacttttgtgtcaaagtattatattgggttttagttttgaaaactgaactagacaagtggctttgttcgactatgttgtccctgtagattgctccacgtaaaggcagacctttgcttgaagctgtggcttgtgttggtaacatcgcaaaggcaatgggatccacagtggaaactcatgttcgagatcttttagatgttatgttttcatctagtctctcttccacacttgttgacgctcttgaccagataaccatcaggtaaagttgaacgaaagaagtttgttattacatacattgatgtgtatacgtttaatgctgacaattctttgtatctcagcattccttctttgctgccaacagtacaagatcggcttctagattgcatttcgttggttctttcaaaatcccattattctcaagcaaagcctcctgttaccattgtccgaggtagtacagtgggcatggcaccacagtcttctgaccctagttgttcagctcaagttcaactagccctgcagactcttgctcgtttcaatttcaaggttggcgctctttgcggataacattttctaaagaatatgaaatttctgtctttgagcttctgatttctggcagggacatgatcttcttgaatttgctcgggagtcagttgttgtttatttggatgatgaggatgcagccacaagaaaagatgctgctttgtgttgttgcagactaattgcaaattctctttctggcatcacacaatttggctcgagcaggtcaacacgagcaggggggagacgcaggcgccttgtggaagaggttttatatcatactgaaagcccattacatttttttcttattatgtcttttaatttcactgtttctcattacaaaaggtttctttttattattttccaaatctgaacttaagtatgttaaacatgcttcgtgatggcatttataattgcaataccagtggcggttccaattttctgcttgctgagaaatgatgtttgggttctgcagattgtggaaaagcttctcaggacagccgttgcagatgctgatgtaactgttcgcaaatctatattcgttgctttatttggcaaccaatgtttcgatgattatctagcacaggctgatagtttgactgccatttttgcttccttaaatgatgaggtatgattgtgttatttgtttgaataaaatagcagcttagatgtcatactgcagtcctaatttgttaccgatcttttatttgtctctcttgggtgaattattgtaattgtattgctctttgagattcaatttcatgggttcatgaagttggtatttaattactccccctaatatcaaaatttggataccaagacgtagctgggcttttagtctatgaattagcttctattgtgtcacaaaacagtgttacttattaagttgtactggaaaagtgcagctgagataacttaattggatgatttgtggatggaatgaatgccttttgttggtggatgcatcatgtgataccctgttaacttgatagaatgtttggcttatgtttcacactttcactccacctggctacagtatctggcctagtcaatggaaccatttcaattcatatattacaatatctctgtttaacaggaccttgatgttcgagaatatgccatctcagttgctggaaggttatcggaaaaaaatccagcatacgtacttccagcacttcgtcgccatcttatacagttgttgacctatcttgagctgaggtaactacaaattttttagttcatatgggaagattcatttcctatgattatgtatctgttgcattgacttcaattgtaatgtcagcagtgcagataacaagtgcagggaagagagtgcaaagctccttggttgtttagttcgaaattgtgaacggctcattcttccatacgtagcccctgtccaaaaggtttaatttcttttcatttcttagatagtatggctattattgttgttcacggggttgtaactcttgttttctaggcacttgttgcgagacttagtgaaggaactggagtgaatgctaacaataatattgtcactggagttctcgtaactgttggggatcttgcaagagtggtaagttgaaatataattggcaagttttagattctatattaagtgtcgattcaaacataactgcgtttttgctgcgcgttaaagttgcagtctgatttttgactatttctatctgtgttctaagtctgtgttggctaagcgtatttcaaatttcaatgccctggccggcatctaatattgtattttttgttgtctctaagttaacagaatgttggtacttttatttcctttcctgtcctgttatttattgtgtttggctaagatattcccttcctggttttcttttgcgttgcttgctcagggtggcttggcaatgagacaatatattccggagctgatgcctttaattgttgaagctttaatggatggagctgctgtagcaaaacgtgaggtggctgtttctactcttggtcaagttgttcaaagtacagggtatgagatattgaccttcttttacgactttcttcttgttttatatgataatgctactaggcaattttgaacatgctaattttcttgtaaactaagacaatgctactatcttgattggcgaaagcctggttggactagatgaaaatactggattctaagtgaattttttgacacaaacggggcctccatctcttcttattagctaggtagaagcctgagctatccttaggctgtttatgtgttaatgtatacatatgtgttatgtttatcctttaacctactaaaagtgagaaaattctatatgaaatgacaatattgttatccctagctagttcttctatctgcggtagatctttgtgatggttttttttccgtctctcctgagatggctcattattccggagaaagaatattgcctttctgtgtccggacttgtcatgagttgtattctctgtttgtcgtgcgaaaggattgatttaccaatacctaggatattatgctgcctagatttaatcaactgtatcactggtgtttatgaagttgtagacatttgtagacagtgcggtgatcaacttgcatgttactgtttagtagcttgggacatgtgctaattattgtgcacataactagtacaaaatgaagggagttccagaagtttacaatcctccctgcatgttatttacggctctaatttcattatgaacgtaggtatgttgtgactccatacaaggaatacccattgttgcttgggttactcttgaaattgctgaagggtgacttagtgtggtctaccagacgagaagtgctcaaggtagtttctagagaattgttttactctagactattctagaagatatttttgtgataaacgtggttatatctacaggttcttggaattatgggcgctttggatcctcatgtgcataaacgtaaccaacaaagtttatcaggatcacatggtgaagttcctcgcggcactggtgattctggtcaacctattccatcaattgatgagttacctgtcgaactccggccgtcatttgctacatctgaggattattactcaacggtagttcttaatttgtgtgaatatatttcatttgtagtctgaattgtgctcaattactttccttattgttataggttgctatcaactcgcttatgcgaattcttagagatgcatcacttcttagttaccacaaaagggttgttagatctctgatgatcattttcaaggtaactaaaaccatcttgactgttttttaaaataaacttgtgttggaactgcaatgaggaggttacaactttatcactactttgtttttgcgaggttagtcaatgggattgggatgcgtgccttacttgccgaaggtaggtgtaaataatattgtatctccggcagcttttcgataaatgctctctctgttttacgttgtggtaatttgttgggttggttccacctctgaatttgaaggttttacctgagctttttcacactgttcgaacatctgatgagaacctgaaggacttcattacgtggggtcttgggactcttgtttccattgttcgccaggtatatccaccttaatattttcagttatggtcaaaatacgaccgactttgtgtaaactcatagcttatgttatctgtgtacagcacatacgcaagtatctgccagagctgctttcattagtctctgaactatggtcatccttcaccttgcccggtcccatacgcccatcacgtggtcttccggtaagttgtatgctgcctagagtatgctatgtttcttattgattaaggacagatatcttatggggagtacttcgcctctcttactgataatcaggttctgcatctactggaacatctttgcttggcacttaatgatgaattcagaacttatcttccagtcatccttccatgtttcatccaagtattaggtgacgccgagcggtttaatgattacacctatgttcctgatattctccacacactcgaagtgtttggcggtcagtaatacttatcttgttttgacatcctcatagtcattttatattacttgggtatgcgagttctagtaattaacgtatgcagttcttttacaagaatgtaaagaggttccacattattagattgtgtagtgtaagatgatacaagtagtttcgttattatatgcatatttgtttcttatctattaaatccaattttttttcggtatataggttctttgaatagtcagattgtttactcctgtagtttccattttctcaccatggccagatttcactctgatggttgacccttagagtccttatgtgcaggaactcttgatgagcacatgcatttactccttccggcacttattcgattgtttaaagtagatgctcctgtagctataagacgcgatgccatcaaaactttgacaagagtaatcccgtgtgttcaggttaggagctttggttatttattttgattttttttttccctttgctgatccagaaaaaattccatattaagcttcttgtaatacttttaattatccgtatatatcctcaggttactggtcatatctccgctctcgtgcatcacttgaagctagtattagatgggtgagttatactgattgtcactatctgaaaaacagtatattggttactttttcctaagggttttcttacaatacttcttcaaaacttaggcattgtgtcactatctggttttctcttaaatggttgacaatgcattatcaaaaaggatggaattattattatctcattaactttcaatccgtcattgttactgttacaaatctgttttccataagttgtttgtattgcttagttacaattttttctggccacatgtatttgttattagaactccgcagatgttagttacatttcttaatatcatgggattttatctgccattattgatgggacccaattgttttctagtggattttcatttcacgtttttctaaaccttactcgtgatttcagtttcgtacgtataaatattcttatggggtatatcttctgtaatcgcaggaagaatgatgagttgcggaaagatgctgtcgatgcactatgctgtttggctcatgcacttggagaggacttcaccatattcattgaatcaattcacaagcttttattgaagcatcgattgcgggtcttgcattttactatcttttaaataaaaatagcagcaaaaatttatctgtcatgtattataaatgtcatttgtgaacttctgtctgtaaaatctcactgtacaacattttttcagcataaagaatttgaggaaattcatgctcgctggcggagacgtgaaccattgattgtagctacaactgcaacccaacaattaagtaggcgactgccagttgaggttatcagggatcctgtaattgagaatgagatcgatcctttcgaagaaggaactgacagaaaccatcaggtactcttttctgtgtcgtatataatcacatatagattcttaatgtgtgaaaattttgttatcaagtttcaagttaaaatcatgattttactctaacattgtacaaaatttctggtcggcatagtcattattagtatgacttcattgaggcaaacatggggtgtattgtagggttccttagctgaataaggcggatctttttttctttctttttcctatctaaatgatgggtaggtttatctatagcaacgttcattcattgaagcttagtcttggtcctgagccatttgcttcaatgagtttgtaaatatgtcctctatatttcctcttctccatggacattcagcttttaaaaacaaataaaactatatatgggcttgatttaacatgatcctctagtaaagtttatttggttctttcttagttttgaaagagctaaaactttcactcatggctttgatgatctgctgaacaggttaatgatggtagactacggacagctggagaagcttctcaacgcagcaccaaagaagattgggaggaatggatgagacattttagtattgaattacttaaggagtctccctctccagcattaagaacttgtgcaaaacttgctcagttgcaggtgtttcatctatgctctttcttttcctctctcaaaagggtgcattttaatgattgtgttttgcagccatttgtcgggagagagttgtttgctgctggctttgtcagttgctgggcacagctaaacgagtctagccaaaagcagttagttaggagcttggaaatggccttttcatctccaaatatccctccagaaattttagctacactactcaatttggtatgttcgttgttacattacaagaaaacttaaacatgataaagacctttgattgagtcactggctataacgaacagcaaatttgtttcctgtggctatgcttgtgcttattgagtgcttgtgttttagcttaggcgattgttatgagttgactacattttccaagactggaaacaaaaacttcttaggtcaccatttctttagcggttgcacctgttaatctttctatgtaaaacacgttttttgttgctaaaaccatcaacaaaacgatctgtgagtgtacatggaaacatgacgtgtaatttttatttaatctaatattaacactataatccaaatatctgcttatacttcgtttaatctatattacgtttaggttggataaacaatcataagttcagaatcaatatcaacctacctttatgtgtgatcctgttgcttggtcctgtcacttgtgcttgattttattatttctcttcttaggcagagtttatggaacatgatgagaagcctcttcccattgatattcgtcttctgggggctcttgctgaaaaggtttgcgttatgtatttgctagttaaattagatttggtacttttttcatttgcgtatcaagaattcatctgattttcttggtaatgtgcaatattccaactttgtagtgccgtgtttttgccaaagctctgcattataaagagatggaatttgaaggtccacgatccaagaggatggatgccaacccagttgctgttgtcgaggctcttatacacataaataatcagttacaccagcatgaggtacactgtattttgtatcctatttcgaccatctttgatatttgttattattgattggttggaattctttgtataggctgctgtcggtatactaacctatgctcaacaacatcttgatgtgcaattaaaagaatcatggtaacatggcttttctgaatcatgatgcacttattttcagttctgtttgataggcattccgtcacaagattgtgtgtggttccattctttgatcctaatcagtggaaaagcactaacagtgtttgtttctaggtatgagaagctgcagcgctgggacgatgcactcaaggcgtacactttgaaagcatctcaaacaacaaatcctcatcttgtattagaagccacattaggtttgtggtaaccaagactaatattgggaggatttagtgggtttttttcttcgataatgtttttttctaagttctgttggcatttttttgtcggtattctgttagtagttcatagagaactgtgggttcataacattcttacaagttagcagaacaacagatcaacgcatttttttccagtctaaaattcatatgatgcttctcttttcttttcatgaaatggcctgattctattgcttatttaccacgttgtaggacaaatgagatgtcttgctgcacttgcacgatgggaagagctcaacaatctctgcaaagagtactggagtcctgctgagccatctgcgcgtctggaaatggcaccaatggttggtaacttctacttatgctacattcggtgatatagctacatggttacataatgtctttttgcaaccatactaggctgcacaagctgcatggaacatgggagagtgggatcaaatggccgaatatgtgtctcggctagatgatggtgatgaaacaaagcttcggggtttagcaagcccggtttctagtggcgatgggagcagtaatggcacattcttcagggctgttctgttagttcgaagggcaaaggtacacttggacctatattttcgtactataaatcttatcaggcttacttataatctatttgcagacactaatttctgcgtatgtgtgcctgtggatatttttctttcctttttagtacgacgaggcacgcgaatatgtggaaagagctagaaaatgtcttgccacagaacttgcagcgctggtaggtttcatttctggtagtattttcattataaacttttgtgaaaaatatctatgaatcatctgttgtgaataaagggaacagatgtatatcagcaaagatatttgtaactggtctcagccttttccattatgttcttgaaactatttgagtacgccttgtggtgttggaagtaggattatacattcctgacatcttagttacatatttagctctatttaaataacattttgtgcatgctatcgttggttcctttcaatagaagcatcatgtaatcaccatgttaccttcttagttgctcacgcatactgaaaaacttgtaattgtctatttgcgccttctacaggttttggagagctatgagcgtgcgtacagcaatatggttcgtgttcagcagctgtcagaactagaggaggttagatctcaattatccaagatcccttctcctggacaccctccctaacacccctccatatacatgattaatctttctatttttttcccctgttgtatcgatactaggtaattgaatattatacgctgcctgtgggaaatactattgccgaagaacggagagctctaattcgtaatatgtggactcagcggattcagggatctaagcgtaatgtggaggtatattatttttaatgttatcatgttagttgagccactagtgaatgacaaggcatttggtattttaagcatcaaatattgcagtatggtgactttattaaatgaatcttcgctaggatcaaattgattttttccatattaggtttgctttatttagtttccgtctgttgatttataaagtaaagtagcttcttaccaaactgttagtcagagcttgtatcctacgtagataaaaaaacaaatccaaataagaaaactcattaaaattttattgagtgatctcaggttttttgtataatagtgtgctttttaatactttgcattcccaatactactcaggtgtggcaagcacttttggctgtccgggcacttgtgctacctcctacagaagatgtggaaacttggctcaagtttgcctcgctttgtcgaaagagtgggaggatcagtcaggcgaaatctactctactcaagctcttaccggtcttgaacttttaccttttgattgttgaattttctctgccaagagtgtatctttattctgttatgtctaacttgggcccttattttgcagtttgatccagaagtatcaccagaaaacatgcaatatcacggacctccacaagtgatgcttggatacttaaaataccaatggtcacttggagaggaacgtaagcgcaaagaggcatttaccaagctgcaggtatgtcatataccagttgctacttgcattgtctgggcttattctctttttcacattttcccatatcttgcttgaacggccatgttatagcttccctcgatctaaattttaattgtttctagattctaacgagagagctctcaagtgtgccacattctcaatctgacatactggctagcatggtatctagcaagggcgcaaatgttccacttcttgcacgtgtaaatctcaaactgggaacgtggcagtgggcactttcttccggtttgaatgatgggtctattcaaggtgaattgtagttgcttttaaatgtgtaagtgtaatcaaactacgtctgaccttaacactttggtgaccaaatatactcttttccagaaattcgtgatgcgtttgacaaatctacttgctatgctcctaaatgggctaaagcatggcacacatgggcattattcaatacagcagtgatgtcgcattacatttcaagaggtcaaattgcttcccagtacgttgtttctgcagtcactggatatttttattctatagcatgtgcagcaaatgccaaaggagttgatgatagtttacaggtaaagcgtgcatgcatccatggcttttccatgttacacaaacgaaaacgtgtctttcttttcttttccatgttgctacttttcttatacttgttgaaatgaggtgttgttttaccatactggtggtctgttaaattattttcctctgctgtctcatttccataggacatactgcgtcttctgacattgtggttcaaccatggagctacagctgatgtccaaaccgcattgaagacaggattcagtcatgtcaacattaacacatggcttgttgtgctacctcaaatcattgctaggatacattctaataatcgtgctgtcagggaactgattcagtctcttctcatccgcataggcgaaaaccacccacaggtttgcagccttctagaaattttataaatcttcatcagtattacaattctatggtgggaattaagacatacataaagttttactctgccattttgattgcatatgtacttcgattttggatgcataatttctccttgactatttatttttcaaatgttttcaggctctgatgtatccccttctcgttgcatgtaaatcaataagcaatcttcggagagctgcggctcaagaggtggttgataaagttcgccagcacagtggtgcactcgtggatcaggttaaaagtcatctcttgtgtttgtcgattttattgaattatatatttttacctgagctaattagtgacccccttcctctacacccataacaacaaaaaaacaggcgcaacttgtatcacatgaacttatcagggttgccatactttggcatgaaatgtggcatgaagcactagaagaagctagtcgcttgtattttggtgaacataacattgaaggcatgctgaaagtacttgaacccttacatgacatgctcgacgaaggtgtaaaaaaggacagtacgaccatacaggaaagagcatttatagaggttggaaatttcaatcccggatttttggtatttgggtgtgtgtgatcacgttatttataattacatctttatctagcacaggggtgtacagcattgcagtatctaggtttatttgctatgtaacttgtagtcatttttcctcttcgcgattttaaagtattaaaataaaccagttgcccttgatagaatcagattactaatgttactgtatggagtgtttcttgtcgcatatgtttcagtaactgttatatgtgaactttacaatgttctttaatgtcagcaacttaagttagtgtaatgttgatgcaggcataccgtcacgaactaaaagaggcacatgaatgctgttgcaattacaagataactgggaaagatgctgaacttacacaggtgatcagaaattttgaacaaaatttcagatgagtgtttgctgtcttcttattaaagggacgggaattgacataatttttcttttcaattctctatcttcttaggcttgggatctttactatcacgttttcaaacggattgacaaacagctagccagtctcacgacattggatttggaagtaataagattctctttttctttggttctctcgctccttttgagttctaatctgactggcatgttacttgttgtatagtctgtttctcctgagttgctgctgtgccgtgacttggagctagcagttcctggaacatatcgtgcaggtaacaacatattgaactgcttaagtttgcctgagctgatttattttattaacccagacttcattgcttacatacatacttcgtttttcttcttattagatgcccccgtcgtgactatatcatctttttcacgccaacttgttgttataacctctaaacaaagaccaaggaaattgactattcacggaaatgacggtgaggactacgccttcttgttgaagggacatgaagatttaaggcaagatgagcgtgttatgcaggtgattctcaaaaaaatcagttatgcattgttctgatgaattcttgttggagaatacgtaattgaagttttcagtttacacttcacaaatatacagttttcagctacaaaatcacatctatccctttcctcttatttgtgtttcagctttttggtttggtgaacactttgcttgagaattccagaaaaacagccgaaaaagatctttccattcaacgctattctgtaataccactatctcccaatagtggactcatcggatgggttccgaactgcgatacccttcaccatcttattcgagagcacagagatgcaagaaaggtttgtcttgtattcactaaggttttcagtcctgaaactatctgcggtttacgttaattcttacacatgcctgtctgaattcatagatcattcttaatcaagaaaataagcatatgttgagttttgctccagactatgacaatctaccgcttatagcaaaggttgaagtatttgagtatgctctagaaaacacagagggaaatgatctatccagggtactcaattcattctggtaactctatttattttgggtaaagtacctaatctggaatactaagttgcttctattcttctccttcttattaggttctctggttaaaaagtcgctcgtcagaagtttggctagaaagaagaacaaactatactagaagtttagcagttatgagtatggtatgtagttgatctcatcctttgttctccacttgtgtagcatcaaataaaaagtttctggtgtttaactcgccaataaaatgaacttcatgcgttactttgtgtcaggttggttatattcttgggttaggtgatcgacacccaagtaaccttatgcttcatagatacaggtacataaaactgaaataaggtttacattacattttcaaccttgggttctatttctttatcaatggttttaattgtgcagtggaaagatcttgcatattgattttggagattgttttgaggcttctatgaatagagagaagtttcctgaaaaggtattaattttaatgtttccctcgtatatacttgtttgtgggtatcaaagaacaattttgtgaggattgcttaaataatgttaggttccattccgcctgacaagaatgcttgtcaaagcaatggaagtcagtggcattgaaggaaacttccgctcaacctgcgaaaacgttatgcaagttctcagaaccaataaagatagtgtaatggcaatgatggaagcgtttgtacatgatcctttaatcaattggcgtcttttcaatttcaatgaagtcccccaattagcactgctcggtaacaacaaccccaatgctcctgctgatgttgagcctgacgaagaagatgaagatcccgctgatatagatcttcctcagcctcaaaggagtactcgagagaaggagattcttcaggtttcttttgaaaatcttattatgtttttttcttctcaaagggggatttttttatatttaaatttgatttttggattatttcaggctgtaaatatgcttggagatgctaatgaagttttaaatgagcgtgccgtagttgttatggcacgtatgagtcataagcttacagggcgtgatttttcttcgtctgcaattccgagcaatcccattgctgatcataataacttgctcggaggagattctcatgaagtcgaacatggtttgtctgtgaaagttcaggttcaaaaactaatcaatcaagccacttcccatgagaatctctgtcaaaactatgttgggtatgttcctctacacttctacactcctaaaccccgattgctttagttcatttaaaattgaacatgcatatttcttgtgtttgttcttttattacaggtggtgccctttctggtgagatgggtcatctgtacatttttaatgtaaataggctttttaattttcaactaatttgcatttatgtttgactaattcgataataaactatgttctttttaatgtaaataatttattagtttcatagtcatgtattaatacatgatgtagcgtggatgaataaatgggcaggtcaccttttttacttttctgaaatatacattctcatatcctcaaggtattttaatggaattgcgacaaaagaagaagaagaagaagatggtgtacaatgtacatgttttatgaactatataaagcaattggaatatgcatgttctttttaatgaaacatgtttccggagtttaagatggatttcataaaaatcaacataattttgttaatagtccaaataatataatttttttattttttttttgttaaagcaaatttgtcacatttttttatataaaatttgtgatgtcaaaagagaagacaaatgtaaaattgtgttgtgggttgttacagtatgtagttggtatctttattaaacctaccaaaacgagacaatttgtaacattgagggagcatgtgatagtacattgggtattatactattaagctaacatgagtaatgatgtttttttgttttttttttctcttctatgtattttgtttttgtaccaatattattaatacagaatggggacaaaaaggagacgtggagtctcgcgttacgttaccactctctcaaatgcggcaatttggcagccacacacacatggacagcgttagcgtactgtagataaataatccgtactcgtgctaacgtacgcttcaaatagttaaaggtgataactttcaccgttgtctcggcaccacttgctcgaatattgacacctttttcttccccagaaaaaatccaaacaaatagaattttgccgtctgaaattcctaaaactataaaacacagcttccttcttctcctatatattcatcggcgacgccttgatcatgattctttccggaaactgataagaggaacaaaaatggcttcttcttctctggagattgttaaattgtgtggctctcctgtatcgtttccccgccataaatctcccataaaattggaatgtagaaaaagggttttcagattacccaattctaggagttggcatcgtcttagggtttcttcatctgctctcaatggtggtgataatcagtccaaaggtcagtttttttttttttttttttgttgcttaactctctaaaagaagtaattagagttgattttgattataactgatatttgattagtcaatagattataaagatgtgattttgattctttccccttttagatagaatttgttgtcattagttctctaatagtatcattagttctccaatcttgtttcttgaatctcttttcataagtcaaaaaggggttttaatatacaagttatccattttacttggactctttcttcttgtaatggtgtgtattcattacttagattttcctctacctgaatttggagtttgatttgtatgagttgtgtaggtgaag

SEQ ID NO: 281 - DNA, 1123 bp, Glycine max
  CDS (85)..(861)
attcggctcgagttttttctttctccgccccttttttgttgttccttcttctcgttcgtcgctttgtgatctctctctgcaaccatgtccgtcgagaaagagagagagacccaggtttacttggccaagcttgccgagcaggccgagagatacgaagaaatggttgagtgtatgaagaaagtagcaaaacttgatcttgatctgactgtggaagaaaggaaccttctctcagtgggatacaaaaatgtgattggtgcacgaagggcctcttggcgcataatgtcctcaattgagcagaaggaagagtctaagggaaatgagcacaatgttaaactgatcaagagttactgccaaaaagttgaggaggaactctccaaaatctgtggtgacattctgactattatagaccagcatttgattccttcttccggatcagcagaagctagcgttttctactacaagatgaaaggtgattattttcggtatcttgctgagttcaagactgaccaagaaaggaaagaggcagctgagcagtcactaaaaggatacgaggctgcttctgccactgcaaacacagatcttccatcaacacatccaatccgtcttggacttgcactcaatttctctgtcttttattatgagataatgaactctcctgaaagggcctgccatttggccaagcaagcttttgatgaggcaattgcggagttggacaccctgagtgaagagtcatacaaggacagcactttgatcatgcagctgttgagagacaaccttactctctggacttccgatttaccagaggatggaggtgaggacaacataaaagctgaagaagccaaaccttctgagcctgagcattgatgtgattcagtagtcagaaatctaaggtactccccaagagggcatttttcagcttttcttgcaatggatttggaccggacaatagggactgtggtggccatttcataattcttgttctctcttaatatctttaccaaagccagaagatctgcacccttttttttcccttaaaactttttatttttattgccttctctgttttaagtggtcagttaagcaatgaacaatttacatttacccttaaaaaaaaaaaaaaagg

SEQ ID NO: 282 - DNA, 1179 bp, Glycine max
  CDS (42)..(824)
attcggctcgagcgtaaaccctaatttcggaaagatcggcgatgactgcctccaaggatcgcgagaacttcgtctacatcgccaaactcgccgagcaggccgagcgttacgaagagatggtggaatcaatgaagaacgttgcgaatctcgacgttgaactgacggtggaggagcggaatttgctttctgttgggtacaagaatgtgattggtgctcgcagagcgtcctggaggatcctgtcttccattgagcagaaggaagaaacaaaagggaacgagttgaatgcgaagcggattaaggagtacagacagaaggttgaattggagctatcgaacatctgtaatgatgttatgagagtgattgatgagcaccttatcccttcggctgcagctggtgaatccactgtgttttactataagatgaaaggagattattatcgttatcttgctgaatttaagtcaggcaatgagaagaaggaagctgctgatcagtctatgaaagcatatgagtctgctaccgctgcagcagaggctgatttacctcccacacatcccatccgattgggtctagctttaaatttctctgttttctattatgagatcttgaactcccctgaaagagcctgtcatcttgcgaagcaagcttttgatgaagctatttctgagcttgacaccttgaatgaggagtcatacaaagatagcaccttaatcatgcaacttctcagggacaacctaactttgtggacttctgacatcccagaagatggagaagatgcccagaaagtgaatggcactgccaagcttggtggaggtgaggatgcagagtgagtccgatggatgatggaatcttccataggattcgatgcatgcgtttgggaatgaaacatgagggccgattacttatctgtgtattagctagagatagggattctattgtttcctctttgtttcctgttggattgcccaatacttcccgataggggaaagagatactccatttgtgctatatttatggtatgtttttatttgtgtggtgtctggaaatggcctatttcattcccaatccgtttcctccagtctctgggggatttgattgatgagaattgcttatggtgggtgtatttccttttccaatgaaatgctacaacatttactgcaaaaaaaaaaaaaaaaaaaaagg

SEQ ID NO: 283 - DNA, 1092 bp, Glycine max
  CDS (49)..(834)
attcggctcgagctctcatccagatcttgcaaaaaaaaaaaaaacacaatggcagcgagcgctcccactccacgcgaagagttcgtgtacatggcgaagctggcggagcaggccgagcgctacgaggagatggtggagttcatggagaaggtctccgcctccgccgagagcgaggagctgaccgtggaggagcgcaacctcctctccgtcgcctacaagaacgtaatcggcgctcgccgcgcctcctggcgcatcatctcctccattgagcagaaggaggagagccgcggcaacgaggaccacgtcgccgtcatccgtgactaccgctccaagatcgaggccgagctctccaacatctgcgacggaatcctcaagctcctcgacacgcgcctcgtcccctccgccgcctccggcgactccaaggtcttctacctcaagatgaagggagactaccacaggtacctcgctgagttcaagaccggcgccgaccgcaaggaagccgccgagagcacgctctccgcctacaaagccgctcaggacattgctaacaccgagctgcctccaactcaccctatcaggctgggtcttgctctgaatttctctgtgttttactatgagattcttaactctcctgatcgtgcatgcagccttgcaaaacaggcttttgatgaggctattgctgaattggatacgttgggagaggaatcatacaaggatagcactttgatcatgcaacttcttcgtgataaccttaccctctggacctctgacatgcaggatgatggtgcagatgaaattaaagaagccgcacccaaaggtgacggggaacaaaattaaacataccatacttctaattagtgattgaacttcccttgtgtaatgttttcaaagggagaaggtgttgaatgctaatctcggtgttactgagattttgggcattcatgttcttcgttatgaattgtggatgtactgggctattttagtttgtccttccattagtacgcgtttctgaactgcctattttcataatgacactgaaatttccattataatgctgtttagaatattaagatataaaaaaaaaaaaaaagg

SEQ ID NO: 284 - DNA, 6501 bp, Oryza sativa
  CDS (654)..(1862), (2310)..(2426), (3407)..(3492), (3590)..(3752), (3845)..(3890), (4476)..(4522), (4985)..(5191),(5306)..(5392), (5473)..(5640)
agctaacctgcgtgatatttctaatcaattcgggaagggaaggataaaattgttttttgttgctatgtgttcgaatcttaatgttaatcacaccgcttaaccaaatgtcttctacagagttgtccctccgtcccgaaaattttcttcttcactgagaataccaagtttatttctcacctgcattttagattctcatcgacttgcacttagccaagaatctgttacacgaagaagggcaaatttacatgtattttcttcacagggagatttgcaataatgacattgtaaacattaacttttactataatgatataggatccatatttcatagacatagatgggtccatgtttgcagttctaatattataattttaaggataagggaattaatatatacaacgtgtcgaaattttgagtcaatttgccaactatggataaaaaattacaaattcaaaaagaaacttgttgcccgacagatcagcccacacaaagtttgaaggctaaaagcccaatctggggggcgcaagaattccagcccaagttataaaaatcacgaaatatcttggatctgacagtctgacagcaaaaggccacactcctcacaaatctcgtgcgcgccaccgtcatctccggcgaccacctcaccgccggccatgccattctcctacgccgccgcggcctctggctccgcgtcctcttctcgcaagccggttcccgtcgccgcggccgccgcccgccgacccgcgccctcgccggcagcggcggcggcacccgcgccctcgccgtcaaaccctagcgcggtctccgattccgacccctcctcgtactcctcctccggggaggagaccgacctcaccgcctccgatccggcggccgcctccgtcatctcctcctacctctccgttgcgggggatggcgccgacctctccaaggtcgggatcttcctcagctccgcggcgcgccgccgatcgccgccgtgcctgatatgcttcgatcccatccgcccctccgaccccgtctggtcctgctccgcctcctgcttcgccctcctccacctccactgcatccagtcatgggcacatcagtcatcctctgccgcgccttctcccacctggggttgccccaaatgccgcttcccctatcccaaatcccagactcccacctcctacctctgcttctgctccaagacggtagacccagctccggacccctggatcctcccccactcctgcggcgacgtctgtggccgacgtctcaatgcagaccgtgactctggctgtgagcacaactgcctcctgctttgccaccctgggccatgtccaccgtgcccggcaattgttccaaatgctatgtgcttttgcggctcacatcgtgagacgcgtcgatgctcacatcagcgttattcttgctcggggaaatgcaataaacgcctcggctgtggaatccaccggtgtcctgtggattgccatgatgggccttgcccgccttgtgcggtgcgaggaaagcacaaatgtgagtgtggagaaacaatggaggagaggctatgctctgaaagggtgttccagtgcaagagggagtgtggtgggatgttgcagtgtgggaagcatagttgtgagaggggttgccatgctggaaagtgtggaggatgcccactccaagggcgacgaacttgcccatgtgggaagaaagattatccaagtttggactgtgatgcagaggctgccacatgtggatcaacttgcgagaaggtgcttgggtgcgggcggcacaaatgcccagagcggtgtcatcgtggttcatgcgttgagacatgtcggcttgtgatcacaaaatcgtgccgctgtgggggtctcaagaaggaggtacaatatatcacacgttttttatgtcaaaattcttaaaaggaaggaaacaaggaatatgtttaaacccttcaagcagataaattaaacaaatcaattccttggttgtctaaaatgcaaaaagcaattagagaatgtcattgtcaattatgtttgatacattattagttaaaatgccttttaagttacttcacatagttctctatagttctaccgacctatttctatatttggaggcaagtatgcttcaaccgttctgagtggaaacaaaacagagtaaaaataagtaaaatcttctttctttatgttacctcaatctgggccagtatagtaaatactggttgtgcaccatcctagcgctggtattgaatgtggagggctgcagcttttgagtacttctctcttattagaatgcaaaccaaatttgttgttcatgtgatgctgcatcaggtgccttgctaccaagaattgacatgcgaaaggaagtgtcagcgtttgcgaaactgtggccgccatgcttgtagacgacgttgctgcgagggtgattgtgcaccctgcccagaggtaaatcctttctttggggggtgtgatgtattgatacctatcaattactaaagtagatttatttctgtttgtaggtttgtgacaagaggctcagatgtggcaaccataaatgcctatctccatgccacaggtattctcttaatcaaatatacatctttggcttgccatgttgaattgtttagtgctagtactgctaattgcattggtgcataccttttatacatatgttcccattttgagccatatttttgcaatggatgtaccacattgccatgataggttccacaaatttaagaatgctgttttgctctcagacatttgcactttattctcttttattccaaatttcaagactaattcaatgtcccgaatcataaatattcttgtttatccaaactgctaatatatgtgacaatatttttcttcattttgtttaacagaggtgcttgtgcaccttgtcctttgatgaagaccatttcatgcaactgtgggcaaacattttttgaggtggaattcggtacactctaaatatgttgtttgtttcttatgcatcccatgtttgatgatcacagcacttcacttgaacagcaagtttacaggaaaaaaagatattcagttagcattaggagtaccattgttttcatatgattttatgtactttgttaaaaaagttaattcttgtccgatccttccacacaaaacttgccttgtgactcgacttcttgtccaaaattcgtatgcacaactttgtatgtaggtgccctgtgggactgagaagaatcagaagccacccaaatgctcaaaaaaatgcaatatagctcgcctttgcaggcacaaacttgaatgccgggtaaacaattacatatctctgctttaaccttatcattaatgataatctcatctattttgtgtttagaaatttatcctggagcattttggggttctcttctataaattaatcctcagaattttcttcttagccccacaagtgccactatggagcttgcccaccttgcaaactaatctgcggagaagaactttcttgtggccacaggtgtaagctgaggtttgtattttgactattttctgaatgtgccagtgttggtaatttgccccaggagtatatccttctgatatgtaaccatccgctcgcactctgccaggtgtcatggccccattgctcctccaaatcctgagttcacactgaaaccaataaaaaggaaaaagggaaagcatatagactctacacctggaacaccatgcccgccatgccaagaagttgttttggtgccatgctttggacatcatcttggccaagaacgtgcagtaagtttcacccttcctcacacatccacactcatatgtgtgctccgtgattgctgagtgcctgagtgcatacaaattctttctccctgcagatactttgctccaaaaggaggcagtttccatgtcagaatttatgtggtaaccctctcaactgtggcaatcattattgtacgaaggcttgccatgtgttacagattccattgagtcagcctgaaggagatcaatcggctatactgtctcttgctagtgcaagtgcattcgctgagccttgcgaagaatgtaacctgccttgtcaaagggtcagtgttctttattgtccttagcaataactttggtttagttctgtttacagacttttaatgtgaaattttgtgcatggttccacatcttttaactttggtgcagcatatttggtatttaccatttctttcaggtcagggagcctccatgttcacatccctgccctttgccatgccatcttaacgattgtccaccttgcaaagcccttgttaaaagaccatgtcattgtggtgctatggtacacgcttttgagtgcatgtattataacaacttaaatgctacaaaacagcagaaagtaaggtcctgtggtggcccatgtcataggtcagttacttttttcctcggtcctatcatcttttttgaatgttggtaacattttccattgctgattttgtaagtttctttcatctgttctttttgcagaaaattaccgaattgtccccatctgtgctcagaaatatgtcaccctggtcagtgcccatcagttgatcagtgcatgaaaaaggtatcttggtgaaactagagttacctaattggcatgatatcacttggtaggcatatatttacattacataattagcatgacattattagcaacctgttctgtggcttagcgatactacaatttttacttgatgaaactggagtaaggtttggaactttgggatatggtccacttatgttctatatatatttttagcgagatcaatcacagaataccatagttgtttttacctctttcatgtaatgtaattaggcactaggctttctcttttctgtccttgtgcgctatcacaagaactttgctgtttttcttgaagaacttgcttaatgaaggcagagctgcttacactttacctaaaaaaaatcacaacatacttttgaaaatatgtattaatacatgttcctctacctatctgatatccattaaggtcaatgtccgttgtgcatgcaacaaccttaaaaaagagtggatatgtcaagatgttctgaaggaataccgtcagtctggtcgtgacccaaaacaaatacctaaaaatcaatatgcagttggcctacttgcctgtggtgaagattgtgttaaaaaggttaaagctgcagattctgagttgcatctccggaaaattcaggagatcaaggtactggaccttaccatctgaaccaaacttcataagttgttacactgttgtgcaaacaatcagctcttgtagttatttttgcttctgtgcttattggctgtaatttccatgtagacccctgctgtggaagttgaaaatgtgcccaagcgcaggaagaggcgtaaccgtggccaagaaagtgttgaaagctcaaaattccaggtgtgctagatactgatgtgctggtttgttatttgggttcgctaagcatgcgttccttacatgaactttatatattgcaggaaatcaaagctgttgcgttgaaatttctcctggttatttttctgtgcataatcgttgtagctggattgtaccttttgtggaaaggtgtttaccggctttctgattggatgaatgacatggaggagcagagggccaggcagaggcatttgaagcctggaagattgtaaattaaagactacggagggtgtttgtggaatattcacaactgagatgtgcatcggttcaccgtcagggattggtttcggatatatggtagtgaaagatgtcatcattttgttattggagccaagccccggagtttgtaactagtttggtctcttgtccgaagctactggttaatggaaactaaagttatccgtgtcaaaagaaagatatcattttgttctttgtttgccaaacaaaatgtaggaactcaacaaccttgtactgtagtttacatgcatactgtgttcgagtgaattaagggtgtgtttagttcacgtcaaaattagaagtttcattgaaattgaaacgatgtgatggaaaagttagaagtttatatgtgtagaaaagttttgatgtgatggaaaaattagaagtttgaagaaaaaattgggaactaaatcaggcctaattaaatgaacaaattctgtcaagtaattgatatacgataaccactgtaatttctacggtgcacataaatatccatcataataaggtacagccttacaggcgatcacatttctgcaccttttgcagtgttgagttctgttgcagtaataacacctagtgattcaggtaaaattggttttgttagtataataagtttatttttgttttgagagagagtacaaacacaagcgtttccgaggtacagcacctgcgtactcattcctataaacaagtgcacgtaaacggcacattttatttctatgagcactttcaacagactagatcggtatattttaaaattgataaagtcactatcgatgtcttaaccgactgatggtatatattgagattaacgaagtcatcaccgatgtctcgct

SEQ ID NO: 285 - DNA, 1585 bp, Oryza sativa
  CDS (199)..(1338)
gccaagctcgaaattaaccctcactaaagggaacaaaagctggagctccaccgcggtggcggccgctctagaactagtggatcccccgggctgcaggaattcggcacgagccgcgtcgcttcccttccttcgcgcggcgctgctccggtagggttttagccggcgatctctcccctctcgcgcgctcggcgactgagaatggtcgaggtggaggaagtcagcaacaagatgcaggtgcagatgcgcctccaccccgccgcggcggcggaggaggaggacgccgacctcccgctccccgccctcttcgacaaggcgtcccacctccactccctcgcctccagctcctccctcgaccaggaagggatccgcaagggggtcgacctgctgcggcggtgcgacgagatggtcagtaaggtcggcctcttctcctccaacgagaccaaggatgacatctccaccgccaacctcaaatacctactcgtaccgtactaccttggggaaatgactgaaagggtagcgcaggaagatcggatcccagtccttaaggcgtcgcaggatcatttgaaggaattcatttctatctgtgaagcactggagcttatatcagaggatgagcttgaaatatctaggcagaagaacctgataccatggcaaatcgaagagcacagaaggttgcacggttcaagcgccaaaaggctgcagaaacaaagctctagaatcaaggagaggaaagaaaggcgtaggcgtcatgagagcagctgcttatcagctcctattgagctgggaggagatcttttgaggatgatggagaaggaaagagaaggcatggttagctactatctcattggctctatcgaaggctttgaccttcttgacatgttaaagaaggaagaagaaatcgttccggcagtaaaagaaggaaagcgaaggatggtaatgcatttgctcgtgaaatgcttgatgaacgtacaaaaagggctgaagcatggcaccataatgctgccaaccgtgcaccatactccaaaccagctgatccaatcacttgtgcaactaaccagtgaaagagagagaatggcagcacaagtttttcagccaagttataggttgccaacgatgagcatagaagaagctggcttacgtgagatgaaaatgatggagaaatggcaagaaagaactgccaagatgattcaagaatcaaactccgcatggcacaaggatggcagtcggtcagcccaagaggacgaggacgccgaagaggagaaagcgagaggatgggatgactggaaggacgataaccctcgtggtgcaggcaacaagaagctcactccctgtggctaaattatatgctatggcaattctattgaacttacatctgaaactgaagctcgtgtaaaaatatgtggtttttactaactttccttactgcggcatttgttgattgctgagtaataatgtgttccatatgtatattataattgtgcatggtttccttctgccaatatatgggcaaccaagtaatgccagaaaagctgatttgagaagcaaaaaaaaaaaaaaaaaaaaaaaaaaaaaaaaaaaaaaaaaa

SEQ ID NO: 286 - DNA, 928 bp, Oryza sativa
  CDS (58)..(741)
ccacgcgtccgagctaattaaggcgcaacacagaaaccctcaccgccgcccgcatccatggcggaggagcacgagacgaggccgccgtccgccggaagaccaccgtcgtccggccgcggcagggccgacgacgctgacgagagggaggagggggagatcgccgacgacgactccggccacgcgccgccgcaggccaaccccgccgcgccgcacccgctcgagcacgcctggaccttctggttcgacaacccgcagggaaagtccaagcaggcaacctggggaagctccatccgccccatccacaccttctccaccgtcgaggacttctggagcctttataacaatatccatcacccaagcaagttggttgtgggagctgacttccattgctttaagaataaaatcgagccaaaatgggaagatcctatctgtgctaatggaggtaaatggaccttcagctgtggcagaggaaagtccgacacaatgtggttgcatactttattggcaatgattggcgaacaattcgattatggggatgaaatttgtggagcagttgttagtgtgcgtggcaagcaggaaagaatagctatctggactaaaaatgctgccaatgaagctgctcagataagcattgggaagcagtggaaagaatttctggattacaaggactcgattgggttcattgttcatgacgatgcaaaaaagatggacaaaggtctcaagaaccgctacacagtttgatctgagcactcctgtccagatatccaagagagtagtatatccacatgtaggatgggttttcttcgatgctttagtgtttgtcattcgcttgtagcgagcgcttgaaggctataatattgccgtgaactgtttaaacttgaaacgtaatataatgacgtatcagaggtgtctctgtactctataaatc

SEQ ID NO: 287 - DNA, 1284 bp, Saccharomyces cerevisiae
  CDS (79)..(882)
tagtttttcctattttcaaaattgagagcgcaagcaagtgagaagaaaaagcaagttaaagataaactaaagataaaaatgtcaaccagtcgtgaagattctgtgtacctagccaagttggctgaacaggccgaacgttatgaagaaatggtcgaaaacatgaagactgttgcctcctctggccaagagttgtcggtcgaagagcgtaatttgttgtctgttgcttataagaacgttattggtgctcgtcgtgcctcttggagaattgtttcttctattgagcaaaaggaggagtccaaggagaagtccgaacaccaggtcgagttgatttgttcgtaccgttcgaagattgagaccgaactaactaagatctccgacgatattttgtccgtgctagactcccacttaattccatcagccaccactggcgagtccaaggttttctactataagatgaagggtgactaccaccgttatttggctgaattttctagtggcgatgctagagaaaaggccacaaacgcctctttagaagcatacaagaccgcttctgaaattgccaccacagagttacccccaactcacccaatccgtctaggtttggctcttaacttctctgtcttctattatgaaattcaaaactctccagacaaagcctgccatttgcgcaagcaagcttttgacgacgctattgctgagttggacactctgtctgaagaatcatacaaagatagcacacttatcatgcaactgctaagggacaatttaaccttatggacttcagacatgtccgagtccggtcaagctgaagaccaacaacaacaacaacaacatcagcaacagcagccacctgctgccgccgaaggtgaagcaccaaagtaagtattctgataaatctaaagagaaattactaaaaaaaagaaaaaaaaaagaacgagggtgtaataatttgtagttcattattgcaattatatatctatatctatatatgtatataacattaacatgtgcatgtacacacgtaatcgcgcgtgtacatgtctatatgtgttacttgaactatactgttttgacgtgtatgtttatttatctctcttctgattcctccaccccttccttactcaaccgggtaaatgtcgcatcatgactcccgacaataatcccctctggtatacgcagaagcaactttagcttcttaacggcaagaacttttttatgtttgtcgcacctgtatcttcacaaaagttggatacagcaataagaaaggaaaccacatttgtgcca

SEQ ID NO: 288 - DNA, 1172 bp, Oryza sativa
  CDS (81)..(848)
agcattcgcatccacgagaccactcgaacccgacccgcctcgccgccgccgccaccgaagtaatcccttaattggtcaaaatgtctcgggaggagaatgtctacatggccaagctggccgagcaggctgaaaggtatgaggagatggttgagtacatggagaaggttgcaaagactgtagatgtggaagagctcactgttgaggagcgcaacctcttgtctgttgcttacaagaatgtgattggtgcccgccgtgcctcctggcgtattgtctcatccattgaacagaaggaggagggtcgtggcaatgaggaacatgttactctgatcaaggagtaccgtggcaagattgaagctgagctgagcaagatttgcgatggtatcctgaagttgcttgactcacaccttgtgccctcatctactgctgcagaatctaaggtgttttacctcaagatgaagggtgattaccacaggtaccttgcggaatttaagactggtgccgagagaaaggaagctgctgagagcacaatggtggcttacaaggctgctcaggatattgctctggcggatcttgctcccacccatcccataaggcttggactggcacttaacttctctgtgttctactacgagattctaaactctccagacaaggcttgcaaccttgctaagcaggcgtttgacgaagccatctccgagttggataccctcggggaggagtcttacaaggacagcactttgatcatgcagctcctgagggacaacttgaccctctggacctctgacctcacggaggacggtggtgatgaggtgaaagaagcctccaagggcgacgccggcgagggccagtaaaatgggaagatcgatcgatcgatggctccgcatgttattggagaccatcgatttagatgcctcatgctgctgtcaccatgatggatggattcttctcctgttctactagaatgtttttcttcctgtccccccttcctctctcttctctggtttttactagggtggtagcggtcgaattagttcttcccattgctttgcatttggtgctagtggtccgtctgggctgattgttttcctctggatatgactctcgtgtgtgttgtctccagatagtgttttattgagcaatatttaaagttgtcgtccacctcaaaaaaaaaa

SEQ ID NO: 289 - DNA, 1004 bp, Oryza sativa
  CDS (6)..(785)
gaaaaatgtcgcctgctgaggcatcgcgtgaggagaatgtgtacatggcaaagcttgccgagcaggctgagcgttacgaggaaatggtcgaattcatggagaaggtggcaaagaccactgatgttggtgagctcaccgttgaggagcggaacctgctttctgtggcttacaagaacgtgattggtgctcggagggcatcgtggaggatcatctcttctattgagcagaaggaggagagccgtgggaatgaggcatatgttgcatcaattaaggagtaccgtagcaggattgaaactgagctcagcaagatctgtgatggtatccttaagcttctggattcccaccttgtcccatctgccactgctgcagagtccaaggtgttctacctgaaaatgaagggtgactaccacaggtaccttgctgagtttaagtcaggagctgagaggaaggaagcagctgagaacactcttgtggcatacaagtctgcccaggatattgcactcgctgacctgcctacaactcacccgataaggcttggacttgcactgaacttctcagtgttctactatgagatactgaactcaccagaccgtgcttgcaaccttgcaaagcaggcgttcgacgatgctattgctgaactggacactcttggcgaggagtcttacaaggacagcaccttgatcatgcaacttcttcgtgacaatctgactctctggacctctgacaatgcggaggatggtggtgacgagatcaaggaagcagcgaagcctgaaggagagggccactaatctgtcctgaagtctatttctgagtccatttactcagctacctgctgtattactggatcataagatgtactaggatcaattgctatgtggaatcataagattagggctgcgtatgtcaaaatgtgtcgagctgaagtacccagtggacacagtttatgtgcactacattgcttccgtgacttatttactagttaattagcaactttcaaccaaaaa

SEQ ID NO: 290 - DNA, 964 bp, Oryza sativa
  CDS (96)..(713)
gcggcttctcccttctcttctctctctcgcatcgcctactcgttcgttttccctcgaggaggagcagaggcggcggcggcggcggcggagcggacatggctgaggtggaggcagcgccgattgcggcggcggagaccccggaggtggcggcggcggagggagcggcggcggcgaaggcgccgcacaagctgcataggcagtgggcgttctggtacgacatccagtccaagcccaagcccggcgccgcgtgggggacctcgctccgcaaggcctacaccttcgacaccgtcgaggagttctggggcttgtatgatcagattttccgtccaagcaaggtgacagtaaatgctgattttcatttattcaaggctggtgtagaaccaaagtgggaagacccagagtgtgcaaatgggggcaaatggactgtgccatgtagcaggaagaccacccttgagaacatgtggcttgaaacgctgatggctctgattggagagcagtttgatgaaagtgaggaaatttgtggagttgttgctagtgtccgccagagaggagacaagcttgcattgtggactaggactgccagcaatgaagccgttcaggtaaacattggcaagaaatggaaggagattgttgactacaatgataagatggtctacagcttccatgatgacgccaagagggagaaaccaagcagaggtggacggtacaacgtgtaagtcaccgcaaaacgttgcagcttggatagtggccatcgagtggtgtgccgataccggcgcctgttctttacagcctcagctagtgttgttgtccgaggcaatttttccgacctattgtgttgctttcctctctgatagcttatggtaaaagatacaaagatgttgaggagtttgtacgccacttaattttgctcgtaacatacattgacaatcaagaggagccatggcattgcgatctaaaaaaaaaa

SEQ ID NO: 291 - DNA, 961 bp, Oryza sativa
  CDS (46)..(726)
gctaattaaggcgcaacacagaaaccctcaccgccgcccgcatccatggcggaggagcacgagacgaggccgccgtccgccggaaggccgccgtcgtccggccgcggcagggccgacgacgctgacgagagggaggagggggagatcgccgacgacgactccggccacgcgccgccgcaggccaaccccgccgcgccgcacccgctcgagcacgcctggaccttctggttcgacaacccgcagggaaagtccaagcaggcaacctggggaagctccatccgccccatccacaccttctccaccgtcgaggacttctggagcctttataacaatatccatcacccaagcaagttggttgtgggagctgacttccattgctttaagaataaaatcgagccaaaatgggaagatcctatctgtgctaatggaggtaaatggaccttcagctgtggcagaggaaagtccgacacaatgtggttgcatactttattggcaatgattggcgaacaattcgattatggggatgaaatttgtggagcagttgttagtgtgcgtggcaagcaggaaagaatagctatctggactaaaaatgctgccaatgaagctgctcagataagcattgggaagcagtggaaagaatttctggattacaaggactcgattgggttcattgttcatgacgatgcaaaaaagatggacaaaggtctcaagaaccgctacacagtttgatctgagcactcctgtccagatatccaagagagtagtatatccacatgtaggatgggttttcttcgatgctttagtgtttgtcattcgcttgtagcgagcgcttgaaggctataatattgccgtgaactgtttaaacttgaaacgtaatataatgacgtatcagaggtgtctctgtactctataaatcagtccagttcttccttaaaaaaaaaaaaaaaaaaaaaaaaaaaaa

SEQ ID NO: 292 - DNA, 949 bp, Sorghum bicolor
  CDS (78)..(707)
cgcaaacctctctccctcgtctggtatcgtctctcccacacccaaaaaaaaccctcgaaaagcggcggcggcgcgacatggcggaggtcgaggttccagctgctgcggtcgcgacgacgatccctgaggcggcggaggctaccgagggcggagccgctgcggaggcgaagggtccgcacaagctgcacaggcagtggaccttctggtacgacatccagtcgaagcccaagcccggcgctgcgtggggcacctccctcaaaaaggcctacaccttcgacaccgtcgaggagttttggagcttgtatgatcagatttttcgtccaagcaagttgtctgggaatgctgattttcatctgttcaaggctggagtagagccaaaatgggaagacccagagtgtgcaaatggtggcaaatggactgtcccatgcaacagaaaggcaacctttgagaacatgtggcttgaaacgttgatggctcttattggggagcagtttgatgaaacagaggacatttgtggaattgttgctagtgtccgtgcaagaggagataagctcgcattatggactaggactgccagcaacgaagctgtccaggtgaacattggcaagaaatggaaggatgtcatcgactacaatgacaagatcacctacactttccatgacgactccagaagagagaagccgagcaggggcggacggtacaccgtgtaagctgcacatcaacaaggttgcttggactggatagcgggcggagtggaattttctgctgagatcagcaccaactttcatttgataagccttggcttacctgaggcaattttcgcacctattgtgatgttattttgctttcagatagcttatgtagtacaagaaagagaggttggagacattgacgattttgtatgcaactgaatttctatctgaatctgccccgattcaactgcaaaaaa

SEQ ID NO: 293 - DNA, 890 bp, Sorghum bicolor
  CDS (9)..(668)
ctgccgccatggccgacgagatcgacacgaggccggcctccgcgggctcccggggccgccccgcgcacgctacggaggacgacgacagggaggagggagagatcgccgacgacacccccgcgcccgccctccccgtcacgcacccgctcgagcactcatggaccttctggttcgacaacccgcagggcaagaacaagcaggccgcctgggggagctccatccgacccatccacaccttctccaccgtcgaggacttctggggcctttacaataatattcatcaccctagcaagttggtcattggagctgacttccattgcttcaagaacaagattgaaccaaaatgggaagaccctatttgtgctaatggcggtaaatggaccatcagctgtggaagagggaaatctgacacactgtggctgcacactctgttggctatgattggcgaacaattcgactatggtgatgaaatttgtggagcagtcgtcagcgtgcgtggcaagcaggaaagaatagctatctggacaaaaaatgctgctaatgaagctgctcagataagcatcgggaagcagtggaaggaattcctggattacaaggactccattggattcattgttcatgacgatgcaaagaaggcggacaagggaccaaggaaccgatacacggtttgatcctgttgctggaaatctcagagtgtagcatgcgcacgtgtagggtggttctatccgaatctaatgcagacatgcagtagcaccttgcagagtttagactctagtgttgaaggttctctatttgctgaggagttgcttaagcataatctaacatgttgaatgtatttcctgtatgttccataaacataatctaacactcgggtgttgtttcgtcaaaaa

SEQ ID NO: 294 - DNA, 1267 bp, Oryza sativa
  CDS (73)..(1128)
caccctcccggcggccggagcggcgcgacttcccatctaacatattgcttccggcagccgccgccggacaccatggctgactctccgagcccacgcctggacgaggaggacgccttcggccgcgacttcaactcgtccccttcgcccacagccccacccgcccgctccggcgagaagaggccgttcggcgatctggacgacgatgacgaggacgttttcgcttccaagaagggaaagacaaaggtggaagaaagtgcgccaggtgctgccacgggaatgattctgtctcttcgcgagagtttgcagaactgtaaagataatcttgcgtcatgtcaggtggaacgggaggctgccaaatcagaagttcaaaagtggcattcagcatttcagaacattccagctgtacctgctggaaccaatccagatcctgtttcggttgtttcttatctcaataacctgaagtcgtcggaagaatcattgaaggagcagctggagaaagctaagaaaagagaggcggctttcattgtaacatttgcgaaacgtgaacaagaaattgcagaactgaagtctgcagttagggatttgaaaactcaattaaggccaccatcgatgcagacaaggagattattgcttgatccagcaatccacgaggaatttacacgattaaagaatcttgtggaggagaaggagaaaaagatcaaggaactacaggacaatgttgctgctgtcaattttactccatccagtaaacatgggaaaatgctaatggccaagtgtagaacattgcaagaggaaaatgaagagattggggcgatggcttctgaaggaaaaatccatgaacttggaatgaaaattgcagttttgaagactcggaacaatgaactcaggaatcagttcaatgagctgtataaacacatggatggtctaacaaatgacgttgaaagatcaaatgaaatggtggccattcttcaagatgagttagaaacaaaagatgtagagctgagaagattgaaggagatgcttgcccagaaagaagcaactgatgagaacaaaatacctcaagaaaatgacgtcgctggagatgatatagttgctgccgccgagagtcagccaataaaagtagaaacataagctacgccttcagcagtcatttctagagtagcttgcgttctcaacattcttattattttttgtatcatgtatcagaagtgtttacttgtgtaatttatctaatgtcgtttattctaaaaaaaaaaaaaaaaaaaaa

SEQ ID NO: 295 - DNA, 885 bp, Zea mays
  CDS (172)..(669)
ggtcacacccaacctcccactgtaaaaaagagcagcggaacgtgcgtgcatccatccatccatccatttccaatcccaatcccaatcccaccagtgtccagtgctcggggaaccgacacagctcctcagcagagtagccagcacgacaagcccgatcagcagacagcaggcatggcactcgcggaggccgacgacggcgcggtggtcttcggcgaggagcaggaggcgctggtgctcaagtcgtgggccgtcatgaagaaggacgccgccaacctgggcctccgcttctttctcaaggtcttcgagatcgcgccgtcggcgaagcagatgttctcgttcctgcgcgactccgacgtgccgctggagaagaaccccaagctcaagacgcacgccatgtccgtcttcgtcatgacctgcgaggcggcggcgcagcttcgcaaggccgggaaggtcaccgtgagggagaccacgctcaagaggctgggcgccacgcacttgaggtacggcgtcgcagatggacacttcgaggtgacggggttcgcgctgcttgagacgatcaaggaggcgctccccgctgacatgtggagcctcgagatgaagaaagcctgggccgaggcctacagccagctggtggcggccatcaagcgggagatgaagcccgatgcctagtagtggcgattgcgaccagtgtttaacccatgacgcagcgccgtcacagatgtcccgtgtggtcttgcgctttagcaatttctctctggagggagcgtgtattgttatcttgtgatcgagagcctgtgtgctgcctttgcttcttgtgattatatagctactgaataaagatgtagcgttcttcaaaaaaaaaaaaaaaaaaaaaaaaaaaaaaaa

SEQ ID NO: 296 - DNA, 835 bp, Zea mays
  CDS (67)..(639)
ccacgcgtccgggggaacacacagaacatactcccgctgaagcgctgagaagtagataagaataatatggggttcagtgaggcacaggaagagctcgtcctccgttcatggaaagccatgaagagcgactccgagtcgactgctcttaagttcttcctcaggatctttgagatcgcgccgggtgccaagcagatgttctccttcctgcgcgacgccggcgacgcgccgctggagaaacaccccaagctcaaggcccacgccgtcaccgtcttcgttatggcatgcgagtcggcgacgcagctgagaagcaccggcgacgtgaaggtgagggaggccaccctgaagcggctgggcgcgacgcacgccagggcgggcgtcgccgacgcgcatttcgaggtcgtcaagacggcgctgctggacaccatcagggacgcggtcccggacatgtggacgccggagatgaaggcggcgtgggaagaggcctacgaccagctggccgccgtcatcaaggaggagatgaagaacgccgccgccgccgaggagcagacgaagaacgccgccaccgccgaggaggagattaagaacgccgccgccgccgaggaggagacgacgaacgccgccgcggctgttgatggttcctagctcccactacgctcctctgctagcgaccgtggcacgcgcaccgctgcgttgatgggtgcttttggactgctgctggcctgatacctacctacgaagctgttgctaatgctgctgcatttttgtttgtcgaccgcatcattgtgatgataaataaaatgttcagaaaatgcccgttaaaaaaaaaaaaaaaaag

SEQ ID NO: 297 - DNA, 1048 bp, Zea mays
  CDS (101)..(1009)
cctagccgcctgaggccgacgccaaatctctcctgaccgcaacggggaactcgacccccgcctccgccaccgccaccgcgccggtcgccgacccactcagatgaacacgtctccgtccagatacagggcaatgatgggaggctgggggggttcggatgggtacgagggatcaaagaggacgcgaatgatgatggaatcgaatccctacttcgcagtgaacgcagggagcccactggatgtctcaaagagggccaggatgatggaaccaggtgctccctattttggggctatgggaagcagcgccagcggtgccggcggcggcttctaccagccctttaacagcaacctagctggtgcagggtctagcaccggtatccaaagcttcccatgtgtccggctgcgaggccttccctttgattgcaacgacattgacgtctgcaagttctttgtggggctggacatagtggactgcctcctggtcaacaagaacgggcgcttcaccggcgaggctttcgtggtcttcccaacatccatgcaggcagagtttgcgctgcatcgcgacaggcagaatatggggcggaggtatgtcgaggtgttcaggtgcaagaagcacgagtactactgcgcaatagccaatgaggtgaaccagggcggttatttcgagccggagtaccgtcgctccccgcctcctccgaggcctaggaagccgtctgaagataagggcagcatggagtacacagaggttctgaagctccgcgggcttccctactctgccaccactgaggacatcatcaagttcttcctggagtacgagctggcagaggagaacgtgcatatcgcctaccgcaccgatgggaaggccacgggtgaagccttcgttgagtttccgacagctgaagtcgcgaagacggccatgtgcaaggataagatgaccattgggacgaggtacgtggagctgttcccgtcgaccccagaggaggccagcagggcgaaatcccgaggcaggcattgaagaaacgtgttccagtgatcttctgtatgcatgcat

SEQ ID NO: 298 - DNA, 1797 bp, Zea mays
  CDS (528)..(1544)
gccggcgagccccgctccgagcatctccgctgctgcttctgccgaatcccagagctccttctcccgcttgccccctttccctcctgtcacattgattcgattttcgtcgcccatggagctacaaattaagtgtaggaaccaattaaaagcttgccaaaactagggcggcggcatcagcattcagcaataccctaggcgggctctcctcgcctccacagctccaggaagccgacccagagcagcacagcgccgcccattctgtctctctcggtctcggcagcgtaggcagcgtcaccctccgcttaaaccaccagcaccagctgctggtgcgccgccccgcccggcaccgccgctcctctacctcttcctggtggattggtgagaggaagccctaacttggcctctcttgaatcaactcggcggtggctttgagtcagtaggtgttgttttgcgctcttattcaaaacccaaatctgtccctcctctcagattattgtgagtttatccctgccccaatccatctgtccatggtccgcgtgggcttgtcttccgcgcccggggtcaatctgacagagcaaatcgataatgtttttgaccaactgatcaacaagatagaacatgcggattttgatacgcggcctttcttgaaacaattgaatgtgttaggccgctatgaaccaatcaagcggaatgtatattgcactaagagacgcattgaagattatggcatttcttgtcactgtaagccttctcctggttcatcagttgtgtgtggcagagactgccattgtggcatgcttttctcttgctgttcatcacaatgtgaatgtgatgacacatgcaccaataaatcattccagcacagacctcttaagaaaaccaaattgattaagacagagaaatgtggtcatggattggttgctgaggatgaaataaagaaaggagaatttgttattgagtatgttggagaagttattgatgacagaacatgtgagaataggctatggacaatgaaaaggctgcttgacactgacttctacctttgtgaggtcagtagtaatatggtcattgatgcaacaaacaagggaaaccggtcccgattcataaaccatagctgtgaaccaaacacagcgatgcagaaatggactgttgatggagagaccagggttggaatttttgcacttcgtgacataaagataggggaggagctgacctatgactataaatttgtccagtttggagcagctcaagtttgtcattgtgggtcttcgaactgcagaaaaatgctaggcacgacgaagtattcaggaagctcacagaatcatcatgccaagaagaaaaagcggaaaacaagttgtgagaattgcatacagcagtttcttcggctgtggcatccacataaaaaaatgtatgttggttgttggataattgacttcgatcaagaaactaaaatgcatactctgaagttcaatgatctccatactgaaaagttcaatttgaaggaagaagaatggcacttcttagaggtcgattttgatgaagattgatcattgaaggtaactgcaagagttggctgccatggtttgtgacagggttgccatggtttgctgcaccgccggcctactagttgggggttcatttgcgatggcagcatagacagacggacggccatttttcttccattttggagtaatagtccaagcctgaactgtgacattcgtgcatgcttatacgtgaaagtgtacctgagagcagattatacgtgaaagtgtatcagcgttgcataaaaaaaaaaaa

SEQ ID NO: 299 - DNA, 3380 bp, Zea mays
ctcttctccccccactcctcccccaccaaatcctcgttcatttttttttccaagcgacttcgcgtgtgagggcgggagagcgcgcggggctagggtttccgcgggtgatggaagcagaggctgccgcggcggtagtggcgtcgtccgcatctgcctcggcttccgcgggccggtctcgcccatctagcagcgccgcccaggtcaccagtaattcggctgtgcgagctggagaagaaaatgctgcctccctctatgttttatctgttattgactcgttaaaaaagaggattaccgcagatcgtttgacttacattaagaataggataggggagaacaagactaatatcagcagctatacacagaggacttacaatttatcaaaaaataggcaaattagtacatcaaagggtactgattcagcatcaaatttgctcacaaaaaggcaagatgatgcgctatgcaccctgcatagtcttgatattattccggttgacaaagatggtggcacttttcaagacgaaagtcctttctcttcatctaatgttatgtttggtggaaatcttggtcccaagaatgctattattagaccaattaaactaccagaagtgccaaagcttccaccttatacaacatggatatttttggacaggaaccaaaggatgacagaagaccaatctgtacttggtcgacggaggatttactatgataccagttgtggtgaagctctaatttgcagtgatagtgaagatgaagccattgaagatgaggaggaaaaaaaggaatttaaacattctgaagatcacattattcggatgacagttcaagaatgtggcatgtctgatgctgtactgcaaacgctagctcgacacatggagcgggctgctgatgacataaaggccaggtatgaaattctgcatggtgagaaaactaaggattcttgcaagaaagggactgagcataatgtcaaagtggaagatttgtactgtgacaaagatttggatgcagcattggattcttttgacaatctcttctgtcgacgatgtctagtacgcttgactgtaactttcagatattcttttctaggacctgtgtgctgatggacatttctgctcattggtgatgctgataggtgtttgattgcaagctacatgggtgttctcaagatttagtatttcctgtaagttttcacaagttgaaagagttatttataaaattgtgtgtttacttgatttgtgtcttctttgtacagacagaaaaacaaccagcttggagtggcgttgatgacagtgtaccctgtggtattcattgccataaactggcatctgaaccagattctgctgctggtgctgatcacatgctttttgatgttgaggagccaactcactcatcagacaatgtgatgaaccagccaggttcaaataggaaaaagaacggctccagtggaaggaagactaaatctcaacaaagtgaaagctcttcaactgcaagagttatctcagaaagcagtgattcggaagtacatccaataagcaataaatctccacaacactcccctagtccctcaaaagttaaaattgggccaaaaggtggaatcagaaagattaccaatagacgaatcgctgagagaattcttatgagtgtgaagaaaggacaaagggaaatggcatcatctgattctaattttgttagtggatatcttttggcaagggacatgaagcttaggtctgatacacgaaatggaaataaggaattaattgtatcctcacaacagagttctccaagcacaagaagttccaaaaagaagagtacacctcaaattgggaacagctcagcttttgctgaggctcataatgattcaacagaggaagcaaataaccgtcattcagcaacagatggttacgatagttcaaggaaagaagaattcgtcaatgagaatttatgcaagcaggaggtgtacttgagatcatggaaggcaattgagcagggacttcttgtgaaaggattagagatttttggaaggaacagttgtttaattgctcggaaccttcttggtggaatgaagacgtgcaaagatgtttttcaatatatgaattatattgaaaacaacagtgcctctggagctcttagtggtgttgattctcttgtcaaaggatatattaagggtactgagttgcgcacaagatcaagatattttagaaggcgaggtaaagtccgtcgtttgaagtacacctggaaatctgcaggttacaatttcaaaaggattaccgaaaggaaggatcagccttgtcgacaatataatccttgtggttgtcaatctacatgcggaaagcagtgtccatgtctttcaaatgggacatgttgtgagaaatactgtgggtgtccaaaaatttgcaagaatcgttttcgaggatgtcactgtgcaaagagccagtgtcgcagccgccaatgtccatgttttgcagctgacagggaatgcgatccggatgtttgcagaaactgttgggttgggtgtggtgatggtacattgggagttccaaaccagagaggagataattatgaatgccggaacatgaaactgcttcttaaacaacaacaaagggtcttacttggaagatcagatgtctctggctggggagcattcctcaagaatagtgttagcaaacatgaataccttggtgagtacactggggaactaatctcacacaaagaagcagataagcgtggaaagatatatgatcgtgagaactcatcgttccttttcaacctgaacaacgagtatgttcttgacgcatacagaatgggtgacaagctgaaatttgccaaccatgcccctgacccgaattgctatgccaaggttatcatggtaactggtgatcatagagtgggcatattcgccaaagaaagaatcctcgctggtgaagagttattctacgattaccgctatgagcctgacagagcccctgcttgggcccgtaagcctgaggcgtcgggagcaaaggatgatgggcaaccgttcaatgggcgtgcaaagaagctcgcccaaaacaacagaggctgaatctgatttgattctttcattgttaggacaaatttggcagccattcaactaatataaggaacctgtcattcataggccccaatttatttgaactcgtcattgtaactcgtatgtgcttgaattctccatggcagctggtcctgccatccgtagagttaggtcccgtttgttttgaggaactaaaaattaatccctctattttagtcacattgagtcttagattgttaaacggcgggactaaaacaaaagactaaactatttgtctctagtacctcaagccatgactaaaagggaataaatcatataaattttattttaaaaa

SEQ ID NO: 300 - DNA, 2941 bp, Zea mays
ccctcttctccccccacccctccctcccccaccaaatcctcgttcattttttttccaagcgacttcgcgtgtgagggcgggagagcgcgcggggctagggtttccacgggtgatggaagcagaggctgccgcggcggtagtggcgtcgtccgcatctgcctcggcttccgcgggccggtctcgcccatctagcagcgccgcccaggtcaccagtaattcggctgtgcgagctggagaagaaaatgctgcctccctctatgttttatctgttattgactcgttaaaaaagaggattaccgcagatcgtttgacttacattaagaataggataggggagaacaagactaatatcagcagctatacacagaggacttacaatttatcaaaaaataggcaaattagtacatcaaagggtactgattcagcatcaaatttgctcacaaaaaggcaagatgatgcgctatgcaccctgcatagtcttgatattattccggttgacaaagatggtggtacttttcaagacgaaagtcctttctcttcatctaatgttatgtttggtggaaatcttggtcccaagaatgctattattagaccaattaaactaccagaagtgccaaagcttccaccttatacaacatggatatttttggacaggaaccaaaggatgacagaagaccaatctgtacttggtcgacggaggatttactatgataccagttgtggtgaagctctaatttgcagtgatagtgaagatgaagccattgaagatgaggaggaaaaaaaggaatttaaacattctgaagatcacattattcggatgacagttcaagaatgtggcatgtctgatgctgtactgcaaacgctagctcgacacatggagcgggctgctgatgacataaaggccaggacctgtgtgctgatggacatttctgctcattggtgatgctgataggtgtttgattgcaagctacatgggtgttctcaagatttagtatttcctacagaaaaacaaccagcttggagtggcgttgatgacagtgtaccctgtggtattcattgccataaactggcatctgaaccagatgctgctgctggtgctgatcacatgctttttgatgttgaggagccaactcactcatcagacaatgtgatgaaccagccaggttcaaataggaaaaagaacggctccagtggaaggaagactaaatctcaacaaagtgaaagctcttcaactgcaagagttatctcagaaagcagtgattcggaagtacatccaataagcaataaatctccacaacactcccctagtccctcaaaagttaaaattgggccgaaaggtggaatcagaaagattaccaatagacgaatcgctgagagaattcttatgagtgtgaagaaaggacaaagggaaatggcatcatctgattctaattttgttagtggatatcttttggcaagggacatgaagcttaggtctgatacacgaaatggaaataaggaattaattgtatcctcacaacagagttctccaagcacaagaagttccaaaaagaagagtacacctcaaattgggaacagctcagcttttgctgaggctcataatgattcaacagaggaagcaaataaccgtcattcagcaacagatggttacgatagttcaaggaaagaagaattcgtcaatgagaatttatgcaagcaggaggtgtacttgagatcatggaaggcaattgagcagggacttcttgtgaaaggattagagatttttggaaggaacagttgtttaattgctcggaaccttcttggtggaatgaagacgtgcaaagatgtttttcaatatatgaattatattgaaaacaacagtgcctctggagctcttagtggtgttgattctcttgttaaaggatatattaagggtactgagttgcgcacaagatcaagatattttagaaggcgaggtaaagtccgtcgtttgaagtacacctggaaatctgcaggttacaatttcaaaaggattaccgaaaggaaggatcagccttgtcgacaatataatccttgtggttgtcaatctacatgcggaaagcagtgtccatgtctttcaaatgggacatgttgtgagaaatactgtgggtgtccaaaaatttgcaagaatcgttttcgaggatgtcactgtgcaaagagccagtgtcgcagccgccaatgtccatgttttgcagctgacagggaatgcgatccggatgtttgcagaaactgttgggttgggtgtggtgatggtacattgggagttccaaaccagagaggagataattatgaatgccggaacatgaaactgcttcttaaacaacaacaaagggtcttacttggaagatcagatgtctctggctggggagcattcctcaagaatagtgttagcaaacatgaataccttggtgagtacactggggaactaatctcacacaaagaagcagataagcgtggaaagatatatgatcgtgagaactcatcgttccttttcaacctgaacaatgagtatgttcttgacgcatacagaatgggtgacaagctgaaatttgccaaccatgcccctgacccgaattgctatgccaaggttatcatggtaactggtgatcatagagtgggcatattcgccaaagaaagaatcctcgctggtgaagagttattctacgattaccgctatgagcctgacagagctcctgcttgggcccgtaagcctgaggcgtcgggagcaaaggatgatgggcaaccgttcaatgggcgtgcaaagaagctcgcccaaaacaaccgaggctgaatctgatttgattctttcattgttaggacaaatttggcagccattcaactaatacaaggaacctgtcattcataggccccaatttatttgaactcgtcattgtaactcgtatgtgcttgaattctccaaaaa

SEQ ID NO: 301 - DNA, 1383 bp, Zea mays
  CDS (71)..(814)
gcctgaagaacttttgccacatggcagttctttgccttgggaaggatttcactatatcacaaaccgtgtgatggattcatctcttattgattcagagaactctatgcctgggtgtgcatgttctcatcctgaatgttctcctgagaactgtggtcacgtgagtctctttgatggtgtctacaatagcctggtggatatcaatggaacaccaatgcatggcagatttgcatatgatgaagatagtaaaattattttacaggaagggtatccaatatatgagtgcaattcatcatgtatttgtgactcgtcctgccagaataaagtattgcagaaagggctgcttgttaggttggaactctttagaagtgagaataagggttgggctattagggctgctgaacctattctacagggtacctttgtctgcgagtatattggtgaagttgtgaaggctgacaaggctatgaaaaatgcagaaagtgtgtcatcaaagggtgggtgcagttacttgtttagcattgcttcccagattgatagggaaagagttcggactgtaggggctattgaatactttattgatgccacaaggtctggaaatgtttcccgttatattagtcacagttgttccccgaatctcagtacccggttggttttggtagagagcaaagattgccagcttgctcacattggattgtttgctaatcaagatattgccgtaggagaagaactcgcctatgattaccgacaaaagcttgtagcaggcgatggctgcccatgccattgtggaactaccaattgccgaggccgtgtctattgattttgcaggaatacactaactgttcaatgctcggttgcagaactccagagatttcaacagttgtgtaggcttgctgagcgatttagcattgcaattttcctacagcttgagtgcagggctaggatctcattgttaatgctacaaatagtgattgtgatataggactcaggcaagcattaggcaataacatagtgtcgattttagtcatggtaccatcatgtttaactgattatttgttagaagcagcctgaaatgaaactgattcaggctgctctgttcgtaggcgagaattctctctgtaaaattccttcatattttatggttcatgagcaccatcattgacgtgaagtaataaactagttatcccagtggcctattgtgcggataatactccctctgttttttttagggagcgacaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 302 - DNA, 3061 bp, Zea mays
  CDS (34)..(2706)
ggggccgtcgcagaattcgcgccaccgcccgcgatggcttcgtcctcgaaggcctccgattcctcccaacgatccaagcggtcggatcaggggatgggcaaggacgccgctgccgcctctgttgtcccgatccacgcgaacctgacgcagctgatacggcaagtccaatcggggcgcctcgcgtacatcaaggagaaattggaggtgaacaggaaaacgctgcagaggcactcctgctcgctgttcgacgtggcagcggcggcggaggtggcgtcgaggggcaccgatggcggcaacgcgctgtcacagcgcgcggcggagagacagtgtgggtcagacctggcaaacgggataggggagagggacgtggtttccgttcaggaggagaacctggctaccggtacgctcgcgctctccagctcgggcgctaccgcgcagcggacaattgtgcggttcgtgaagctgccgctggttgagaagatccctccgtacaccacttggatcttcctggacaaaaaccaaagaatggctgacgatcagtcagttgttggtaggagaaggatatactatgatacagttggaaacgaggctctgatctgcagtgacagtgatgaagaaattccagaaccagaggaagagaaacactttttcacaaagggagaagatcatttgatatggagagctactcaagaccatgggttaaaccaagaggttgttaatgtcctttgccagtttattggtgcaaccccatcagaaattgaggaaagatctgaagtcctatttgagaaaaatgagaagcactcaggatcttcagataagatagagagccgactttctcttgacaaaactatggatgccgttctggattcttttgataatctcttctgccgcagatgcttggtttttgattgccgccttcatggttgttcacagaatttggtatttccatgtgagaagcaaccctacagctttgaccctgatgaaaacaagaagccatgtggtcatttgtgctaccttcgatggagagaaggatttaaagagatgcatgatgatggtcttgctggtggtgcaacatatactatggaatcgggaactgcctcacagagagttgatgttaatgttatgtatgaatcagaagattcaaaccgacagaaaggcaacattaggtccatgacactagttggaaccagtggatcaaaaataatttcttctgtcagtgcggaagaaagcactactactccttcagcagatatctctgaaacagagaatgtatcctctgatttgcctcccagtagtttaaggaaacacaagatttcaaaacatggacctaggtacagggagcattctcctggcaaaaggcagaaggttttcacttctgacatttcttttgaaggcaatataatgaataaactttccattccggagattcgtgacacaagactagagtccagagaatctggtggtgataaactacgaattcttgacgagtccactaagaagacttcaaggaaagatatgtgtggggaaagcccagctactaccatggaaaatgtgggaagacagagtaataaagtgtcttcaacaaagaatttcttggagtccactctttcttgttggagtgccttagagcgagatctatacttgaagggcatagagatatttggaaagaacagctgtctcatcgccagaaacttactatctggtcttaagacctgcatagaagtggcaaactacatgtataacaatggtccagcgatggcgaagagacctctcttgaataaatccatctcaggcgactttgcagaaaatgaacaagactacatggagcaagacatggctgccagaacaagaatctatcgtcggaggggccgcaatcgaaagctgaaatatacttggaaatctgcagggcatccaactgttagaaaaagaactgatgacgggaagcaatgttacacacaatatagcccatgtgcgtgccagcaaatgtgtggtaaagattgcccctgtgcggacaagggaacttgctgtgagaagtactgtgggtgttcgaagagctgcaaaaacaagtttagaggctgtcattgtgcaaaaagccaatgcagaagcagacagtgcccctgttttgcagccagtcgtgaatgtgatccagatgtttgtaggaattgctgggtgagctgtggagatggttcactaggtgagccacttgcaagaggtgatggttatcagtgtggaaatatgaagctccttttgaaacaacagcaaaggattttgttaggaagatctgatgttgcaggttggggtgcattcattaagaatcctgtaaataaaaatgattatcttggagaatatactggtgaattgatctctcacaaggaagcagacaaacgcggcaaaatttatgaccgggcaaactcatcttttctgttcgatttaaatgaccagtatgtgttggatgcttatcgcaagggggacaaattgaagttcgcaaatcactcatctaaccccaactgctatgcaaaggtgatgctggtggctggcgaccatcgggttggtatatatgcgaaggagcatattgaggctagcgaggaactcttttatgattatcgttatggacctgaccaggctccagcttgggctaggagacccgaaggatcaaagaaggacgaggcatccgtctctcaccgtcgagcacacaaagtggctcgatagctgaagagtcgctccggatgatacaatatgcagtaaacttaatacttaatacatgattcagtcctagttcattggtagataaacatgctatatactatccattagtaaataaactctcattcatcgagttggagaataaatgcgtataaacatatgtggacctcaggtcgggaaggtggcaaccttgttagtttgagcaccaacaggttctcaaacttgagtggctattgctagagtatcaaataatggctgcgactatagccttgtttgtatattttcttggtgagatgaaataatttgtcaaacactcaaatgtacactttattcctgaaagtatttgatgattcaaaaa

SEQ ID NO: 303 - DNA, 3480 bp, Zea mays
  CDS (478)..(3045)
gcctgatctgcgcgtccctgtcctcggctcctgagcactcgcgtactcgctcgtcgcatctgcccacactaccactggccacaccgaaaccctagctgcgcacccaaatcgatcgatccagggacggcagcggcacgacgcgccaaaataggttcagaactagcgtcgcgacaaaatcggttcacgaccgccacggttggaccagctgcgccgtggccgtgcggctgtgcggccggcattggcgcgctgcgcgctgcttcaggccggtgtgccgcgcggctgggcgacgtgaaacggattcacatcgtaggagcagaacttgctggtcgaggtggaggcttgctgcgtgcagcaggacagggagtcagggacaacagattttagcaaagtatgagctgtgaactagtgttagaggaaagcacgaaggaaatagtggcataaaacttgatttgtctaaagataaattggtttcttaaaatggctcagcaaatggcttcagttcatttgaatgatacaacagttgttgatgccaagcccttgcgtacattgactcccatgttccctgcaccactagggcttcacacgttcactcctcagaactcaccttcagttgtttgtgtgaccccatttggaccatatggtggagggactgaattggggatgcctgctgttccaccaatgtttgcagcgcctgtacctgctgcaggagcagaacccagccagagacagccgcatacagctaatatgaacggaggagacactgaattggggatgcctgctgttccaccaatgtttgcagcgcctgcacctgctgcaggagcagaacccaaccagggacagccacatacagctaatatgaacggaactgcagtcaacagttcggtcacatctttgcaaactccttcagctgccacacaggaatctggtaagaggaagaggggcaggccaaagcgtgtgcctgatactactgtttcttcggctccttcagctcctctggctcctactatttctccagttccttcacttcctgtggttactccagttccttcagctcctcaggaattgaacactattgtttccctgacgccttcttcagacgccccacaagaatctggcaagaggaagaggggacggcccaaacgtatacaagacgttcctgtaatggttcctctgacctcgcaaggagatagcacatctgttattcagacacttccagggtccagtgtacatgaatctggtacgagaaggggacgtcccaaacgtttgcaggatagttcagatattgtcactccaattgactcaaaagatagtgagtcctctccccagccacctattgccgcacctgccgaaagtggtaagaggaagaggggacgtccaaagcgcattgatggttccgtgactccttcaagtcattctgttttttcaatagatgatgatgctgttgacacgatgaaacgtggacgacctaggaaaattgataccaaactgttacagtttccatctttattttcagatgatcctagacaaactgcagataatgtactcatgatgtttgacgccctgcgacgcagacttatgcagatggatgatgtgaaacaagctgcaaagcagcagcctaacttgaaagctgggagcatcatgaacaatgctgaacttcgtgtcaataaggacaagaggataggagaggttccaggtgttgaggttggtgatatgttctacttcagaattgagatgtgcttagtggggttgaatagtcagagcatggcagggatagattacatgtctgccaagttcggtaatgaggaggaccctgtagctattagtgttgtgtcagctggtgtatatgataacactggagatgatccagatgttctagtttatactggacatggcatgtcgggtaaggatgaccaaaaacttgagaggggtaatcttgcactagagaggagtttgcatagaggtaatccaatcagagtcattcgtagcgtaaaagacttgacttgtccaactggcaagatttacatatatgatggtctttacaagatcaaagaagcctgggtagagaaagggaaatctggtttcaatgtgtttaaacacaagttgcttagggaacctggccaacctgatggcattgcagtgtggaagaagactgaaaaatggagggaaaatccatcatctagagaccatgttatattacttgacatatcatatggtgtggaaaataaccctgtctgccttgtaaatgaggttgacgatgaaaagggccctagccgcttcacttatacaactaatttgacatatgggaattctctcagctcgatgagaaagatgcaaggttgcaaatgcataagtgtatgcctccctggtgataacaactgctcctgtacgcatcgaaatgctggtgaccttccttacagtgcttcaggcatacttgttagccgaatgcccgttttatacgagtgtggtgattcctgcacatgttcacaaaattgccggaaccgagttgtacagaaaggtacgcagatccgttttgaagtttttaagacaggagatcgtggttggggcctccgtagttgggatccaattcgagcaggcacatttatctgtgaatatgcaggtgaaatcattgacataaatagagtgaatggtgaagatgactacatatttgagacttctcctttagagcagaatttaagatggaactatgcaccggaattgctgggtgagcctagtctttctgactcaaatgaaacaccaaagcagctgcctatagtcatcagtgcaaaacgaaccggcaacatagctcgctttatgaaccacagctgctcacctaatgtgttttggcaaccagttctgtatgatcatggtgatgagggatatccacatattgcattctttgcaattaagcatattcctccaatgacagagcttacctatgattatggtcagaaccagcgtaatagtattcaaatgggaacccattctggttttcggaagtctaaaagttgcttatgttggtccccgaagtgtagaggttcctttggctaataaccagccctataaggaatatattggatcataatactccatttcaaagttacacctaagatatctgctggtcgacttttatattcagctcccaaaaatctgtcacaagtttgtgagagcaactgaattgtctttaccagcagaagcagcccgccatggtggcctgtatgaagcagcaggggtctcctatgtcctaggtgttccatgcaccatcgaataaatccacccctcttcatgttagaatgggaaacggggatgtgttttgcacaaattatctgtcatgcagtcgtcgtattaagttttcttgaactagtttgtagtcatcctcagagaatgcatgatgtgcactttgtagtaatatatgcaggttgttatcccacctaaaaaaaaaaaaaaaaaaaaaaaaaaaaaaaaaaaaaaaaaaaaaaaaaa

SEQ ID NO: 304 - DNA, 2985 bp, Zea mays
  CDS (37)..(2634)
gcggccgctgcccgggttttcgtcggtcccttcgccatgtcttcgctggacccttcgccagcgacgagcacccaacagaagcaattggagagtttggtaaatctactgacgcagggaagcaggttctaccgcaaagcatataatgaactgttctcaggtgtaactactgagcaggatccggattcatcgactaatattcctgagtatatgctttttgggtggcatctcttcttaatgctccattcgagatcaccagaattgttcaaggacctggtgtcctgcatccatggattagttgctgtgttggccatacttttgattcacgtgccagctaaatttaggagcttcacgattgaaggctcttctcacttaatcaaacaaactgagaaaggcgtggatcttattgcttcattatgtcataactatcatacctctgaagaacgtttgaaagaaatgttgcacaagtcttacaatgcaatagaagacattttccatatgaaagcactaagtgcttcagagtgcaaaccagaaaatttggataagatagacacagatgacctgatgtatttcaaaggtctgattgatatggaatgtttccagtcaaatttggaaaaaatggagaaactatgtaattctaatagctgtaaaggggagcttgattttaaatcaattttgatcaataatgattatattccctatgatgagaactcgacgggggattccaccaatttaggacgttcaaagtgtgcctttgaaacattggcatctcccacaaagacaataaagaacatgctgactgttcctagttcccctttgtcaccagccaccggtggttcagtcaagattgtgcaaatgacaccagtaacttctgccatgacgacagctaagtggcttcgtgaggtgatatcttcattgccagataagccttcatctaagcttcagcagtttctgtcatcatgcgatagggatttgacaaatgctgtcacagaaagggtcagcatagttttggaagcaatttttccaaccaaatcttctgccaatcggggtgtatcattaggcctcaattgtgcaaatgcctttgacattccgtgggcagaagccagaaaagtggaggcttccaagttgtactatagggtattagaggcaatctgcagagcggagttacaaaacagcaatgtaaataatctaactccattgctgtcaaatgagcgtttccaccgatgtttgattgcatgttcagcggacctagtattggcgacacataagacagtcatcatgatgtttcctgctgttcttgagagtaccggtctaactgcatttgatttgagcaaaataattgagaactttgtgagacatgaagagaccctcccaagagaattgaaaaggcacctaaattccttagaagaacagcttttggaaagcatggcatgggagaaaggttcatcattgtataactcactgattgttgccaggccatctgttgcttcagaaataaaccgccttggtcttttggctgaaccaatgccatctcttgatgacttagtgtcaaggcagaatgttcgtatcgagggcttgcctgctacaccatctaaaaaacgtgcttctggtccagatgacaacgctgatcctcgatcaccaaagagatcgtgcaatgaatctaggaacacagtagtagagcgcaatttgcagacacctccacccaagcaaagccacatggtgtcaactagtttgaaagcaaaatgccatccactccagtccacatttgcaagtccaactgtctgtaatcctgttggtgggaatgaaaaatgtgctgacgtgacaattcatatattcttttccaagattctgaagttggctgctattagaataagaaacttgtgcgaaagggttcaatgtgtggaacagacagagcgtgtctataatgtcttcaagcagattcttgagcaacagacaacattattttttaatagacacatcgatcaacttatcctttgctgtctttatggtgttgcaaaggtttgtcaattagaactcacattcagggagatactcaacaattacaaaagagaagcacaatgcaagccagaagttttttcaagtatctatattgggagtacgaaccgtaatggggtattagtatcgcgccatgttggtatcattactttttacaatgaggtatttgttccagcagcgaagcctttcctggtgtcactaatatcatctggtactcatccagaagacaagaagaatgctagtggccaaattcttggatcacccaagccatctcctttcccaaatttaccagatatgtccccgaagaaagtttcagcatctcataatgtatatgtgtctcctttgcggcaaaccaagttggatctactgctgtcaccaagttccaggagtttttatgcatgcattggtgaaggcacccatgcttatcagagcccatctaaggatttggctgctataaatagccgcctaaattataatggcaggaaagtaaacagtcgattaaatttcgacatggtgagtgactcagtggtagccggcagtctgggccagataaatggtggttctacctcggatcctgcagctgcatttagccccctttcaaagaagagagagacagatacttgatcaattataaatggtggcctctctcgtatatagctcacagatccgtgctccgtagcagtctattcttctgaataagtgggttaactggagcgatttaactgtacatgtatgtgttagtgagaagcagcagtttttaggcagcaaactgtttcaagttagcttttgagctatcaccatttctctgctgattgaacatatccgctgtgtagagtgctaatgaatctttagttttcattgggctgaaaaaaaaaaaaaaaaagggcggccggcgatcccacgcgtccgcccacgcgtccgcccacgcgtccgcccacgcgtccgcggacgcgtgggtcgacccgggaattc

SEQ ID NO: 305 - DNA, 889 bp, Wheat dwarf virus
  CDS (49)..(843)
cacaccccgttttttcgctaaggacctgccggacttctgttcactaccatggcctcttcatctgcacccaggttccgtgtctattccaagtacctctttctaacatatcctgaatgtacccttgagccacagtacgccttggattcacttcgcactctcttgaacaaatatgagcccctctacatcgctgctgttagagagctccacgaagatggatcaccacatctgcacgttctcgtgcagaacaagcttcgtgcttccatcaccaatcccaatgccttaaacctccgtatggatacatctccattctccatattccatccaaatatacaagctgccaaagactgcaaccaagttcgtgattacatcacgaaggaggttgactccgatgtaaacacagctgagtggggaacattcgtggctgtttcaactccaggtcgtaaagaccgtgatgcggatatgaaacagatcattgaatctagttcctctcgcgaggaattcctcagcatggtttgcaatcgttttccgtttgaatggtctatccgtctcaaagacttcgagtacacggcacgccatctatttcctgacccagttgccacttacacacctgagtttccaaccgaatcactcatttgccatgagaccattgaaagctggaaaaatgaacatctctactccgtaagcctcgaatcctatatcctttgtacttccactcctgcggatcaagcgcaatctgacttagagtggatggacgattattccaggagtcaccggggaggcataagtccatctacatctgcgggccaaccagaacaggaaagacttcctgggcaaggtctctagggacacacaattattataacagtctagttgatttcacaacatatga

SEQ ID NO: 306 - DNA, 1246 bp, Arabidopsis thaliana
  CDS (81)..(1136)
gtgtttcttctttctgctaaaaggttataatttttgtttcttggtttggtgagaatcttcaagaaactgaaacaaagaaaatggattctagttgcatagacgagataagttcctccacttcagaatctttctccgccaccaccgccaagaagctctctcctcctcccgcggcggcgttacgcctctaccggatgggaagcggcgggagcagcgtcgtgttggatcccgagaacggcctagagacggagtcacgaaagctaccatcttcaaaatacaaaggtgttgttcctcagcctaacggaagatggggagctcagatctacgagaagcaccaacgagtatggctcgggactttcaacgagcaagaagaagctgctcgttcctacgacatcgcagcttgtagattccgtggccgcgacgccgtcgtcaacttcaagaacgttctggaagacggcgatttagcttttcttgaagctcactcaaaggccgagatcgtcgacatgttgagaaaacacacttacgccgacgagcttgaacagaacaataaacggcagttgtttctctccgtcgacgctaacggaaaacgtaacggatcgagtactactcaaaacgacaaagttttaaagacgtgtgaagttcttttcgagaaggctgttacacctagcgacgttgggaagctaaaccgtctcgtgatacctaaacaacacgccgagaaacactttccgttaccgtcaccgtcaccggcagtgactaaaggagttttgatcaacttcgaagacgttaacggtaaagtgtggaggttccgttactcatactggaacagtagtcaaagttacgtgttgaccaagggatggagtcgattcgtcaaggagaagaatcttcgagccggtgatgttgttactttcgagagatcgaccggactagagcggcagttatatattgattggaaagttcggtctggtccgagagaaaacccggttcaggtggtggttcggcttttcggagttgatatctttaatgtgaccaccgtgaagccaaacgacgtcgtggccgtttgcggtggaaagagatctcgagatgttgatgatatgtttgcgttacggtgttccaagaagcaggcgataatcaatgctttgtgacatatttccttttccgattttatgctttcgttttttaatttttttttttgtcaagttgtgtaggttgtgattcatgctaggttgtatttaggaaaagagataagacc

SEQ ID NO: 307 - DNA, 1644 bp, Oryza sativa
  CDS (336)..(1430)
gtaattaactaggctcaagatagatagacgtcgtctctactactcctactagaaaacatatctttgtccaagcaaattaacaaaatcaaatatagcaagaacacgtttaattttgtacacatgctgcgtttgggttggtccaaataaaatacaaagaccagtgtctatatatacagagcacacgcccacagcaactatcactcttcatcatcatcttctttggcttctccctcttcactgccctaattacaacccatttgcttatctctctcctctctctctctctctcgctgcagccatagcttagctagagctagagctttcttggtgccgagatgggggtggtcagcttctcctcgacttcctccggcgcgtccacggccaccaccgagtccggcggcgccgtgcggatgtcgccggagccggtggtggcggtggcggcggcggctcaacagctaccggtggtgaagggagttgactcggcggatgaggtggtgacgtcgaggccggcggcggcggcggcgcagcagtcgtcgcggtacaagggggtggtgccgcagccgaacgggaggtggggggcgcagatctacgagcggcacgcgcgggtgtggctcgggacgttccccgacgaggaggcggcggcgcgggcctacgacgtggcggcgctccggtaccgggggcgcgacgcggccaccaacttccccggggccgcggcgtcggccgccgagctcgcgttcctcgccgcgcactccaaggccgagatcgtcgacatgctccggaagcacacctacgccgacgagctccgccaggggctccgccgcggccgcggcatgggcgcccgcgcccagcccacgccgtcgtgggcgcgcgagccgctgttcgagaaggccgtgacgcccagcgacgtcggcaagctcaaccgcctcgtggtgcccaagcagcacgccgagaagcacttcccgctccgccgcgcggcgagctccgactccgcctccgccgccgccaccggcaagggcgtgctcctcaacttcgaggacggcgaggggaaggtgtggcgattccggtactcgtactggaacagcagccagagctacgtgctgaccaaggggtggagccgattcgtgagggagaagggcctccgcgccggcgacaccatagtcttctcccgctcggcgtacggccccgacaagctgctcttcatcgactgcaagaagaacaacgcggcggcggcgaccaccacctgcgccggcgacgagaggccaaccacaagcggcgccgaaccacgcgtcgtgaggctcttcggcgtcgacatcgccggcggcgattgccggaagcgggagagggcggtggagatggggcaagaggtcttcctactgaagaggcaatgcgtggttcatcagcgtactcctgccctaggtgccctgctgttatagcatcaaatcaaattcatatatagatcaaatcaaatcttcttctcttccatcttttttgttgttcatcgtctgttgtttcatcttcgatttagagctgttctatcttcgactttctttttttgttttttgtctttattttgcatagaagtttgtcaggtcagagattgcaaatgatcgatcaagatcgagctgtatatgtacagccttatta

SEQ ID NO: 308 - DNA, 2001 bp, Oryza sativa
  CDS (572)..(1522)
aaagcgacaattaaattgtttcaccaaaaaaaaccaattaaaattatcagtaaaaatactaaaatagctaagaatatatgtatgctcatggaccatttctgtggaaaaagcatgctggcttgcacgaatcaaatttaattaaatatggtacacatcaaaactaaataatagcatcgaccaaaatagtcgattactaacagagattctcgtagccacacatgcctaaacagtaggcacaaacgaacacttgcctgaaaagatcacgcaaaaaatatagcataaaatgacagtctcaacagtgtaaagtttgcaagaatgtgcaattagaagctaacataaacacaaaactagctatcatacatacgagtgaagggctggaagcagctaagctgaaagctcaacacaacatatactaccaatctagctacaaggccactccaagtcgcatatatactagtatctataagctaggctgttctctctttccattcgtcaagaactaccacgacgtcgacatcataatcgtcagagagctcgagaaattttttagtatctttgatccagatcgatcatggagcaagaagctgccatggtcgtcttctcctgcaactccggctccggtgggtcgtcgtcgacgaccgattcaaagcaagaggaggaggaggaggaggagttggccgcaatggaggaagacgagttgatccacgtcgtccaggcggcggagctgcggctgccgtcgtcgacgacggcgacgcggccgtcgtcgcggtacaagggggtggtgccgcagccgaacgggcggtggggggcgcagatctacgagcggcacgcgcgggtgtggctcgggacgttccccgacgaggaggcggcggcgcgcgcctacgacgtggcggcgctccgcttccgggggcgcgacgccgtcaccaaccgcgccccggcggcggagggcgcgtccgccggcgagctcgcgttcctggccgcgcactccaaggcggaggtcgtggacatgctgcggaagcacacctacgacgacgagctccagcagggcctccgccgcggctcgcgcgcgcagccgacgccgcggtgggcgcgcgagccgctgttcgagaaggccgtgacgccgagcgacgtcggcaagctcaaccgcctcgtggtgcccaagcagcaggccgagaggcatttcccgttcccgctccgccgccacagctccgacgccgccggcaagggcgtgctcctcaacttcgaggacggcgacggcaaggtgtggcgattccggtactcgtactggaacagcagccagagttacgtgctcaccaaggggtggagccgattcgtgagggagaagggcctccgaccaggcgacaccgtggccttctcccggtcggcggcggcgtgggggacggagaagcacctcctcatcgactgcaagaagatggagaggaacaacctggcaaccgtcgacgacgatgcccgtgtcgtcgtcaagctgttcggcgttgacatcgtcggagacaagacgaggtaacacgcaagcgcagctagctgcatcgtatcgatcatatatatcaccccggcgccttcttcttcttcttcttcttcttcttcttcttcttcttcttcttcttcttcttcttcttcttcttcttcttcacttgttcttcgttttcttcctcttcgatcttctcattcatcttctgttgctgccctagctacaatgatcgatcgatggatgatccatatcatcgttgatccttcgcttcacatcaggttcatcattcctagctacatcgatatatgtacctataatttgatgatgagatgaacttcttcaaaattcaaattaatctctgaagaaaccaacggagaattaggatcagagtgtgctagctacatgtgagctagagattagagaaatttaagagtgtgtgttatatgtaaatatatcgatcattgccagatcgatcgaggcgaaactatagaattttgccttggggtttaatt

SEQ ID NO: 309 - DNA, 1008 bp, Zea mays
  CDS (1)..(747)
atggtgaagctcgcattcggaagcgtcggcgactccttcagcgtcacctccatcaaggcctacgtggccgagttcatcgccaccctcctcttcgtcttcgccggcgtcggttccgccatcgcctacgggcaactgacgaatggcggcgcgctggacccggcgggcctggtggcgatcgcgatcgcgcacgcgctggcgctgttcgtgggcgtgtccgtcgcggcgaacatctcgggcggccacctgaacccggccgtgacgttcgggctggccgtgggcggccacatcaccatcctgacgggcgtcttctactgggtggcccagctgctgggcgccaccgtggcgtgcctgctcctcgggttcgtcacccacggcaaggccatcccgacgcacgccgtcgcgggcatcagcgagctggaaggcgtcgtgttcgaggtcgtcatcaccttcgcgctcgtctacaccgtgtacgccaccgccgccgaccccaagaagggctcgctcggcaccatcgcgcccatcgccatcggcttcatcgtcggcgccaacatcctcgccgcggggcccttcagcggcggctccatgaaccccgcccgctccttcggccccgccgtcgccgcgggcgacttcgccggaaactgggtctactgggtcggcccgctcgtcggcggcggcctcgctggcctcgtctacggcgacgtcttcattggcggctcctaccagcaggtcgcggaccaggactacgcctaatttattcaccactccatctccgctctggatgaatggattcaaaaccgtcgtcgtttgcttttgctcctcgccacgttcaattaatggttgtgtatgcatgtatgtgccaatatgatgtgcctttgccctggtccattcatttccctttcttttttcggggtgaaatagatgtaaagatctcgtcttgcctgccgtactcgcgctgtgttgggaaaaattggttttcgttccaaaaaaaaaaaaaaaaaactcgagggg

SEQ ID NO: 310 - DNA, 1157 bp, Zea mays
  CDS (1)..(864)
atggcgaagcaggacatcgaagcatcggggcccgaggccggcgagttctcggccaaggactacacggaccctccgccggcgccgctcatcgacgcggatgagctcaccaagtggtccctctaccgcgcggtcatcgccgagttcatcgccacgctgctcttcctctacatcaccgtggccaccgtcatcgggtacaagcaccagacggacgcggcggcgtcgggccccgacgcggcgtgcggcggcgtgggcatcctcggcatcgcgtgggccttcggcggcatgatcttcatcctcgtttactgcaccgccggcatctacggggcacataacccggccgtgaccttcggcctgttcctggcgaggaaggtgtccctcgtccgcgccctgctctacatcatcgcgcagtgcctgggcgccatctgcggcgtcggcctcgtcaatgggcttcagagcgcctactacgtgcgctacggcggcggcgccaacgagctcagcgacggctactccaagggcaccggcctcgccgccgagatcatcggcaccttcgtgctcgtctacaccgtcttctccgccaccgaccccaagcgcagtgcccgtgactcccacgtcccggtgttggcccctcttccgattgggttcgccgtgttcatggtgcacctggccaccatccccatcaccggcaccggcatcaacccggcgaggagcttgggagccgcggtcatctacaacaaggacaaggcctgggacgaccaatggatcttctgggtgggcccactgatcggcgccgccatcgccgccgcctaccaccagtacgtgctgagagccagcgccaccaagctcgggtcctaccggagcaacgcctaataagtccggcggcgggagctgtgggcgccaccgatcgatccaagtgtagatacgtacgctcccccgactccgtccagtatatgacgccctgtggtcgtccacatctgccaccacagtcccgtccgcttggtgctgttttctttctttccttgacggggaaaaaaagtgtgatatatctttgctttctgtatatgtgacaaaatgcattctgtaagccagtcatgtgagtttttatttaaccacagtctacttttagaacgatttaaaaaaaaaaaaaaaaaactcgaggg

SEQ ID NO: 311 - DNA, 1135 bp, Zea mays
  CDS (177)..(860)
cacgacttcctcccgccgccggttggcttcgctgctcgtccacctccgcccggcccgtgggacgagtggggactggagagggtcgcctctgggcttcgcctctcggcggccgagtgtctgcgtcgtccacggagctgagagcctgagactgagactgagagcgaccggcggcggggatggcgagggagaggcgggagataaagaggatagagagcgcggcagcgaggcaggtcacgttctccaagcgccgccgcggcctcttcaagaaggcccaggagctctccgtgctgtgcgatgccgacgtcgcgctcatagtcttctcctccacggggaagctctcccagttcgccagctccagtatgaatgagataattgacaagtacaacacgcattctaaaaacctggggaaaacagaacagccttcgctggacttgaacttagagcatagcaaatatgcaaatttgaatgagcaacttgcggaagcaagccttcgactcaggcagatgagaggtgaagagcttgagggattgaatgttgaagaactccagcaattggagaagaacctggaatctggtctgcatagggtgcttcaaacaaaggatcaacaattcttggaacagatcaatgacctcgaacgtaagagtacgcagctggcagaggagaacatgcaactgaggaatcaagtatcccagatacccccagctggcaagcaagcagttgctgatactgaaaatgttattgctgaagaagggcaatcctctgaatcagtgatgactgcgttgcactctgggagttcacaggataatgatgatggttcggatgtatctctaaagttagggctgccttgcgttgcatggaagtaaacaggaaatgaggctccttgtcgattctgggtgtggatgtgggtggagctgcggcctcagcggataggcacttgtgtatggttttatggacgaccggcccccgactacgtactgcaataatcttgcattggaagcgagatcggttaacctgatttgtcatcccttgtggcttcatgatgcgatgttccgcttgtaccgtttgctagcatgttaactgaatttttagaatcgcatatacttttgttcctatatatcactgtcgtactgctcgt

SEQ ID NO: 312 - DNA, 1021 bp, Zea mays
  CDS (93)..(791)
cctccggactgctccggacgcgcgcctcagatctactccaacacctccgcagcggcggcgcccgcgggtggaggagcaggagaggcggcgccatggtcgggaccgggaagagggagcggatagcgatacggaggatcgacaacctggcggccaggcaggtgaccttctccaagaggcggcggggcctgttcaagaaggccgaggagctctccatcctctgcgacgccgaggtcggccttgtcgtcttctccgccaccggcaaactcttccacttcgccagctccagcatgaagcaggtaatcgatcggtacgactctcattccaagactctccagaggtccgaaccgcagtcgtctcaactgcagtcacatatggatgacggcacttgtgcaaggctaaaggaggaacttgctgaaacaagccttaagctcaggcagatgagaggagaggagctccagaggctgagcgtcgaacagctgcaggagctcgagaagaccctcgaatccggcctcggctctgtactcaaaaccaagagccaaaaaatccttgacgagatcagcggtctggaaagaaagagaacgcagctgatcgaggagaactcaaggctgaaggagcaagtgacacggatgtcgaggatggagacgcagcttggcgccgatccagagttcgtgtacgaggaagggcagtcgtctgaatccgtgacgaacacgtcctatccgcgcccgtccaccgacaccgacgactgctccgacacatcgctcaggctcgggctaccactcttcagctccaagtgacggagatttgacatgtccggtagcggagcggtgccgattgcttgcccttctccactctagataggtctggattgggggagagcaagcactgctggatcgggaagacccaagtgaccaacgcgtcgcatcagaataaggcattttgagtgctgtatgatgtgtgtattctggctctgaaagtgagacctgcttttgttataatacatacatacaggcagcatggcaat

SEQ ID NO: 313 - DNA, 876 bp, Glycine max
  CDS (96)..(713)
attcggctcgagctaactggcaactaattaacgtgtttgggactcgcgagttgtgcattcctaacacccatttcaggaagcccaagcattgggagatgactagaaagaggatacagatcaagaaaatcgacaacatcagttcgaggcaagtgactttctccaagagaaggaaagggcttttcaagaaggctcaggagttgtcaaccctttgtgatgcagacatagctctcatagtcttttctgcaactagcaagctctttgagtatgccagttcaagcatgcatcaagtaattgaaaggcacgatcgctattcagcaatccatagattggatcgcccctctattgagctgcagattgagagtgactccaacaacattctgcgcaagaaagtagaagataagactcgtgaactgaggcagatgaatggggaagatctgcaaggattgacattacaagaactgcagaaactagaggaacatcttaaaagaagtttgaccaatgtttcaaaagtaaaggatgcaaaatttatgcaagagatcagcacctttaagagaaagggagtggaactaatggaggaaaaccaaagactgaaacaggtgccgagccttatccatgcacatagctataggcaatcatcggaatccattcttagcaattcatctaaccttcctgaagatggtggtagcaacacatctctcaagttggggttaccttaaataatgaacaaaatgtagattatttagaagtgatcggtttcgcttcctttatatgtcagtcaaaaccaattgaatatcctgtgttgtttgctgtttaaaaacaactcgtgtaaagtaagtaaatccaaaggatgaggtcctgcatgtagaattgtgcttg

SEQ ID NO: 314 - DNA, 999 bp, Glycine max
  CDS (60)..(674)
cggacgcgtgggcccaggcattggtgggttcttaccctttattattattattattggagatgactagaaagaggatacagatcaagaaaatcgacaacatcagttccaggcaagtgactttctccaagagaaggaaagggcttttcaagaaggctcaggaattgtcaaccctttgtgatgcagacatagctctcattgttttttctgcaactagcaagctctttgagtatgccagttcaagtatgcatcaagtaattgaaaggcgcgatagccattcagcaatgaatagactggatcgcccctcaattgagctgcagattgagaatgactccaatgaaatcctgcgcaagaaagtagaagataagaaccgtgagctgaggcagatgaatggggaagatctgcaaggattgacattacaagaactgcataaactagaggaacaccttaaaagaggtttgatcaatgtttcaaaagtaaaggatgaaaaacttatgcaagagatcagcacgcttaagagaaagggagtggaactaatggaggaaaaccaaagactgaaacaggtggtaccgagccttatccatgtacataggcaatcatcggaatccattcttagcaattcatctaaccttcctgaagatggtggtagcgacacatctctcaagttggggttaccttaagtattcaacaaaatgtagattattagaagtgaccgggttcgcttcctttatatatgttttaagtgtttcactcaaaaccagttgagtccagtgatgtttgctgtttaaaaacaactcctgcaaagtaagtaaatcctagggatgaggttctgcaggcagaattgcatgtacttgaattcgtattctattttcttttcgtagattgattcataggaagtgttatatatgcccgagttaatggtcaatgctttggccgtttcttactttctatactttgtcatcataaaaaaattattcttacctaaaaaaaaaaaaaaaaaaa

SEQ ID NO: 315 - DNA, 1036 bp, Triticum sp.
  CDS (149)..(736)
gggagagcagagagctagtcgctcgcgcgggcaatccaaacctttccctattcttgcaaggtctcggaaacggaaaggcccctgctccgctgcgcgtttgcgagtttgggaagaagccttgcctgccggagggggggaaacgggcgagatggggcgagggcgcagcgagataaagaggatcgacaaccccacgcagcgccagtccaccttctacaagcgcagggacggcctcttcaagaaggcccgggagctcgccgtcctctgcgacgccgacctcctcctcctcctcttctccgcctccggcaagctctaccagtacctcgcgcccaccgtcccctctgtcaaggagttcgtcgagaggtacgaggcttcgaggcacaccaaagtttggtccgacatccgccaggagaggcgccgcgagctggagaaggtggccaagatgtgcgacctcttggagaaggaactgaggttcatgacggtggacgacggggagcggtacacggtgccgtcgctggcggcgctggagcacaacctggaggcggccatgcacaaggtgcgctccgagaaggaccgcaagatcggcggcgagatgagctacctcgagaacatgatcagggggaaacaagcggagcgctacggtctgtgtgacaagctcgctcatgctcagagcctcaaggtcgttgaaggtggatccacctcgctgaacaacggcctggacctcaaacttggattcaactaggaacgggtgaaagcttctggccgtggggttctgctctagtgttgcttttgagctcgagtgttatgtcaggttgaaatattctgcaatttccttcgaagggattgtatgaacttgtaagagaccactgtcttatgagatgtttggcttaggctggactgggctgtgcgttgtacctccaataggtggaatgtgataccagtccagtattgcaataatgtagttaacggtcaccttatgctctagttcatgcgttctttgtcaatgtggactattcgtgtttttcttgatttctgccag

SEQ ID NO: 316 - DNA, 972 bp, Zea mays
  CDS (75)..(749)
tggagagccattcgtgggcgtaggacgagagagagaggatcggagcagtacgcggcggcggcggcgtgtgggagatggcgcgcgagaggcgggagatacggcggatagagagcgcggcggcgcggcaggtgaccttctccaagcgccggcgcgggctgttcaagaaggcggaggagctcgccgtgctgtgcgacgccgacgtcgcgctcgtcgtgttctccgccaccggcaggctctcgcagttcgcgagctccagtgtgaatgacatcgttgacaagtacagtacacattctaagaatctggggaaatcacatcagcagccttctattgatttgaatgtagagcagagcaaatacagcggcttgaacgagcaacttgctgaagaaactaatggacttagacagatgagaggtgaagaccttgagggattgagtgtagaggaattgcaccgaatggaaaggaaacttgaagcaggactgcatagagtgattagtacaaaggaccagctattcatgcaacaaatcggcgaattactgcaaaagggcacacagctagaagatgagaacaggcgtctaaaagaacaaatgcctcaggtgctaacggctggcacaatggtggttgctgctgctgcagaaaatatcctcactgaagacgggcagtcgtctgaatctgtaatgactgcattgcattcaggaagctcgctcgactgtgatgatggttccgatatatccttgaagttgtcgttgccttgaaaggaaggaccatcgcatcgcatgttatctgcatgagtggggctgacaccagtgcttctaagaagacaaagactgggatagtcccattcgcggcattatattggtttaaccagatgtgctgtccttgtgcatgtctgtacttcaaagtggctaacgcgaaatttgtatatataatagtgtatgcgctgcgttatcttcgttctaaaaatctgtattgttt

SEQ ID NO: 317 - DNA, 1419 bp, Zea mays
  CDS (304)..(774), (956)..(1219)
caccgctttaaatccgcctcctcccagcgtctccctcctcccggcctgtcccctcacctcctccccctatctctccaccgccgcagctagctgtgacgtcatgcactcgccggcgccaccgccaccgcatactatctacaattagccagccgtaggcttacctatcctgtgtcaagcaagcctctcgcaagcaacaaggaaggaagctagctagttttatagctgctgtcggcggcggcggctgaagcgacgtgcctgggctaggatttaggttgagatcaggagagggagaaggcggcggcgatggggcgcgggaaggtgcagctgaagcggatcgagaacaagatcaaccgccaggtgaccttctccaagcgccgctcggggctactcaagaaggcgcacgagatctccgtgctctgcgacgccgaggtcgcgctcatcatcttctccaccaagggcaagctctacgagtactctaccgattcatgtatggacaaaattcttgaacggtatgagcgctactcctatgcagaaaaggttctcatttccgcagaatatgaaactcagggcaattggtgccatgaatatagaaaactaaaggcgaaggtcgagacaatacagaaatgtcaaaagcacctcatgggagaggatcttgaaactttgaatctcaaagagcttcagcaactagagcagcagctggagagttcactgaaacatatcagaacaaggaagagccagcttatggtcgagtcaatttcagcgctccaacggaaggtaaattgttgagcttgctaaagttggctgttcgaacttcctcttttaagaattgtatgatttctttagctggccattagatgggcatggtttattgcaagtgttaactactttggttgccttgttacatccacaaaatatctctgctcttgcgctgtgctgcgatgcattgttaccgcaggagaagtcactgcaggaggagaacaaggttctgcagaaggagctcgcggagaagcagaaagaccagcggcagcaagtgcaacgggaccaaactcaacagcagaccagttcgtcttccacgtccttcatgttaagggaagctgccccaacaacaaatgtcagcatcttccctgtggcagcaggcgggagggtggtggaaggggcagcagcgcagccgcaggctcgcgttggactgccaccatggatgcttagccacctgagctgctgaaggtttgctctcatcgtcgcagtgtgctagcccaaaatccagcaagtcttccccggaccccggactggccaagcttctccgcctggtgcagtatcgtcgtgatcgcgagaagcagcagcagcggtttgccgtattttttaccaccgtgtataagtagcatatctgcaatgtgtatattttgttcaccgttcctgctg

SEQ ID NO: 318 - DNA, 2000 bp, Arabidopsis thaliana
  CDS (329)..(1267), (1353)..(1562)
tagaaaaagaaaacaaaacagtgcatcgtcgtcagtgggagtatataactaccaccacccactcaccattccggaattatctctgaatcactcataaaccctttcttcttccttgttcaaatccactcactcttggagagagacgactcaaacgcatagtctctcctctgtatttactcgttatcgtcactgtgagagagagagagagagcgcgcgcattcccccaattaaagcctctctgctccaaaccgtgatatactctttacgttgtttgtttttgcctttatccttccctagttgtgtataattttgttcttttcttatggagatggatctcagcaaggttactcttgacattttcacaaagcttgaacagaaatggctctctcactgcgactcctcccggaagactcgtatccttagcatcgacggtggcggtaccactggcattgtcgccgctgcttctattctccacctcgagcaccagatccgccttcaaaccggcgaccctcacgctcacatctctgatttcttcgacattgtcgccggaactggcatcggaggcattctcgccgccctccttgtcgccgacgacggctccggcaggccgatgttcactgccagagacgcggttaagtttgtcgcggagaagaactcggagctcttcgagatcaggtacaccggagttttcaggaggaacaagagatactcggggaagagcatggagagggttttggagacggcgtttaggagagaggacggtaaggtgttgacgatgaaggacacgtgtaagcctctccttgttccttgctacgacctcaaaacctctgctcctttcgttttctcacgcgccggcgcgtctgagtctccgagcttcgacttcgagctgtggaaagtctgccgtgccacgtcagcaacaccaagcctcttcaagccgttcagtgtagtgtcggtggacgggaaaacctcatgctcagccgtagacggcggtttggtgatgaacaatccaacagcagctgccgtcacgcacgtgctacacaacaaacgagatttcccgtcagtaaacggcgtagatgacttgcttgtactgtcgttgggaaacggtccgtcgaccatgtcatcatcaccagggaggaaactccgtcgtaacggagactattcaacgtcaagtgtggtggacatagtggttgacggcgtttccgataccgtcgatcagatgctggggaacgctttctgctggaaccgtactgattacgttagaatccaggtacgtattctcaacttttctcgtcaccacagagatcaccgatcaaaatgtctcgaatatattaaaatgtggtggatgcatgcaggcgaacggtttgacgagcggcggagcggaggagttgctgaaagagagaggtgtggaaacggcgccgtttggggtaaaacggatactaacggagagtaacggagaaagaatagagggtttcgtgcaacgtcttgttgcgtcaggaaagtcaagtctacctccaagtccttgcaaggaatctgccgttaaccctctcgctgacggccgttaagtttcctttattattataaccctccccgtccgtgatgtaagaagtttgtaaccaaacccctgggttaattttttaaccccagccagcatcttcgagttaattaattagcctttctttttttctaatgactttagttgaggaattaataatggttaatgaatgatagtctttacttatttatcactgacttgctagctagcagcttctctaaccattttttttaatactagtactgtatttgctattcccttggatcaaggcccgatgattctgtcaaaactgttttccccaaatgacttttatatgctcttccaacccaaaaaaatacaagtaaatgagaacaaaaactcaattcagagcaatgaatatatatacacaattagaaaatctccaattaaagagataggcattgctttagaactttgttatattgaagga

SEQ ID NO: 319 - DNA, 2601 bp, Anabaena
  CDS (451)..(2184)
aaaagtctaggttaagtgcgttggagttaaaaatatatgggactcctatgggattttggcacaaaactaccatagcattgggatcagtgtacaagtcttataggaaagaatgatcagtcagcatttagaaactacgacacttgtagtgtgagtattgcagcaacagtcaatatatttaccaacaagctatattgcctgatagataaaaataaattatgtatatagttccgttgattaattacaaattatatgatttggagatgaaaatgttgtgacaaatcaagtaaatacccaatcagttctgacatttgatggtcaagatgactacataaattttggcaaaaaatgatattggtggtgtgtttgctcaggggagttcagcctttacgatttccggatgggtgaatccgcatcaactcaccaataaagcaactacatacggggcacacaatgtattttttgcccgttcttcagaccgatacagtgataattttgaatttggcatcagtgagagaaggtaatttagatgtatacattgatgaaaatattgacaatgttattaaaacctttggcaatggagaattaaccatcggacaatggcacttctttgccattgtttttaatggtggtcaactgactatatatcttgatgaccatgaatatactgggtctttgacaggttcttctttgaacaaagcaactagtcctataaccatgggggcgactttacacaataatgtatactttacaggacagttggcaaatattagcgtctggaattatccctgcactcaagaccaaatccaaacgcatcgctctagtcctctagtcggaaatgaaccaggattagtagcctactggagattaaacgaaggagaaggaacaactgtccaagaccagagtggaaatacccataatggaaccttgtatggtgatcccagttggaatttagcacaagttctatttgcgatcgcacaatcatccagcgagggacacagaccaagtagttcacctgcagagatagccgaaatcgcccaaactaccgaatacccaatcccagacaatattcaacaacaggaacaagcgcaaacaccctctcaagaggaatcgaaacaaactatgaataatacagcaaatcccaaatataaaatacttgctattgatggcggtggtattcggggtattatccccgcaatcatcttaactgaaattgaaaagcggacacaaaaacagatttttagtttgttcgatttaattgcaggtagttccagcggaggaattctcgcactcggactaactaaaccgcgattagatttagcaggatctgatagcccacccgtcgcccaatacagcgctgaagaacttctgcaaatatatttggaatatggggctgagatattttacgagccattctgggaacaattactcggacagctagaggatatattcgttcaaccaaaatattcttcagaggggagagaagaaattatcaagcaatattttggcgacagccctttagaaaataatctcaaagaagttttcgtaacgagctacgatatcgagcagcgaattcccatattctttactaataagctcgaaaaacaacagactaaatcgaaaaagtttcgcaagttatgcctaggttttacgctcacagatgcagcattggcaactagtgcaactccgacttattttgctccctatcgtgtttccagttcccataataccaacggcttctatacattagtggatgggggattagttgcgaataatcccgctaatttggctattttagaagcgcaaattagtaggcaagaaaatcaacaagccctgaatatggaggatatcttggtagtatccttgggtaccggttccctgaccagtgtctacccttatgaccaagtgaaaaattggggactattgcaatggacaaagccgctgttaaatatggtgcttgacggcgggagtgaagtagtagctggagaattagaacggttgtttgaggctactaataaaggtcataaaacttcttattatcggtttcaaccattcttaaaaagtgaactcgaagatatagataatgccaaaccagaaaatctgcgccaattacaaactttagcgaatatactgattcaagaaaaaaatcaagaaatcgatgaattgtgtagtatcttgtcaagttagggactgccaaaataaaaaatatcccatatttagggtgcgtcagccgaacggttattaattgaaatcacagattgataagattgtcagcaaaagtatcacaattttaggtaattacaatggacgaaatcgttaaaaaattggctggtctgggtcttcctggcataattctcgtggttttagcagtttcatcagcaggtagtaatgctgctattattgctaccctcacatctgtgggaggaccgtttggtatcctcggaggtataggtctgcttggtctgacaacagttgtaggggatactgtagcaggctatggaattgaagctattctcaaggctatatatacagaacgtagcaaaaccgaatcagtcagatttctgctcaaagaaattaaagatttgcccatttcagacgacctaa

SEQ ID NO: 320 - DNA, 1135 bp, Zea mays
  CDS (86)..(805)
gtcgaggagtagggttctagcgcctatctggtttctccctgcgccgccgccgccgccgtggacaaccggagcgtagtgggaggggatgatggagggaggtagccgcgcggatgggcggaatccgaaccagctccggccgttcacctgcaccgggaacccgctccaccgcgcccacggctccgcgcggtgggcgcagggcgacaccgtcgtgctggccgctgtgtacgggcccaagccgggaacccggaagggcgagaaccccgagaaggcctccatcgaggtcgtgtggaagcccaagaccggccagatcggaaggcaagaaagggaatatgagatgacactcaagaggacgttgcagagcatctgcttgctcacagttcatcctaacaccaccacctctgtcgtgcttcaggttgtgggtgatgatggttctcttatgccatgtgcaattaatgcttcttgtgctgctcttgcatttgctggaatccctatgaaacatctcgctgtcgcaattagctgtggagtgatggacaatggtgtggttatcttagacactagcagagcagaagagcagcaagctaggtcgtttgctcacctggtgtttccgaactcgcgcaagtcagtcgaatcgaaggacccgacacagcgagatgaggagtccgagcgaggattgataacttgcatcacgcatggagcaatgtctgaagatgactatttcaactgcatagagaggggtgtcatggcgtcctcgaggatctcggatttcatgaggaagacactgcagaaggaggcgtccagggatgcctgacctgagtagcaaatgtattagcacgactgagaagctgcctgcctgtgatagacgatggcgatggcaatggtgtgtagacagcagctgggtctctagtttagacggcatgtagtcgtgttagaacgaaggaggcaagggtgcggagtggaggtcaatcggcgtgtgatgccatgtctcaattgtgcggtggagtggtttggtggacttttgatgaacagataatgaggttgtatttggtggtacccaattgtgtgtgttgaaatcatatgatgcacggcacgctgaaattttactcgaacgccgcccgattaaaacaatatccatact

SEQ ID NO: 321 - DNA, 5218 bp, Saccharomyces cerevisiae
  CDS (1351)..(5211)
tctagaggaagttttcaattccaaatgggcggataggctaatttggatgactacgattccgatgaagattcgaggacccaaggcgactacgacgattatgaatctgagtattcagagtctgacatcgatgaaactataattacaaatccagccatccagtatttggaagaacaacttgctcggatgaaagtggagttgcaacaattaaaaaagcaagaactggaaaaaataagaaaagagaggcgcttacgacgtggatcaaagaaacgcggcaaaagatcgaagggaaggagtgggtctaagaacgcttcttcgaaaggaaggcgagataaaaagaataaattgaaaacagtagtgacatatgatatgaaacgtatcattacagagaggatcaatgatttaccaacttccaaattagaaagagcaatcgacataataaaaaaatccatgcccaatatttctgaagacgatgaagtagaacttgacctcgacactttagataatcacaccatcttaacattgtacaacactttctttagacaatatgaaagctcatccggtgcttctaacggtttggacggtacttcaggtgttacgcgagatgcttcgtccttgtcgcctacaagtgcgggaagcagaaagagaagatctaaggcattaagccaagaggagcagagtaggcagatagaaaagataaaaaataaactagctatcttagacagtgcttcacctctgagccaaaacggctccccaggccaaattcaaagcgctgcacacaacgggttttcctcatcttcagatgacgatgttagcagcgaaagtgaagaagagtgactgaattttgaatttgattatcttcaacgactgagaagaatgagcaccattttgatattttgattaattaagtggtaatcttaagctcatatacaaaaagggaaggaaaaaaaataaagatagaaaagatcttaggaacggatagaggtttgaaaaaggaataacaggtaatttttcattttcatatcggttgtaacattataaagctcacaaatttaaaacaaaaaaaaacataaacctaacaaggttaatcatttgcacatgatctcatcatatagatcaattcataatctatataataatgaataattagaataaaaatttcctcttgtctcagaacgcccatcggatggcataactttagttaatgatatcacgacggacgaagtattgaaagacaacctaacctgttcatcaatttaaaagtcaacgcagaaactataatacattgccacatagttctttccgatatgaacaacctaactcacaaaatttactgtactaatactaatttatatgtctgagggattcagtagcagttccatacaggaattatatcaatcgttaaaagaaatcactaacaacgcagacgtagagcttttcgaagatcgcattactaaattagattttgagagcaccgatgaaccaaagcatgcaaatgatatcataaaggatagatttttgagaccttctaatgctcttccttggagcttgttggacatggtccaagacgttccacatacgtcttctccagaagattgctctggtaaactagattacaaggaattgctgaaagtcccggacccaattaatagaacatcataccagtttaaaagaactgggttagaaggtaaaatttcaggctacaaagaagaggttgatttgaaggaagttgcaaatgccaatgcatcaaattcactgtcgattacgagaagtatcaaccataaccaaaactcagtaaggggttctacagcgcaattgcctttcacaccaggcggaattcccatgaaatctgtcaagacagattcagaacaaaatggatcttctacaatggccaacgctactaaattgttacacaaggatggtcaaggtttattcgatattccagagggtatgaatagaggcattaagccgatggattctccagctgaaaatgaggatcaaaacggacagttcaaagaattgaaacagctaaatgagatagataatgaattagacataaggattgaggcgaacgaggcaaagttaaaagaggaggaaaaatctgccaagtcaatttctgaagaaattatggaggaagccactgaagaaacgactgccgataatgctgatgatgccgaaatcgatgaactattaccaattggaatagactttggcagaactaaaccagtttcgaaaagtgttcctgttaaaaaggaatgggcccatgttgttgatttgaaccataagatcgaaaatttcgatgagttgattccaaaccccgctagatcgtgtccttttgaattggatacatttcaaaaggaagccgtctatcatctcgaacaaggtgattccgtatttgttgccgcccacacatctgctggtaaaactgttgttgcagaatacgcaattgccatggcacatagaaacatgactaaaactatatatacatcacccattaaagccttatccaatcaaaaattccgagactttaaagaaacttttgacgatgttaatattgggttgattactggtgatgtgcaaattaatccggatgctaactgtttgattatgacgaccgaaattttaagatcaatgctttatagaggtgccgatttgatcagagatgtagagtttgtcattttcgatgaagttcactacgttaatgatcaagaccgtggtgttgtctgggaagaagttattattatgcttccacagcatgtcaagtttatcttattatctgccaccgttcctaacacttatgagtttgctaattggattggaagaactaagcaaaaaaatatttatgtcatttccacaccaaaaagacccgttccattggaaataaatatatgggctaaaaaggaactgataccggttattaatcaaaattcagaatttttagaagctaatttcaggaaacataaagagattctaaatggggagagtgcaaaaggggctccttcaaaaactgacaacgggagaggtggatccacagcaagagggggccgtggtggatccaatactcgagatggaagaggaggccgtggtaattcaacacgtggaggtgccaaccgtggaggttcaagaggtgctggcgcaattggctccaacaagcgtaagtttttcactcaagatggtccttcgaaaaaaacatggcccgaaattgtcaattacctaaggaaaagagagcttctaccaatggttgttttcgtatttagtaaaaagaggtgcgaggaatatgctgactggttggagggaattaacttctgcaacaataaggaaaaatcacaaatccacatgtttattgagaagtcgattactcgtttgaaaaaagaggatagagatttgcctcaaattcttaaaaccagatcattacttgaacgtggtatagctgttcatcatggggggctattgcccattgtcaaggagttgatcgaaatattattttccaagggttttatcaaagttttatttgcaacagaaacttttgccatgggtttgaaccttcccacaagaacagttatctttagcagcatccgtaaacatgatggtaatggattaagagaactgactccaggtgagtttaccctggctggtagagctggtagaaggggcttggattccactggtacagtcattgtgatggcatataatagtcctttatctattgctacgttcaaagaagtaacgatgggtgttccgacgaggttgcagtctcagtttagattaacatacaatatgatattaaatcttttaagaattgaggcgttgagagttgaagaaatgatcaagtattcttttagtgagaatgccaaagaaactttacaacctgaacatgaaaaacaaatcaaagtattacaagaggaattacaaaccatagagtacaaaagttgtgaaatctgtgataatgatatcgaaaagtttttggaattgatgctggcatataaggaggcaacagtcaacctaatgcaagaaatggttaaatcgccttcgatattgcatatcttgaaagagggcagactcgttgcttttagggaccccaatgattgcttgaaattaggatttgtatttaaagtttctctgaaggatgctgtttgtgtcattatgacgttcacaaaaccatacaaactcccaaatggtgagccaaatcatttaatatactttccaaaagcggatggatacagaagaaggaacttccctaaattccagaagactgatttttatatggaagaagttcctgtgacggctattgaagtgatcactaaacgcaagtttgccgcacccttgggaaaagtgattaaaaaggatgttgccgctttgaacgagtttaacgctgaaacaaataacattttggacggcaaaacgctaaaagaagcaattaacattgaaaagcaaggtttaaaaattcaccaaatattgttagaccgtacaaatataagggatgagatattcaaactaaaaagcattaaatgtcccaacctaagccaacacattgttcccaagtttaaggcgcatgtaattaaaaagaaaattgaagaattgtaccatttgatgtctgaccaaaatctgagcttactacccgattatgaaaagagattggctgttctgaaagacactgaatttatcgaccaaaaccacaacgtgctgttaaaaggtagagtggcatgtgaaattaattctggttatgagttagttttaactgaattaattttagacaactttttaggaagctttgaacctgaagagattgtagccttattatcagtatttgtttatgaggggaaaaccagggaagaggagcctcctattgtcacaccaaggctagcaaagggtaaacaaagaattgaggaaatttacaagaaaatgctttgtgttttcaatacgcatcagattccattaactcaggatgaagctgagtttttggacagaaaaaggtttgccatgatgaatgtggtgtatgagtgggcccgtggtttatcattcaaagaaatcatggaaatgagccccgaggctgaaggtactgtagtcagagttatcacttggctagacgaaatttgccgcgaagttaagactgcctctattattattggtaattccacattacatatgaagatgagcagggctcaagagttgattaagagagatattgttttcgccgcaagtttgtatttatagagagctc

SEQ ID NO: 322 - DNA, 5192 bp, Saccharomyces cerevisiae
  CDS (793)..(5091)
tttgtaatgcaaataactggacgagagaaccacgctataacctatttggtaataaaaatgtttgtatgaataaaaaagctgctgactgctttctttgatatgtgtatatagaatatttaatcggtgattgaatctaagaaaagcttacctctgaaagttctctcttcggtcgcttgctgatttgtagtaaacaatttgaaaagtttagcaaattcttcctcaggattttcaaaaccggcttcctttaaagaatcaatgacctcattcaagggaacgtttaaatcgtgtcctcttccaatggcttttaaactttcttccaattcttcacgctcgggaaactgcgataagttcttccccatgatagataagaatatgggaaagcttacaccttcttctccaacttccgcggtactggtgtcattgtcaggtaccattttggaccattcctcatctgtcaatgtcttccccaatgttgcatatatcttggtaagatctcccctactaatcagaccatcctcatcctcatccagcatttggaaagcatctttgagtttatttatgtagtcctgcgtaagttggttaaacgttagcgattcactatggtccatatctacttcaagtttgctcaataaacgattcgaaattactcttttcttagctgtgcattgtatagtttagaaatacgagaaatgtaaaaaaaaaaataaagttggaaaacaactaactaataaaactttcttgtcaagaaagacactaagaacacagaaaagaaacacgaagagcagaggaaatatgtcggatattaaacagctattgaaggaagccaaacaagaattgacaaatcgtgactatgaagagaccatcgaaatatcggaaaaggttcttaaactagatcccgataattatttcgcacatatttttctagggaaagcactttcgagtcttccagctagtaataatgtcagttcaaatcggaacctggagagagctactaatcattacgtgtccgctgccaaattagttcctgataaccttttagcgtggaaaggactttttctcttatttagaaccactgaggttgtcccagacatactttcgtatgatgaatattttgacctgtgtggccaatatgcagacgcacttttaaagcaggaacagtctcaagtagaactaataaatgacataaaattactaaagaaaacgcatccagattgtcaaaaagccttttatcagcatttgaaacctgggtcgctaatggcggaaactattggtcgtcatctatctacaccccaggacgctttattaaatcttataaagatactgtctaatattgaaacaacggaaataggtaagacccttagtcagaacaggttaaaactaaaagctagtgatcctgattatcaaattaaactaaattcattctcctgggaaataattaaaaattcagaaattgatcagttatacaaccagttggtaaatattctcgctgacgatcaaaagagaagtgaaattgagaaccagtggttagaatatagaatcaaagtgctaaaatcaatgccgctggatgtaaaaaaagattttttcacgaaagttaaggaaatggtcgaggatatggttcttgtgaatcatcaatctttgcttgcatggcaaaagtatttcgaatggacagattacgaagatctggacaacatggatgccccattgataataaagtactttaagaaatttcctaaagatccattggccatgatcctctattcctggctttcctcaaaactatcgaaatatgatattaaaagtttggaatcggctaataaaccacctgaaggccataaaaagacggagaaggaaacagatattaaggatgtagatgagacaaatgaagatgaagttaaagatcgcgttgaagatgaagttaaagatcgtgttgaagatgaagtcaaagatcaagatgaggaggcaaaggaagatgaagaagaagaccttgatgatatagaaattggtttattagaggaagaggttgtcactgtattgacggagaatatcgtaaaatgtaaaaataatatcttagcgcatcgcattctttgtcaatattacctactgaccaaggagtatgaggcagctttaccatacatcaaaaatggtatttctttaattgcctataatataaaggacctgggggtacatttgccattaacaaaaagagaattttctctggatttggctaccgtttatacatatgtcgatgccccaaaggaccacaatgctgcattaaagttatatgataacattttatccggtgattttagtaatatacaagcaaaaatgggcaaaggtataatttttattgaaaggaaaaattggaaggatgctatgacattactaacacaggtgcatgaacaatcgcctaataatctggaagttttatctgaactgtcatggagtaaagcccatatgggttatatggacgaggcattagctggcttagatactgtcatcaagggtatcaaaggtatggatttacgttcgatagatttcagagcattaaacttatggaggcaagccaaagtttacattatgaagcatgcttccattaacgatgctaaacaggaaaacgtcaagtgcgcattcaaattactcattcagagtattaaaatattggacacttttgctcccggattttcgacactgggcgatatttattgccactattataaagaccatttgagggccttcaaatgttatttcaaagctttcgatctggatgcgggggattacacagcagcgaagtatattaccgaaacttatgcaagcaagcccaattggcaagctgcttcttccatcgcttcaagattaattaaaggtgaaaaagcaaaggcagaactgcgctcaaataactggccctttagggtcgtagggattgctcatttggaaaagcaagaagaaagtgattctattgagtggtttcaatctgctttacgtgttgatccaaatgatgtagagtcatgggtgggcctgggacaagcataccacgcgtgtggtcgtatagaagcatctatcaaagtttttgacaaggcaattcaattaaggccctctcatacttttgcccaatactttaaagctatttctctatgtgacgtaggtgaatatcttgaaagtttagacattctggaaaaggtatgtcaagaagccgctacagaagagtcattccaaattggtttagtggaagtgcttatgagatgttccttggatttatattcgcaagggttcttgctcaaatcagtttcaattgcaaaggacactattgaacggatcaagataattatcagtgaattaaaatgtgagaaccaacaggtttggatctacctttcacaagtactgagattatttatttggatagagtcaaaggttgatactttacctgttgaatcactagtatcaatttttgaaaattctcaattttctggtagtgaagaaattgattctgtcgacaatatcaaaatcgatactttactcgatagcactactgatgataatgtgtccattgcgtgcaagtttttgatcttagcttcaaaatatagtgtttcggatcaaaaatttacagatatagcaggaacggtcagggcctcatactggtataatataggtatctcagagcttactgctttcataacattgaaagaaccgcagtatagagatgctgctatttttgcttttaagaaatccattcaattacagtctaatataagtgaaacttggattggtctagggatagccactatggacatcaactttcgtgtctctcaacattgctttattaaagcaactgctttggaaccgaaggcgacaaatacatggttcaacttggctatgctaggtttaaagaaaaaggatactgaatttgctcaacaggttctgaataaattacaaagccttgccccacaagattcgtcaccttggctaggtatggccttgattcttgaggaacaaggagacattatcggaagttctaaactttttgcacactccttcatattatctaatggaaggtcaaaggctgcgcaatttatgtatgctaaaaatgtccttgagaatcacattaataatggtgacgatgaaagagatattgagacagtggaaaaactaaccactgcttcaatagctttagagcagtttttcaaaaaaagtcctgatagtcaatttgctcttcaatgtgctcttctaactcttgaaaggttacatcactatgaaaatgcaaacgaactggctaatcggttgataggcattttggaaaaaaagtttgagaaaactcaagatgaaagagaactgtttaattttgcgataattaaaggacaattcgctcgtattcacttaggtttaggaaatttcgaactctctattgaaaacgctgatctttctcaaggtattatatctgaatcgagcgacgaaaaatcaatgaaaaccaaaatatccaatcacatttgcttaggattaagttatttcttcttaaacgactttgatcagactttgaaccaattccaagaactgctaagcatttcaaaggattctaagcacctagttgttttaattgcgaaggtgctttatgatgtaggtgaatctgacacaaaggaaattgctttacaggaactaacagaatatatagccacaagcggcgcagacttgttagtaacactaacgattgcagctatgtcaattctagacgataagcgtgaagatttaagcattattttagaagaattgaaagctttgccattatccaaacaaataatagataagcacaaagacgcaccatatctgatagaagaaattactaagagactttatcgtaacgataccggtaaacaagtatggcaaaggagtgcgtactttttccctaataacctcaaggtttgggagagattagataagaatattcaacgaagaatagcttctaatggacaaaataaagttactgcggaggagatgagtaaactatattgtgagagtaagaatttgagaagcatacaaagaggtatgtttttgtgcccttggaacgttactgcagtgaaggcgctaaacgaatgtttctaaaaatttggattcgagatagtcaatcaaaccttaatgtaacattagtaataaattttatcttttctatagagtataaaaggttattagacagagtttatcag

SEQ ID NO: 323 - DNA, 1386 bp, Saccharomyces cerevisiae
  CDS (323)..(1201)
agcagaaaactgggagaaatggaaatgaatcaaatcatacatatcaagacattctagtttttataaacctataatttatcgcaagaatcttgggtgttatgtgttgtatttgcggcatcatttcaaaataccgtctgcattacccgtctccgtcacgtgaagtaaaaatttccaaaaaatattgaaaaaagaaagaaaaataagatccagaattcactgatgatgagcttatggtacggcatgattaactacgcatttgtatattaaagattctttgattttttccagagcattgaatacctcaatctataagtgtattataatggcatgcaattttcagtttccagaaatagcttatccaggtaaactaatatgcccacagtacggtacggaaaataaagatggcgaagatataattttcaattatgtgcccggtcccggaactaaactaattcaatatgaacacaacggacgaactttagaagctataactgctacactagttgggacagtgaggtgtgaggaagaaaaaaaaactgatcaggaagaagagcgtgaaggcactgatcaatctacagaggaagaaaaatcagtagatgcatcacctaatgatgtcacaagaagaactgtaaaaaatattctggtttcagtgcttcctgggacagaaaagggtcgtaaaaccaacaaatatgctaataatgattttgccaataacctaccgaaggaaggtgatattgtgctgaccagggtgacaaggctttcgttgcaacgagccaatgtcgaaattttagctgtggaagataaaccatctccaattgatagtggcatcggcagtaatggatcgggaatagtcgctgctggtggcggttctggagcagctacgttctctgtttctcaagcatcatcagatttaggtgagacattcagaggtataatcaggtctcaggatgtacggtctacagacagagatcgtgtgaaagtgatagaatgtttcaagccgggagatattgttagggcgcaagttttatcattaggtgacggaaccaactactatttgaccactgcaaggaatgaccttggggtcgtgttcgccagagctgctaatggtgctggtggattgatgtatgctacagactggcaaatgatgacttcaccggttacaggcgctacagaaaagcgcaaatgtgccaaacctttttgatatgtaacagcttatctacagtgcatatagacgcgtatatatttaaaagagggtattcgcttcttcttctttagattgcattctttgatggttaggaaaaagaagcgggaacgtgattaaactttttattctcttttatttattatatattatagtgcattatcattatctatctaaatttgcct

SEQ ID NO: 324 - DNA, 1857 bp, Saccharomyces cerevisiae
  CDS (1007)..(1747)
taaagtactaatctcatcctccttttgtttttctcgagagggcccccttattcgtccgcctgagattgcattggccgaattgaaaagtgacagttatgcacctcagcggctattccctgcgtcgcttgctgaagattgaggattataggaagtagtaagctggaaatggtaatttgtaaaaagaaaatttctaatactgtgacaatgttattaaatcggggttgtttttgtttggggcggccagcggaataatttgttttcaaggacagcagaagctcagaagaacaaaatctccgtgatcttttaaacttttttccattctgatggaataatggtcttgatcccctaaatatttccttttttattgcaattatgatagaaattaatagtagtctatgctggatgatatatatatctcttttgagcttgcttcaaattttttcccgttataatgatgagtgttttgcttattaagggtctaggacatttctatcagtttctataccaaaagaagaaaaagtggagaattgtttgtttattttaatattttgttctttagttttaaaaattcagaagagaaaaaaattttatttgtcacaaggaaataaaacataaacaaaaaagaaaaattaagatttgcaattctgccgcttaagcaaaagtagatcattcactggaatatatatatataaacgcatttataatcttgtaacgtgcactcaatttagctacgaaagccaaccagcaaggaaccttttatttgagtaggtacatttacatcttcgggtaacgcggtgaaattgaaaaattttaaggcattaataattgaaaagctagaagaaatggatgaatgaatgacattgcgaaccattgtgcaatgaacatcatccaaaagaaaacatcatttacacatattttctttccagggtcccactggtaaaatctattaacatataaaaagatttacaaaaaaactttagtgccataactacagcaggatcatcatatgtcaagactagaaatatactcgccagaagggctacgtctcgatggacgtcgatggaatgaactccgccgttttgaaagttccatcaacacacatccgcacgctgcagacggttcatcctacatggaacaaggtaacaacaaaattatcactcttgttaaaggtccaaaagagccaagattgaaatctcaaatggatacctcaaaggctttattgaacgtatcggtaaacattacaaaattctccaaattcgaaagaagtaaatcaagccacaagaatgaaaggcgtgttcttgagatacaaacctccctggtgaggatgtttgagaagaatgtcatgctgaatatctaccccagaacagttatcgatatcgagatccatgtccttgagcaagatggcggtattatgggatctttaatcaacggtattaccctcgctttaatagatgccggtatatcaatgttcgattacataagtggtatatccgtcgggctgtacgatactaccccattattagataccaattcattagaagaaaatgctatgagtacagtgacactaggtgtggtagggaagtcagaaaaactttctcttttattggtggaagacaaaattccgttagataggttagagaacgttcttgccatcggcatcgcaggtgctcatagggtaagagatttgatggatgaagaactgaggaaacatgctcagaaaagagtcagtaacgcctctgctaggtagaataaaaaacgccattaattgccactgtttatataaaagtacataaaaaacagtaaaattgaaaattgaacgcatttacattttcgtgtttctaccgtaaagcaaaacgc

SEQ ID NO: 325 - DNA, 2646 bp, Saccharomyces cerevisiae
  CDS (279)..(2519)
cgctgtgattttctacaatcaaacaaccctgtgttttcgctctttttaggacttgtcaagaaaagaatgatgatactgacttttccatttgatattaatttcaactagcggagtttttccagttttcaaagtacaggacaaagtgttgtgtaacccggaccagatttacattggtgtactataatatgtactataacagattggaggtataaacctagagacccttctacaatacacgtacgaggaggtggtcttcgaaacttacagtaccacctgacatgtcgttattagagcaattagcaagaaaaagaatagaaaaatctaaaggccttttaagtgcggaccagtctcatagtacatcgaaaagtgcatccttactagaaagactacataagaatagagaaactaaagataacaatgctgagacaaaaaggaaggatctgaagacgctacttgcaaaagacaaggtaaaaagaagcgactttaccccgaaccagcatagtgtttcattgagtttaaagttgtctgccttaaagaagtcaaatagtgatttggagaaacaaggaaaatcagtgacattagacagcaaagaaaacgaactccctaccaaaaggaaatcgcctgatgataaactcaacttagaagagtcatggaaggctattaaagaaatgaaccattactgtttcttgaaaaacgatccatgcataaatcaaaccgacgattttgcgttcacaaactttatcataaaagataaaaaaaactcgttgagtacatcaataccgctatcgtcgcagaattcatcatttctgtccttaaaaaagcataacaatgagctccttggtatttttgtgccttgtaacctgccgaaaacaactcgtaaagtagccattgagaatttcaatagaccaagtcctgatgatataatacaatcggcccaacttaatgctttcaatgaaaaattagaaaacttaaatatcaaatctgtgcccaaggccgaaaaaaaggaaccaattaaccttcaaacaccacctactgagtcgattgatattcattcattcattgccacccatcctctgaatttgacatgtttgttcctcggtgatacaaacgcaggcaaatccactttgcttggtcatcttttatatgatctaaacgaaatttctatgtcatcaatgagggaactacaaaaaaaaagcagtaatttggatccttcatcttcaaatagttttaaggtcattctagacaataccaaaacagaaagagaaaatggattttccatgtttaagaaagttattcaggtagaaaatgatttactaccgccatcatcaaccttgacgcttatagacactcctggtagtatcaaatacttcaataaagaaactctgaactcaattttgacctttgatcctgaagtttatgtattggttattgattgcaattatgactcgtgggaaaaatcattagatggtccaaataatcagatttatgaaattttaaaagtgatctcttatttgaacaagaattccgcatgcaaaaagcacttgataattcttttgaataaggcagatctaattagttgggataagcaccgactagaaatgattcagtctgagctaaattatgtgttgaaggaaaactttcagtggacagacgcagaattccaatttatcccgtgttcgggtttattaggttcgaatttgaataaaactgaaaacatcacaaaatctaagtataagtcagaatttgactctataaattatgttcccgaatggtatgaaggtccgacatttttttcgcaactatatctattggtagagcataatatgaacaaaatagaaacaactttggaagagccatttgtaggcacaatactgcaatcttctgttcttcaaccgatagcggagataaattacgtgtcactcaaagtcttgatcaacagcggatatattcaatcaggccagacaattgaaattcatacacaatatgaagattttcattactatggtatagtttcaagaatgaagaattcaaaacaaatactggagactaacacaaaaaataatatatcagtcggtttgaaccctgacattttagaggttcttgttaagattcataataccgaagacttcacgaaaaagcaatttcacattcgtaagggtgatataataattcactctagaaagacgaatacactatcaccgaatttaccaaacacactaaagttgttagccttgcgtttaataaaattatcaatacaaacgcacgcgctaagtgatcccgttgacttgggttctgaattgcttctttaccataatttgacgcacaacgcggtaaaattggtgaagattctcgggactaacgacatctcaattaatccaaatcagtcacttattgtcgaagtcgaaattatagaaccagactttgctcttaatgtgattgattccaaatacattaccaacaatattgttttaacatcaatagatcataaggttatcgcagttggcagaattgcatgccagtaatcctacaactaagaaattatactaggcattcatacttattgtttaatatataaaatgaatagtaataagttgatgatagattgatttttttaacccattttacacatatcttatgaaagtgata

SEQ ID NO: 326 - DNA, 6001 bp, Oryza sativa
  CDS (464)..(884), (1132)..(1287), (2103)..(2252), (2353)..(2487), (2957)..(3288), (3399)..(3509), (3596)..(4095),(4350)..(4518), (4783)..(5022), (5097)..(5228), (5315)..(5449)
cacgttgcgaaatgctgactgctgaagctgcttatatatgtgatgattgtatttttctgtgtacgctagcgtcattacgcggaggcccatgtatatgtagttttatgaacttagtattatcaagcaaagaagtacagtgaacttgtccttataagttgcttttatttttatccaagtttgaccaactttataaaaaaatatactagcattttcaacataaaataaacatattatcaaaatatgttcaatgttaaatttaataaaaggaaaaaagtccactttgactcccttaaaagtcacccgaatctaatccgtgaccctcaaccgtaaaaccggataggatgactccccgaactattcaaactagtgcaatttgactccctcagcggttttggatggcggttttgctgatgtggcgttgacgtgccgacccgatggcaaccgtgcggtgccgtaccggcccatgggctcagacgtcgggccaagcacggcacggctgaacgggtcgtgccggcacggcccacgagcgggcgtgccgtgccgttcctgggccggctacagtgctgccgtgctcgggccggcacgccttggcccggcccatttggccaggtatactagtcggctccagtcctcctccccccagcgacctaagccgccaccgccctcgccgcgctaccgccagcgccgcctgccgtccctccgtccctcctcctccggcgggcgcgcggcctgccgtccctcgccgcgcgaccgccagcgccgcctgccgtccgccgtccctcctccgccagcctccgtcgccgcctcccaccagcgccggcccgtcggcgtcccccaggccccagcgcgcgaccaccagagctcgccgctgccggagctcgcccgtcatcgtcgctcaggcccccaggccctcgccggagctcgcccgtcatcgtcgcccaccgagccacttcatacttcaatcaagctatttgttcaaagcctcctttcttgatttgatggtagggttagtgttatttgtaaagagaaaaccagcttccagatctcgaatttgcctcaaacttatcttctcttgtagatctggaagctaggttttctctttacaaataacactattttttcccccattaggtctgccctgtgtcagcaggatgccgcgcaaggttgtctctgggcctgactacgatgatgagtacaatgatgactatgatgagtatgatgaagactatgatgattacggtgggactgggcacagtgacgacattcagcaccctacgaaggagaaaggtattatgtcaaaggtttgaagctagtactagacagtgtacacctcagcatgtaagaatggtgaaatagctattggagtcgcttcatgatgcacacctaacatatctactcgtgtaggttagtcacggcggtgtaggttactaggagccttcacccgttatcataatttgctcagtggtgttaaatgttgttaatgtcattacattgtttccatcctgcattcgtacttgctatcgcatcctctattgcctgattatgcaaataagaatttctagtgcttaattactctaaaacttccaatagcattgcttgttcaaacaaatgcagtgatcgtgtagcttatgtttgccgattacctggtcttgtgataatttccttgcccatttatcccatcatatgcacttcagatatttgttttcttgaaggcattgttattcaacatgcattttttggaatgagtcaaatatcattcatccagtccatcaaaataaaaacttactacaaattaaatctacccaaattgggtgagaatcgaaacatagctggctgccagttagaactaccagtattacctactggttgcttgctgaatcctggtgcatatgcatattattgttttatatatttgacacattttgaaataattcatatgcttatacatttaaccgttgctttccgcataagctccacgcatcgaatgctttgctttgttgttgtacagtgaagtttttttgtgacttactcagcatatcaagctaactgcgtgtagtgcagctccttgatctctaatgttatgtcaccactctattgtgcagagtcatcgaagaagtcctcaagtatggtgcctgtgctttggagatgctccatgtgcatgttcgataatcatgaaagcatggtgtattgtgagatgtgtggggtttttcgagaatcctttatgaaatctgccaaggatggttcaataaaaggtaacatccttcacccattctaattctctttgaatcacaatttgtattctgacaaggaattctaatgtaatcatagtgtactataactattaaattacagtccatgggataccaagtgattttgggacaccttcgatgccgaaatctgattctacaaagatgccagtgaatactcgtactacagactttggtggtgaccctgagataaagaatgctagcatatctcatgagaaaggtactgctggtgcaaatggtagatgctgtacaattttgtgtatgcaactctgttctacctttaaactagcttctcctaccataacaccttattgagttatgaaaaggataattcataattcaccatataaaagaatcacattagctcatcttatgtgcgggaagcagattttgatccttttctttcccaagcaccattgtcacttactgtggctgaacagattgttcccttgcataccactaaaaaatgtttcacttgttggacaacaacaacccacagctcacgtgtcatgccctctgaagtctgaaccaagctacttttgtaagggtgacttatttgtacttgatttgcagatcttcccaaccagttgtatcatctgttggttgataagccttcctgttgaaaaaaaagcctgttagctttgttcttttattgtcaccttaatttaaattattttattattcaacagttggttccacacagtacgcatctgttggtagctcatcaggcgctgggaaaaaggtgaaacacattgcacttcctgaagatgtgcctgtcgagaggacagctcaattgatttctgatcattttcagctgaaggaggaccagagtagtagggctaccagttctgcacagaatgaggatgtggcccagaaactttcttctgacatacagaagctaggtttagaaaagaatgaagtagatactgcaaaaccttatttacctgaagaatataagcctgagaagtggatgtttgctaatgaggaatcaggagtgctgagccaactaaaccttgcaatagtatgctatactcatcttctgttctgaatatggcatatgttccgtaacaattttgttattctaaaagtgctttgtctaaataggttactgtctacgaacaatttgtttaggtaggtcatgttgattctggcaagtcaacactctctgggagactgctacatctgttaggaaggatatcgaaaaaagatatgcacaagaatgagaaggaggctaaagaaaaagtaagtttattattgttgttattgtactatacttgatcctgatgttccattcatattcttgtattatggaaattattttttaccagggaaaaggatcatttgcttatgcgtgggctatggatgaaagcagtgaagaaagagaaagaggtgtgacaatgactgtggctgtggcttatttggagaccaataagtaccgtgtagttttgcttgactctccaggccataaagattttgtaccaaatatgatatctggcgcaacgcaagctgatgcagctattcttgttgttgatgcttgcactggttcatttgaagctggcatggacggtgaaggagggaaaagtgttggccagacaaaagaacatgctcagcttattagaagcttcggcgttgaacagcttattgttgcggtcaacaagatggatgccatcgggtactccaaagaaagattcgagttcatcaaggttcaacttggtagttttctgcgggcatgcaacttcaaagattcatctgttacctggattcctcttagtgctgttgaaaatcagaatttgatcaaaattccttctgatgtccgtttaacttcctggtaagttatgttttgacacactacttccatgccattcgaaacactacattgtgtagaatttttcaacagagatggctgtttcatgcatcttgcaatttctaaccttttcacatggtaatatcgacatattgtagtaagcactcgtgagaatagcattactgatattttgaaatatttgggaccatactgtcttattagaaaaaaaatcatttgtttatctgaagaataggaatcttgaactgatgtcctttcaggtatcaaggattttgtctcttggatgctatagattccttgcagcttccatctcgggatgtttcaaagcccctcattcttcctatctgtgatgttatcaagtctcagtcaacagggcagttggcagcatttggaaaattagagactggagctattcgaattggttcaaaggtacattcctcacaaatcagcagggactattgatacttgtatatttcattgagatgagctccaaatatgaggatagaggaaagattgatcaagagcgtttacattgtgacatttgctagttgcatatttgcatgccaatctttcagtaacagcatgatgtcggaatttggtctttttaaaaaatatatatatttatacttgcttttgtacgcaaatgtcttgacattcctatctgttttgacagcttggaacttgctgttgcaggttttaatttcaccttgtggggaagtggcgacagtgaaatccatcgagcgggattcaaattcatgtgacatagcaagagctggtgataatgtagcggttagtttacagggcatcgatgggagtaagctaatagcaggtgggattctttgcaaccctggtttcccagtgcctgtctctaacttcttggagctaagggttctagtgttggacgtcaccattcctatccttattggctatcaggtaaagatatgaccaaaagctctccttttgattattttcttccctgatgcaatctgataaaaatatgggcctaggtcgagtttcacatacatcatgtgaaggaggctgcgagggttacgaaaatcgtggcattgcttgacaaggctggcaaaccaagcaaaactgcacctcgatttcttaagtcaaagcagaatgcagttgtgcaggtaacaactgatcacagatccttgtgaggagccattgcttccgaagtcatcatttgcgatgttgtgattttcttgatatttgtcaggttaccttagacgctccggtctgtgttgaagaattctccaaatgccgagctcttggcagggcattcttaaggtctggtggaagcacaatcgctgttggagtcgtaacgcgggtactcgggcaagatcagaactgaaagacctccgcccaacatctgaaaatttgaacgtatctgcagccgtgccctgctttggggtccataatattgtagttgactcaaaacggtattgccgatgagaagaagtttggcgacggcatttttcactgtgtgttcgtcgccatttcagaatttaatccgtcactcttttagttatttgtaattttcttatgcctaatgaaaaagggggtttcaggatttcatttttatttagacaggggcacaagaaaagaagacagtgcaacgtactgcatataaaatcgcatccgacctgaccaatgaatactacatttgactgttggtgatagggaggaaattacgacatggccattaatccgttggtgatttaatgatctgatggcactagatctacatctacggagttgctagaaatatggcgctatatgctacagttgatttttttagccacttacacagtagttatatcttatttacaccccacttacatatataattagtatgtaattttcgaatttacatatgtaattttagtacttacatatgtaattt

SEQ ID NO: 327 - DNA, 949 bp, Zea mays
  CDS (36)..(632)
cccagttgcccccaaaccccagccaccagctaccaatggcggccaccgcgatggaccatgacggcggcgacgacgtggtcacaccaggggagcttctcggaaactcattaaccctcgcggccggacgtggcgcctacgccgacggtcgctctgtgcgcgcgtcggtcaccgggcgccgccgcatcgtgccgcccgcacctgcctccgacgaccagagatccacggtggaggtggtggggcacaaggcccatggagctgtgccgcagccgggaagcgtcgtcatcgcccgagtaacaaaggttatggctagaatggcctctgcagatatcatgtgtgttgactcaaaggctatcagagaaaagttcactggcatgataaggcagcaagatgttcgtgcaactgaaattgacaaggtggatatgtaccaatcatatcgtcctggggacattgttaaagctatggttctttctcttggtgatgcaagggcatattacctttccactgcgaaaaatgaacttggagtcgtttcagcacaaagcatagctggtggtacattggttccaatcagttggactgagatgcaatgtgatttgaccggtcaaattgagcaaaggaaagttgcaaaggtggaatagatgtgctgtggccctcctgataaatggtaaacatgtggtggcggtatacaaattgtggaccagtgacaccaggtccttgggcggactacccaattctgcgacgtccaacttcattacagctgcattgagcatgggtttttaaaaccctggctgaatttaactagacatgaatcgtagccatgggtcctgtaacccaaccttgggatctgaatcatagccatgggttctgtaacccagtaaccttgcccttgtgatttgttactctgtgagctaatgacattgcagttttccaccttgtgatttctaaaaaaaaa

SEQ ID NO: 328 - DNA, 1311 bp, Zea mays
  CDS (238)..(1098)
cgacgcgcccaaagctcacgccggacctgctcctctccgacggcggcatcggcttcgtgctccgctactttcccaaggcgttcaagccccgcccccgcccaggccacgaggtggacgacctcgccaacctcatcaagctctacgcggactggcactcccgcctgatcccctactactccttcgaacagttcgtgcgcaaactcgagaaattgggtgccggcaaccgcgtcagggacgatggtgggcctctctgaaggggagaaacacttcatccgcggcggcattgcacaagacgttcgcactgatggacgtaggcggctgcagttccggtccctctccgtccaaaccggagtcattccacaggcgaatggctcagcgcgtgttaggttgggggccactgaaataatcgctagtgtcaaggctgaactaggaaaaccaagcattcttcaccctgacaaaggaaaagttgctatttttgtcgactgtagtccaaccgctgagcctctgtttgagggtagaggctctgaagaattgtctgctgagctctctgtttccctgcaaagatgcttgttgggtggtaaaagcggtgctggtgctgcaattgatctgtcatccctaattgttgttgatggaaaggtctgctgggatctgtacattgatgggcttgtggtcagttctgatggtaatttgctagatgcgctagctgttgcgataaaggttgctttgagtgatacaggtataccaaaagttaatgtttctgttagtgctgcatctgatgaggaacctgaagttgatgtaagtgatgaggaatttctgcagtttgacacatccggtgtgcctgttattattacattaaccaaggtgggtcggcactacatcgttgatgccacctcagaggaagaatcccagatgagttctgcagtgtcggtgtcagtcaacaggcatggccagatatgcgggcttaccaagaggggaggggcagggctggatccaagcgtcatcttcgacatgatatctgtcgccaagcatgtgagccagcagttcatctccctcttggattcagagattgccgccgccgaagctgaagaagaggctcagtgattgatgaaaaggaaaaaggactggttgcgtaaatgctcgtgtgttccaacttcaaccaaatgctgtagaaatcttcaggaacactctatatttacaaagtcattttgctctctatatttacaaagtcattttgctctctatatttacaaagcatgaatgaagatacccaagaacactcccgcacctaaaaaaaaaaaaaaaaaaaaaaaa

SEQ ID NO: 329 - DNA, 1424 bp, Oryza sativa
  CDS (41)..(1261)
ggagagcgcgagcagagcaagcaaccaagcagcagcagcgatggccgccgcagccacgacatcctcccacctgctcctgctctcccgccagcaggcggcggcctcgctccaatgcggcctctccttccggaggcagcccggcaggctcgccggtgggtcgtcggccccgagcgtgcggtgcatggcggccgtcgacacggcctcggcgcccgccgcgacggaggctagcaagaagagcagctacgagatcaccacgctgacgacgtggctgctgaagcaggagcaggccgggaccatcgacggcgagatgaccatcgtgctggccagcatctccacggcgtgcaagcagatcgcctcgctggtgcagcgcgcgcccatctccaacctcaccggcgtccagggcgccgtcaacgtgcagggcgaggaccagaaaaaactcgacgtcgtctccaacgaggtgttctccaactgcctcaaatcgagcgggcgcaccggcgtgatcgcgtcggaggaggaggacgtgccggtggccgtggaggagagctactcgggcaactacatcgtggtgttcgacccgctcgacggctcctccaacatcgacgccgccgtctccaccggctccatcttcggcatctacagccccaacgacgagtgcctagccgacatcgccgacgaccaaaatcttgaccaggtggagcagaggtgcatcgtgagcgtgtgccagccggggagcaacctgctcgccgccggctactgcatgtactcgagctcggtcatcttcgtgctcaccatcgggacaggggtgtacgtgttcacgctggacccgatgtacggcgagttcgtgctgacgcaggagaaggtgcagatccccaaggcaggcaagatctatgccttcaacgagggcaactacgcgctctgggacgacaagctcaagagctacatggacagcctcaaggagcccgggccgtccgggaagccatactccgcgcgctacatcggcagcctcgtcggcgacttccaccgcacgctgctctacggcggcatctacggctaccccagggaccagaagagcaagaacggcaagctgcggctgctgtacgagtgcgcgccgatgagcttcatcgtcgagcaggccggcggcaagggctccgatggccaccagaggatacttgacatcatgcctacggagatccatcagagagtgccgctgtacatcgggagcgtggaggaagtggagaaggtcgagaagttcttggcttgactgcaagtttcatatacgggggtgtttctaaaaaaaaaagtattgtaactaaattataatatatttgtagaaattttcttttctgatggcgaattaattaaacccattgtgaaggatttcatccctactgttgataggtcgaggctccttctcactagtcctg

SEQ ID NO: 330 - DNA, 1501 bp, Escherichia coli
  CDS (208)..(1206)
gtgccacaaattcctaaaatatgaatgcgcatacgtcactatccttttttaatctgccgctcattttacgcatatgtcgggcaagtgagaaacgcatttcaggataatccgtaatttgctggcgcgattcacctgagcgcaacattgagattatttgttaagattgttgcggtcgctttactccataaacattgcagggaaagttttatgaaaacgttaggtgaatttattgtcgaaaagcagcacgagttttctcatgctaccggtgagctcactgctttgctgtcggcaataaaactgggcgccaagattatccatcgcgatatcaacaaagcaggactggttgatatcctgggtgccagcggtgctgagaacgtgcagggcgaggttcagcagaaactcgacttgttcgctaatgaaaaactgaaagccgcactgaaagcacgcgatatcgttgcgggcattgcctctgaagaagaagatgagattgtcgtctttgaaggctgtgaacacgcaaaatacgtggtgctgatggaccccctggatggctcgtccaacatcgatgttaacgtctctgtcggtaccattttctccatctaccgccgcgttacgcctgttggcacgccggtaacggaagaagatttcctccagcctggtaacaaacaggttgcggcaggttacgtggtatacggctcctctaccatgctggtttacaccaccggatgcggtgttcacgcctttacttacgatccttcgctcggcgttttctgcctgtgccaggaacggatgcgcttcccggagaaaggcaaaacctactccatcaacgaaggaaactacattaagtttccgaacggggtgaagaagtacattaaattctgccaggaagaagataaatccaccaaccgcccttatacctcacgttatatcggttcactggtcgcggatttccaccgtaacctgctgaaaggcggtatttatctctacccaagcaccgccagccacccggacggcaaactgcgtttgctgtatgagtgcaacccgatggcattcctggcggaacaagcgggcggtaaagcgagcgatggcaaagagcgtattctggatatcatcccggaaaccctgcaccagcgccgttcattctttgtcggcaacgaccatatggttgaagatgtcgaacgctttatccgtgagttcccggacgcgtaatctcctgcgcctctccacacggagaggcgtttttattgctgcgcaatgttgactcttgtcactggcgaactctgacgattctcccacagcaccgttaatccacgctgtaatgctataaaaataaacaacaaaataccgatggcgattttcgtccaccaggaactcagcgtgccatcaaagtttatgtaagtctgaatcagtccctgaatcgccacgccaaaaagcgtccctaataccgttccaacgccaccgctcaaaagcgtaccgccaattaccactgaggcgatagcatcca

SEQ ID NO: 331 - DNA, 1167 bp, Synechocystis sp. PCC 6803
  CDS (1)..(1164)
atggacagcaccctcggtttagaaattattgaagtcgtagaacaagcggcgatcgcctcggcaaaatggatgggcaaaggtgaaaaaaacaccgctgaccaagtagccgtagaagccatgcgggaacggatgaataaaatccacatgcggggccgcatcgtcattggcgagggggaaagggatgatgcacccatgctctacatcggcgaagaagtaggcatttgcaccagagaagatgccaaatccttctgcaatcccgacgaattggtagaaattgacattgctgttgacccctgtgaaggtaccaacctagtagcctatggtcaaaacggttccatggccgtgttggcaatttctgaaaaaggtggtttgtttgccgctcccgacttctacatgaaaaaactggcggctcccccagcggccaaaggtcatgtggacatcgacaaatcggccaccgaaaacctgaaaatcctctccgattgcctcaaccgcagcattgaagaattggtggtagtggtcatggatcgtccccgccacaaagaattgatccaagaaatccgcaatgccggtgctcgggtacgtctaatcagtgatggagacgtttccgccgccatttcctgtgctttttccggcaccaacatccacgctctgatgggcatcggggctgctcctgaaggggtaatttccgctgctgccatgcgctgtctggggggtcacttccaaggtcagttaatctacgatcccgaagtggttaaaaccggcctaatcggtgaaagtcgggaaggcaacctagagcgtctcgcttccatgggcatcaaaaatcctgaccaggtttataactgcgaagaattggcctgtggcgaaaccgtattatttgccgcctgtggtatcacccctggcactttgatggaaggagtccgcttcttccatggtggggtacggacccaaagcttggttatttctagccagtccagcaccgcccgctttgtagacactgtccatatgaaaggaaagccccaaagtaatccaactgcattaatttccctctcggcaactatccccaagaaggttaaaacctggggaaatacatcgccgtttcccttgtcccctgaagttcagactttgggggacttatgttttggttgggtcatagtaactggggtttga

SEQ ID NO: 332 - DNA, 2001 bp, Synechocystis PCC6803
  CDS (480)..(1523)
ttaatccacgacggtgcccgttgtttggctacgccggatttgtttgatcgttgcacagaggctctccagcattgccaaggattaattgccgccatgccagtgaaggacaccatcaaaatagttaacgctgatggttggatcactgacacccccgatcgccaaggattgtggggagcccaaacgccccagggttttgacgtggccctgctcaaagcctgccatgacaaaggtaaacaggaaggttgggaagtaacggatgatgcggccctgctggaaaaatgtgggcaacccgtgaaaatagtgccaggggaagatactaacttgaaaattaccacccccgtagatttggcgatcgccgaatttattttggggcagaggtcggcaaaatccgcctgaaaataggcaaatttcggggttcggaaagatcaagctaggatggaagggactttgagcctagcaatccaaggagacttttatccatgaccgttagtgagattcatattcctaactctttactagaccgggattgcaccaccctttcacgccacgtactccaacaactgaatagctttggggccgatgcccaggatttgagtgccatcatgaaccgcattgccctagcgggaaaactgattgcccgtcgcctgagtcgagctgggttaatggccgatgtgttgggcttcactggggaaaccaacgtccagggggaatcggtgaaaaaaatggacgtatttgccaatgatgtttttatttctgtctttaagcaaagtggcttggtttgtcgtctggcttcggaggagatggaaaaaccctactatattcctgaaaattgccccattggtcgctatactttgctgtacgaccccattgatggttcctccaacgtggacattaacctcaacgtgggttccatttttgccattcggcaacaggaaggggacgatctagacggcagtgcgtcagatttattggctaacggagacaagcaaattgctgctggttatatcctctacggcccctccaccatcctggtttattccctcggctccggagtgcatagctttatcctcgatcccagtttgggggaatttattttagcccaggaaaatatccgcattcccaaccacggccccatttacagcaccaatgaaggtaacttttggcaatgggatgaagccctgagggattacacccgttacgtccatcgccacgaaggttacactgcccgttatagcggtgctctggtgggggatattcaccggattttgatgcaagggggagtgtttctttatcctggtacggaaaaaaatcccgacggcaaattgcgtttgctctatgaaactgcgccgctggcctttttggtggaacaggctgggggaagggctagtgacggccaaaaacgtttactggacttaattccttctaaattacatcagcgtacccccgccattattggcagcgcagaagatgtgaaattggtggaatctttcatcagcgaccacaaacaacggcagggtaattagtttacttaatcactgcaaatcgtttgaggtctaggaacgtcttttaaaagccccctagccccccaattctggggggaatagtgttcaaagtcccccaaatttgccggagctttagtgaagacatttggagagtggatcatgacttttcaaacatactctaacgccggagattcaactttgttggtaaatctacattgatcaatcctatgcgacagttattgctaatttctgacctggacaatacctgggtcggagatcaacaagccctggaacatttgcaagaatatctaggcgatcgccggggaaatttttatttggcctatgccacggggcgttcctaccattccgcgagggagttgcaaaaacaggtgggactcatggaaccggactattggctcaccgcggtggggagtgaaatttaccatccagaaggcctggaccaacattgggctgattacctctctgagcattggcaacg

SEQ ID NO: 333 - DNA, 1473 bp, Oryza sativa
  CDS (26)..(1315)
ccaagtcgaagcaaaatccctagcgatgtcgtcgccgccgcccgccgccgccgccgcgatggccgtcgacgacgccgacgacgaccagctcgcctccatgtccacggagaacatcgtcagggcaacccgcctcctcgacaacgagacccgcgtcctcaaggatgagctgcagcggacgaaccttgaggtggaatcctacaaggagaagatcaaggagaaccaggagaagatcaaactcaacaagcagctgccttaccttgtcggcaacatcgtcgagatattggaaatgaaccccgaggatgaggctgaagaggatggtgcgaacatcgatctggattcacaaaggaaaggaaaatgcgttgttttgaagacatccacaagacaaacaatattccttcctgtaatcgggcttgttgaccctgaaaagctcaagcctggggatttggttggagtcaacaaagacagctacttgatactagacacgctaccttcagaatatgattcacgggttaaggcaatggaggtagatgaaaagcctacagaggattacaatgacattggtggccttgagaaacagattcaagagcttgttgaagcaatagtattgcccatgactcacaaggaccggtttcagaagttgggaattcgccccccgaaaggtgttcttttgtacggaccacctggcactggaaagaccctaatggctcgtgcatgtgctgcccaaactaacgccacatttctgaaacttgctggtccacagcttgtccagatgttcatcggtgatggtgcaaagcttgtccgtgatgcctttcagcttgcaaaggagaaatccccctgcatcatttttattgatgaaattgacgcaattggaacaaagcgttttgatagtgaagttagtggtgacagagaagtgcagcgcacaatgttggagttgctgaatcagctagatggattcagtagtgacgagaggataaaggtgatagctgcaactaatcgcgcggacattcttgatcctgctttgatgaggtctggtaggctggaccgaaaaattgagttccctcatccatccgaagaagcacgagctagaattttgcaaatccattcaagaaaaatgaatgtaaaccctgatgtcaactttgaagagttggcacgatctacggacgacttcaatggtgcacaactgaaggccgtttgtgtagaagcaggcatgcttgccctacgccgagatgctacagaggtgacacacgaggatttcaatgaagggatcatacaagtgcaagccaaaaagaagtccagtttaaattattacgcttaattcttccgagagagttattaggcctaaggaaacgctccgtccaaaattgtttgtttgtaacactaccgttttatatatttgtgtggttcaagatgtgattgtacgaaacatgtcttgcgctgttccttctctgcttgatatatactgatagaagttga

SEQ ID NO: 334 - DNA, 2877 bp, Saccharomyces cerevisiae
  CDS (883)..(2187)
gaattcttcgaaattgcgggactcgcttacagttttggagaaagcagatagtattgaacacaataaaggaacaactatgtaaccaaccagtgatgagtttaaaaatttagtgcagatggaaaagaaaaaaatgatctagtatactgtctgcaatcaacaaaaactctagccacaacaaactaagcaatcttccccaaatcaacgatattgtacgattaatatatgcaaagaatagtaaggtaagctatagtaaaagggcaagtttaacctcttctgttatttgatctggtgatgagttctgccagaagagcctgtgcaataattttgccaaaaaaaatggcaaatttgctgaaacacgatattcacgtatatagtgatgataataagcatgctatatatcagtagtatgtattttgcagcttctactttctgcaatgtgatgccgttggcattgagattccaacgaatatacacagatgcctgatttgtttgcgattagttactgtaatagagaaaaaaaaatttaaaaaagacgaaagccccaaaagagacgagtgcaattagtggtgatactttatactatgtttaatatatatacctggtttacctagtgagtatgttcgtaaaaaaataacgtcagtaatggttgttggtcggcagccttggcgaattcttttattagcaatggtttaatcatgtagttacccggcaaatatgtggtggcaaaaatgaattaatgtatattttactgaaaaggaccccattaatgaactcttgggtaaaaagggcacatcaggagtttgtctaaaacgtttatacgagtgatttatttgtgcattatagaggtgagaacaaattggaaagttttaattttagtttaagatggccaccttggaagaattggatgctcaaactttaccaggagacgatgaattagatcaagagattttgaatctttcgacgcaggagcttcaaacaagagccaagctcttggacaatgaaattcgtatttttagatctgaattgcaaagactgtcccatgaaaacaacgttatgctcgagaagattaaggacaataaggaaaaaatcaagaataatagacagttaccgtaccttgtggctaacgttgtcgaggtcatggatatgaatgagattgaagacaaagaaaatagtgaatctactacacaaggtggcaatgtcaacttagataacaccgctgttggcaaagctgctgtagtcaagacttcttctagacagactgttttcttgcccatggtcggtttagtagatcctgataaacttaagccaaatgacctggtaggtgtgaataaagactcgtatttgattttggatactttaccctctgaatttgattctcgtgtaaaagctatggaggtagatgaaaaacccacagaaacttactcggacgtgggtgggttggataaacagattgaagagctggtggaggccattgtgttacctatgaaacgtgcagataaattcaaagatatgggaattagagcgcccaagggtgccctaatgtacgggcctccgggtacaggtaaaactttattagctcgtgcttgcgcagctcagacgaatgctacttttttgaagctggcagcacctcaattggtacaaatgtatatcggtgaaggtgctaaactagtgcgcgatgcttttgcactggccaaggaaaaggcaccaactattattttcattgacgaattggatgccattggtactaagagatttgattctgaaaaatccggtgatagggaagtgcaaagaaccatgctggaattattgaatcaattggatggctttagctccgatgatcgtgtcaaagtcttggcggctaccaatagagttgatgttttagatcctgctttgttaagatcaggaagattggatagaaaaattgaattcccactcccatccgaagactcgagagctcaaattttacaaattcattccagaaaaatgaccactgatgatgatattaactggcaagaacttgccaggtctactgatgagtttaatggtgcccagttaaaggcggtaactgtggaggcaggtatgattgccttaaggaatgggcaatcttccgttaaacacgaagatttcgttgagggtataagtgaagttcaagcaagaaaatcgaaatcggtatccttttatgcataaaaataataatattttgatttatcaagccgccattcacatatctacatattagaacaatccttttatttaaagtcgcgtaacttccttattattgatactgtatatggctaattgtatactacttattatttgatgaaaccgaaagcgtagacacaagtatatattcattggcgtttgactttttttttactgtattttcttttcgttggcaccttcgcaatttcaaggatgcattgaaggaaagagaaaagcgtaggagaacaagacgcatcgacggctacgggtgctttgagatttaacttgcagagctccatatacagcacacatctgtagatgatttagtgacatattaataggctgcagaaagggagtaaaacaggtagaagtaagatatcggcaccattctacttttcatataacgattgattaatcttaccaaagcattaaatttaaacaggcttgcagactgaaggagtactcataaagcaaccggaccaggtaatatttgttgtagtattatgggacagtcttcttcaatcagttccagttcagtaacgaagagggttcttcccactcaaaaaaattcacaaatagcaaagatattttggcatatttcaataacaaagcacagcaacaggtcactattccagaattagtcagttttaagggaaatttgcaaattgaagatct

SEQ ID NO: 335 - DNA, 6001 bp, Saccharomyces cerevisiae
  CDS (331)..(5520)
gtttctgggcttactttattcaacaaattattagtagacgtaaacttacttgttgccgcggtacatatttcaccattagagagtttattgtcactacattggccagtcattcaatgcccgcgtgcaaagtgatctaagtcgtttctgattccgaaaaattttgaaaaattttaagatgagatgagctaaacccttctatacattagcagcaactgaagaaagctcagtaaggttcgtctattcatttttatttaaagctattagtatctactactacagtctgaatcaaggaccgtttaatataaaaaacacacctgtactgttgcaaaaatggtagcttccaccaaaagaaagagagatgaagattttccactttcgagggaagactccacaaagcagccctctacctcatcattagtaaggaacactgaggaagtctcttttccaaggggtggtgcgtctgctttgactcctttagaactgaaacaagttgctaacgaagctgcaagtgatgtgttatttggtaatgaaagtgtcaaagcatctgaaccagcaagtagacccttgaaaaagaagaagacaacaaagaaatccacttctaaagattccgaggcctcatcagcaaactctgatgaagctagagctggactaattgaacatgtcaactttaaaacgttgaagaatggctcttctttgcttggtcagatttctgctatcactaaacaagatttatgtataacattcacagacggaatttctggttatgtgaacctaacacatatctcagaagaatttacttcgattttggaagatctggatgaagatatggatagtgatactgatgctgctgatgagaaaaaatccaaagttgaagatgcagaatacgaatcgtccgacgacgaagatgaaaaattagataaatctaatgaattacctaatttaagaaggtactttcacattggtcaatggctaagatgctctgtcatcaagaatacctctttagaaccatcaactaagaaatccaaaaagaagagaatagagttaaccatcgaaccttcatccgtcaacatatacgcagatgaagatttggttaaatccacgtctattcaatgcgcggtcaaatccatcgaggatcacggtgctaccttagatgttggtctgccaggctttacagggttcattgctaagaaggattttggcaattttgaaaaattattgccgggggctgttttcttaggtaatatcaccaaaaaatccgacagatcaattgttgtaaatacagacttttcggacaagaaaaacaaaattactcaaatctcctcaattgatgccattatccctggtcaaatcgtcgacttattgtgtgaatcaatcactaaaaatggtattgccggtaaagtttttgggttagtatccggtgttgtcaacgtatcacatttaagaacattttccgaagaagatttaaagcataaatttgttattggttctagtattagatgccgaattattgcttgtttagaaaacaaaagcggtgacaaggtcttgattttgtcaaaccttccacacattttaaaactagaagacgctttgagatctactgaaggtcttgatgcattccctatcggctacacatttgaatcatgcagcattaaagggcgtgattccgaatatctatacttagcattggatgatgatagattaggtaaagtacattcttcaagagttggtgaaattgaaaattcagaaaatttaagttccagggtccttggttatagccctgttgatgacatttatcaattgtccactgatccaaaatacctaaaattaaagtatctaagaacaaatgatattccaatcggagaattattaccaagttgtgaaataacttccgtctctagttcaggtattgaattgaagatatttaacgggcaatttaaggcttctgttccaccattacacatttcagataccaggctagtttatccagaaaggaagttcaagataggttctaaggttaaaggtagagttatatcagttaattcaagaggtaatgtgcatgtcactttgaaaaaatcattagttaatattgaagacaacgaattaccactggtttccacttatgaaaacgccaaaaatatcaaagaaaaaaatgaaaagactttagcaactattcaagttttcaaaccaaatggttgcatcatttccttttttggtggtttatcgggatttttacctaattctgagatctcagaagtctttgtgaagagaccagaagaacatttaagactcggtcaaacagtaatagtaaaacttcttgacgtcgatgctgacaggaggagaattattgccacatgcaaagtttcaaatgaacaggctgcccaacaaaaagataccattgaaaatattgttccaggcagaacaatcattactgtccatgttatcgaaaaaaccaaagattctgttattgttgaaattcctgatgttggcttgcgtggtgtcatctacgttggtcatctctctgattccagaattgaacaaaatagggctcagttgaaaaagctcagaatcggcactgaactgactggtttggtaattgataaagatacaagaacccgcgttttcaatatgtccctcaaaagttctctgattaaagacgctaaaaaggagactcttccattaacatatgatgatgttaaggatctaaataaagatgtaccaatgcacgcttacattaaatccatttctgataagggtctctttgttgcatttaacggtaagttcattgggttggttttaccaagttacgctgttgatagtagggatattgatatcagcaaggcgttttatattaaccaatccgttaccgtctatttattaagaacagacgacaaaaaccagaaattcctattatctctaaaagctccaaaggtcaaagaagagaagaagaaagttgaatctaatatcgaagatcctgttgattcgtctatcaaaagctgggacgatttgtctattggtagtattgttaaagcaaaaatcaagagcgtcaagaaaaatcaattgaatgttattttagcggcaaatttgcatggcagagtggacattgctgaagtgtttgacacgtatgaagaaattacagataagaaacagccgttgagtaattacaaaaaagacgatgtcatcaaggtaaaaatcataggtaatcacgatgtcaagagccataagttcttgccgattacacacaaaatctcaaaggctagcgttttggaattatccatgaaaccatcagaattaaaatctaaggaagtgcacacaaaaagtcttgaggaaatcaacattgggcaagagttaactggctttgtcaacaattcatcaggtaaccacctatggctaacaatttctccagttttgaaggcgagaatttctctactagatttagctgataacgattcaaatttttcagaaaatattgaatctgttttcccattaggttcagccctccaagtgaaagttgcctctattgaccgcgagcatggctttgtcaatgccattggaaagagtcatgttgacataaatatgtccacaattaaagttggtgatgaattgccaggtcgtgttctaaaaatagctgaaaagtatgttttgttagaccttggtaacaaagtgactggtatttcctttattacggatgcgttaaatgatttctccctaacattgaaggaagcttttgaagacaaaattaacaacgtcattccaactaccgttttatctgttgatgaacagaataagaaaattgaactatcccttcgtcctgctactgcaaaaactcgttcgatcaaatctcatgaagatttgaagcaaggcgagattgtagatggtattgttaagaatgtgaatgacaaaggtatttttgtttacttgagtaggaaagttgaagcctttgtccctgttagtaaactatctgattcttacttgaaggaatggaagaagttttacaagcctatgcaatacgttttgggaaaagtcgttacatgcgatgaagattctcgtatttctctaaccctaagagaatccgaaataaatggtgatttaaaggttctaaagacctattcagacattaaggctggtgatgttttcgagggtacaattaaaagcgtcactgattttggtgttttcgtcaaactagataacactgttaatgttactggtttggcacatattactgaaattgcggacaaaaaacctgaagatctttctgccttgtttggtgttggggacagagtaaaagctattgttttgaaaacaaatccagaaaaaaaacaaatttcattgagcttgaaagcgtctcatttctctaaagaagccgaattggcttctactaccaccaccactactactgtggatcaactggaaaaggaggatgaagatgaagtcatggcagatgctggcttcaacgattccgacagcgaatctgatatcggagaccaaaacaccgaagttgccgataggaagcctgaaacatcttcggatgggctatccttgagtgctggttttgattggactgcttccattttggatcaagcgcaagaagaagaagagtctgaccaagatcaagaagactttactgaaaataagaaacacaagcacaagagaagaaaggaaaatgttgttcaggataagaccattgatatcaacactagggcaccagaatctgttgccgattttgaacgtctacttatcggtaatccaaattcgtccgtagtgtggatgaactatatggctttccaactacaactgagtgagatcgagaaggctcgagagctcgcagaacgtgcgctaaagaccatcaacttcagagaagaagccgagaagttgaatatttggattgcaatgctgaatttagaaaatacttttggtaccgaagaaactttagaagaagtgtttagcagggcttgtcagtatatggactcatatactattcatacaaaactgcttggtatttatgaaataagtgaaaagttcgacaaagcagcagaattattcaaagctacagctaagaaatttggcggcgagaaagtttctatctgggtatcgtggggtgattttttgatcagccacaatgaagagcaagaggcacgtactattttaggtaatgctttgaaggccctaccaaagcgtaatcatatcgaggttgtccgcaagtttgctcaattagaatttgcaaagggtgacccagaaaggggtcggtcattattcgaaggtttggttgctgatgcgccaaagagaattgacctgtggaacgtttacgtagaccaggaagtgaaggcaaaagataagaagaaggtggaagatttatttgagagaataataaccaaaaaaataacaaggaagcaggctaagtttttctttaataaatggttacaatttgaggaatctgaaggtgacgaaaagaccattgaatacgttaaagctaaagctactgagtatgtcgctagccatgaatctcaaaaagcagacgaataattcctgatggatttttaactgtaaagtaatataaatggctaagtttgtaaagtatatttgtaaagtacatagaatgtaaagtttcaagaagcaatttctatcgatcaatttagctttgacggttcgtagagctccttttcttaaagttttagttccgcttctcgcttcttgattacaagatggttccgtgttaacgaagattgagttctatgtattttttatattcacacgctaaaatcacatatttattaaataatgaagtaaattttaaaagcacttttttcaaccagagtgctctgtttgatacatatcaacaaaatccattaaaatatctggtttgaaaggccactccatgaataatttcgttagatatataaactcgtcatttgtcaaatcaatcggacacttttttagcagatctttgtcagtgattctactattaaaatattgttggccaccatgtcccagcgagtccatgaca

SEQ ID NO: 336 - DNA, 6001 bp, Oryza sativa
  CDS (277)..(436), (479)..(1524), (1790)..(2065), (2150)..(2425), (3134)..(3262), (3380)..(3580), (3683)..(3825), (3905)..(4190), (4294)..(4433), (4711)..(4789), (4874)..(4929), (5754)..(5946)
caattctgcatcatttcggggtagtatgtttcattggagtgcttcagcagcttcatccaaactaaactcacaacagctgcctgtgatggaggtgcccatctaccatgatagagttactcctggacctaataatctgccctcctgtgcatataatgtatcctccactcagggtgagttgagatgatgagttacctattttaacctcacaatacaccttaatttttttaattctttattggcttgattttggcaggatataaccaatatgaaaactgtatgggtgctgctaactttgctcattcgttggctgataaacccaagcagatgcctgaaagattagcaaacaccatttttacctcatgtgcatcaactctaccgaaatgtagccctagtattgatgtactgcatattggccatataaaagaacatttctcaggtgagtttacatcccctttcttatgtctgaaacagagttgagctgaagttatttggcatcataaacactatggtcaaattttgccaggtgatgcgtatcaaaatgatagttcacaaccatcaacctctgggagttctagttctttgtcagcagtgtgggatcaaacaacatgttctagtgcaatgagaacacttccgatggattctttctcaacagtgaacggacaaaacctttccacaaacaataaaagtttgtatcccacaaccggtcagggacctttgttgcaacaatacatagaatgtgagatgaagcaagagacgtggagtcggtcactagagcaatcagatcagtcaaacattaccactggaaaccgtgacttgtatcatgctcaaattcatccgtacatcaatggagagcacaaacgggatcgatgcattcaaatgaaagaaaaacttgggcatacttctgatcatgaaggtttctccagggagaaaagctcaaatttaagcaaccactttatgcatcatcagcagggcttcatgactaattatggtgcttgtagccctgtaagcaagacagtggatagagctgaacagacatcaaatagtactgtatcaaagccgacttcacctgcttcagatggatcttctggcaagcattatccagcaaaacgcttgaaagttgatgttccccatcttgtccatgtcaatgaaatggaggcttcaaaggaacaacaacctgctgccaatgagacttatgcatctgctgaaacagtacaatctgaagtcactaattcaccaacaaaatcaccatgttgtacttccttgggggacaacattgcttgcaccgataatgtacatggaatggatatggtcagattgtcggggagtgctgtacaaactgaagaagaatttcgtcgtgaaaatagtgacattgagatgaaggatgcaaaggttgatttattggaccaaacattgtcaggggacagcctgagggcaaggaagagaagaggggcctcagtactttatgcattaacttctgaggagcttaaagatcacttgtgtactctgaaccatgatacttctcaggtgagtgaataacctgttggatcttgtatgatttatctagtattgtaaagcacttgattattattggttgatgtagtctagagaaattttcaaactgagcagctgcaaaattaactaaatattatgtactttcaattgattttcatttggtactaagattttgggttttgttgtcactcaagctttcttgattatattgtacagagtgtgtgcttgttttaagcaaagtttatatctcttaacatgattaacttattttttgtagagcaaagtgccgactgaagagctgctatcagttgaaggcttgcctgatcagaacacatgcaatttatgtgggatggaaagactcctctttgagccccctccacgattttgcgcgctctgttttaaaataattaattctacaggatcctattatgttgaagtggaaaatggaaatgacaaatcttcaatatgtggcagatgccaccatcttagtagtgccaaagccaaatatcagaagagattcagctatgcagagacagatgctgaggcagaatgggtaacatatgcttctcttatttctctctagtcatttggaatcatatacgaattactcattttttgtttaattatgccttttcagtgggtccagtgcgataagtgcaaagcttggcagcatcaaatctgcgcactttttaaccccaaaatcgtggatccagaggctgaatatacttgtgcaaaatgtttcttgaaggaaaaggataatgaagatgttgattcacttgagccatctactattctgggagcacgcgagttaccaagaactagactaagtgatcatattgagcaaaggctttctgagcggcttgtgcaggagcggcaacagagggcaattgcttctggaaaaagtgttgatgaggtagttgtgttatgcttttcttttataccttgtcccgtgtacagaatatgctggtgttgcattctgctaccgttgaacaggctacctcactgttaacctattgaaccacagccaaaagttacatacgtctttccaattgcatttttgtgcttcttgctctatgtgctggattgaaggttacaagtaacatgttagtccttatattatagtcttctaagttgacttagataattcattacatgaatgcatctttactgtcatacgtttctttttattttttacaatgtactgatggcatttcacttaatcatgttcttaatacttctcttggtgcatctagcaatgtgtatttatggcttcaggattgcagctgattacacatgaattcatctttggaacacatgttgatgaccatatatttgttgcgtttcagtatcctttttagtgaaactacttttttcttctttttccttgcattttattggattccgataaaagttggttctgcatattcatctgatttagctgaccaagatgtcatattacaattcatggtcaaacttggaacataaacttgtggatgctttgcttagtcttatctgatcatctatgctgatcttaatgttatttttctgcctctaggatttttattacactgtaatatactggagaaacttattgggcgaacttttatggtccaattattaggtaccaggagttgaaggtcttactgttagagtggtatcttcagctgatagaacactgcaagtccaaccacgtttcaaggatttttttaaaaaagaacaatatcctggggaatttccgtacaaatcaaaggtgattatgtgatacttatactttactaatgctattattataacatccatttaaattatgctttcattatttagtggataatgtgggttaccatttccgtgttttgtgcttgtgcaggccattctcttgtttcaaaagaatgaaggtgtagatgtatgcctgttcgccatgtatgtgcaagagtatggttcagcctgcccatcaccaaatcaaaggcacgtttatcttgcatatattgattctgtcaagtacttcagaccggaaatcaagtcggccagtggagaagctctccgtacctttgtgtatcatgaaattttggtatgagaatgcataatcattaaacacttagtgttcttgatcttgatttcagtttatggatctcatgttggtctgattatcttccaatctgttttcccccagattggctacttggatttctgcaagaaacgagggtttgtaagctgttccatatggacttgcccatctacaaagcgtgacgattatgttttatattgtcatcctacaatacagaagatgccaaagtctgacaagcttcggagctggttggtcttcatcatcttttacagtcaatcctaaaattatttatgggccttcatttgataatcttttcaatatatttaggtaccagaatttggtaaagaaggctgttaaggagggggtagttgtggaacggaatacactctatgacttcttccttcagcccaccaatgaatgcaagaccaatatctcagctgcatggttgccatactgtgataatgatttctggcctggggaagcagagaggctccttgaaaagaaagatgatgacacctcacagaagaaagaaactcaactaggaaggcttctacgggttgccaaacgtgatgaccggaaaggaaacctcgaggatattttacttgtgcataaggttggttgtttaaatcatggtgctccctttcttcagaattttttttcgccgggccttcttcagtattttaggcacttgaccccttaattttcattgttggcagcttggagaaaggttgcgaaccatgaaagaagattttttaatgctttgtctgcagcaattttgcaagcattgccaccatcctattgtatctggtagtagttgggtttgcaccagctgcaaaaacttctttctttgtgaacggtaagcattcagtcatgtaaacttttgtgaccatatagaatgcatttcccatactgaagaactttctggaacagcactaggggaaatgtctgctgttggtaaaaatatataattgcacatggcacttgcatagttcaaccattctagcttatacagtgaccgtttgcctgtcaaattgcaaaatgaatctacattcctactcttttgttgttattcaattactctttgtcgttaaggcacccattatttatgatgccattcttatttgtcctcgtagttgttatgctgaggagctgaatacccctctgaaggacaggcacccagctacaacaaaacaaaagcatgcatttgaaagagtacgtatatgaattcatctatttaaggtagctacaatctgcctgcatggaaatactaaccagattactaatctcctctgacagatagaggaagaacctcttccagaaacggatgatgtagatccaacaatggaaagcaagtactttgacagcagaatagatttcctgaagcattgtcaagacaatcaataccagtttgatactctccggagggcaaaacattccacaatgatgattctttatcatctacatgattcaacttgttcttcttgtcaccgtgccatggatcaatgcttggcatggcggtgcttggtttgcctaggctgcaacttttgtgattcatgctataaacaagacggtgaaagtttgcatattcataagttgaggcagaaaaaagaccatcacgtattgcagaagtacactctacaggtatccttaaattggtagctgaatctttttcatctcctatttgtgtttttcatgaatgtttattatgcactcgaaattaacatcttctgattttttgggaacaactctggggatctgatttttttttggttgtttgctcttcgcatgattatatttggcataaactgtagaatataagtgagttgcactattattatttgttccataattttatccttttggtttaatcttgagcatatgtgtgaagtgtatgcttcactattcttatgtgttgcttcatgttatgttttgtcccagtattttgtgactgcatatccaaattttcaatcaggatgaaaaatattctatgagcttttagattctaatgtggtaattatgtggtttcatcccaaatattattttctgctagtgatatttacggtgcctcttgctaatgaattggatgctttcaaagcaggactaccttgaaggcttggtgcatgcatcaagatgttttgatcgaagttgcacttccaaactttgtttgacgttaaagaaactgttcttccatggtgtacgatgtcatacccgtgcccgtggtggaggaggttgccatatgtgtgtattcatgtggaaactgctgttcacgcactcactgctttgtgacaatgcagactgttcagctcccagatgcaggtaaagtgtgcatcacccgcaatattgatctgccttccggagttgtgaaataattttcacaattttattttttccaattggcttgttaattatctttttcccttttaa

SEQ ID NO: 337 - DNA, 6001 bp, Oryza sativa
  CDS (616)..(903), (1848)..(1940), (2046)..(2165), (2254)..(2355), (2443)..(2693), (2849)..(2994), (3165)..(3363),(3475)..(4141), (4438)..(4770), (5028)..(5309)
ttagcgggttcactgctaatggctatggttgtattaacttatatttttttgttgttaagggtgtaatgccgctgcttgcagccataactaaggctatagggagcgttcttctggccggctacaatggttgcagttgtagctacgcacagtgagtgcggcactattcgtgtcgatcatggtgcagtcacaaaagcaacagccgaaaatgctcattaaatagagccgcttatttttaagttaattagaactgatctaaaagttttacatataaattatattttggttgatactaataaaaacatgatggctggaaacaacaagacataaattttggaggaaaaaccgctgtaaaatacactccgtctcccacaagagaacacgccattttggcaggcgtttccccctccgaactccaccgaggtgatccctcccatggcggccgttagctacgagtagccgcggagacggaagactctcccacctagcaaaaggactagtagcaatccagcgaactcaaagccacccctcctcgtctccctcgcccaagtccacggcgagccgcggcggcggcggcggcggaggaggaggcgcagcgagtgggaggggaggcggaaaatggtggtggtggacgcgtcggagttcggggcggaggggttcgacccgaagcggtggatcaacgcggcgctggacgcgcgccacccgtcggagccgctcgaccgcttcctcgccgacgccgaggagcgcctccgctcggccgccgacgacgccgcggccgcgctcgagcgggacagcgccgacgcgctccgccgcgtcccgctcgcctgccgcgacgcgctccgcctccgcgacgacgccgtctcgctccggtcccatctcgcctccgtcctccagtcgctctcccaggtgcgcccccgctcgcctgctagttggatctggatctcacagttcactcgtgcacaattgtacgtgtatcacgcgaaacccagatcattttggaggattacgaacttgcgataatagttggtgcgaatgagcaaatgttgaaccaatttggcacaataggttttagtttgattcatttatgcgtatgattcagcctctggccgcttttagtaccccccgttttttcacttggatctggatctcacgtactgtatttggtcatgtcaattttatccttgtacgctttgcattgaacagtgcgtacaactagaactgtatttagtcatgtcaattttatcgctgtacgcttttatcaaatgatatgttaatttgatcatctctgttaactgaaactgaagtcagaatttgcgtgggcttggcaaaaccaagctggagctctgttggcaaaatccttgcatgtgtcgggatgttataatgctgtgtacttatgcaatgcagttatgtgcatgtaaactttgagtatgctgtagaggacattcaaatccagcagttcagtgatgcccataaaactatgcctatagtctattataatgggataccgtcacttatatcatttagttcatataggtgataggtcaggatgctacatcaaatcacaagcaaaacattttctcctgtagcatgtacttcttgttacgtgtagcgttatcttctcataacatttagcttgacattttgtagaatacactggaatgaatttgctagcactagaacttttttttttgggtactgagtgattccttctttgtaacggccaatgctgaatactgggtgttaatgaatgaaatatgacatacatatgcatgtatgatcaactaactaggtattcagtcccatctacatttcataaattctgtattactgatgatgatgatttcttcaatcaggctgagggttcatctgcagagtcaataactgcactagcacgaattgatactgtgaaacaacgaatggaagcggcgtatgcaacattacaggtaagttgtatgtggactatggtgcatgttactgaagtaaatgcttcactcacagtggtaggttatcttttaatagatttaacagcttgttggtcggaatgccaggatgcggctggactagctcagttgagccaaagtgttgaggatgtattttctagtggtgatcttccaaaagctgcagaaaccctggcaaccatgagacattgcttgtcggcagttggtgaggtattgtactctctcacacaaacatgcacagtacactgagtttatatgcagaagctatttgttttgcttatataaaagttgctttcaggttgcggagttcgctaatgtgagaaagcagcttgaagtattggaagaacggctagatgacatggttcaacctcgtttggtggatgcactttctaaccgcaaggtttttcttactaatctcatttatatttgttaaacagtagtacaggcatctctatttcatctaaagcctacaaattttggttggaaggtcgatgctgtgcaagatcttcgtggaatactgatacgtattggcagattcaagtcactggaggtgcaatatactaagatccatgtcaagcctctaaagaaactttgggaagattttgatctaaaacagagagctaagcgggtagagatggagaagtatggtggagaaagcataaacagtctctcatttgctagctggcttccaaatttctatgatgagacactactttaccttgaacaagaatggaagtggtatgttcattgtaccctgttgtcttttgttctgaatcagcaatgtttgcccttgtaaacagaagccagtttttggcagcatcttttagctgcattcggacaatatttttgctccaccaaaaattaatggatgttctacaatgctaatgctgaaggtgcctgactgctttccctgaagaatacaaatcactagtcccaaaagtacttgttgaaaccatgagtgagttgaattcaagttttgtctctcgtgtcaacctagcaactggagatgctgttcctgaaactagatctgttgcaaaaggtaatgcataaacttctcgtattatttcatttttgtatgtctatactaatttcatgattgaattacatgttttatttttctctgttcaattaaaaaaggatattacttgtttgccacatatgcgtacttctttcgtaacaataaattgattttatgtcctctgtacccaggtatactagatgttttatcaggtgacttgccaaaaagtaccaaattgcagaataagcatcttggagcactgatcgacctgcacaacatgacgggcacttttgctcggaacatccaacatttattttcagagtcagatcttttagttctgctgaatacattgaaagctatttattccccatatgagacttttaaagcaaggtaaaaaaaaaacttgtgaaaaattctgttgcatgcagttaactgcattggtgagattttttttgttgctattgctgtagtactcagccagtggtgtttcatgctatgtaggtatgggcaaatggagcgtgctttactttctgctgagatggctggtatagatatccgtggggccattgctcgtggtgtgggtgcacagggtatagagctgagtgaaactgttcgtagaatggaggaatccatcccacaaattatagtgcttcttgaagcagctgtcgagagatgcattagtcttactggtggttcagaggcagatgaactggtattggctctagatgacattatgctgcagtacatatcaaacctacaagaaactttaaaatcccttaggattgtatgtggggtggataatactgcacatagtgattcctctaaaaaggaagcaggactagagaaaaaagaagcacaacgattggtcgatgtctctgaagaggaagaatggtctattgtccagggtgctttgcagattcttacagttgctgattgcctaactagcagaacctcagtttttgaagcttctttaagggctactcttgccaggattggaaccaacttttctatttctggttttggttctagcctagataaatcaactgcagcaaatggtgatgagaatgcagaagtgcctatcacagggagggcagcacttgatattgcagctattcgcctcaccgatctaccagacaagtctaagaagctcttcactgtactagaacaggcaagttatatatttttaaattatcttgctagtgtcacaacactagagttatcacatgtttctctgatttgtttgaacagcctgattgcaaacttaggtggtagtattaagctagattatctggttttataggaaattcggagatcttttttagctttccttttctattatgcatttttttaagctactcatatgtggcatagaacctattttttgacctataatttcccaagtatcacaagtaactctttgtttgtcttcatggctaatttaaagataacatttctgttatacagtcaaaagatccaaggttccatgctctacctctgacatcacaaagagttgcggccttctcagacacagtaaatgaactcgtctatgacgtgctcatatctaaagtccgacagcgtctcaatgaggttgctcgcctcccaatttggtcatcggtggaggaaccaggtggccttccccttccaagcttcagtgcctacccgcaggcatatgtgaccagtgttggggagtatctcctaactttaccccagcagttggagccacttgcagaaggtatctcaggcggtgaggctggcaacgaggaggctcagttctttgctactgaatggatatttaaggtaatatattcaaagcattttttttcatcatgctgtgtacattcgcaacataccatcgacaaaaccattcatacttcacactgcgactttcgcaaattccgtacagaagagttgaccatttagaactacatgcattgcaactgaatacaacattacataaaaccccaataatctgaccacaacataaacaccgaacccaaatcttttgatgaattaatctagaactgtctctgatctctgtttccatgatgaaccaggtcgcggaaggcgccaccgcgctgttcatggagcagctgcgagggatccattacatcaccgaccgaggcgcgcagcagctggcggcggacatagagtacctgagcaacgtcctctcggcgctgtccatgccgatcccacccttcctcgccaccttccacacctgcatctccaccccgagagaccaggtccgcgacctcatcaagtctgacggcggcagccagctcgacctccccaccgcccatctggtctgcaagatccggcgcatctcgtcatcagattagtgaaacacaaaggttgccttggtttgttcacgccctgtaacatcgtgtgcatccatccctccaccgttttcccacatcctgagcaaactgatcctgccgacgagtggttgacagtttgacatgtgcttgtaattctttaccattctgcatcttggctacagagttttgcctgtgtaatcgtattccttacagatagagaataatcattagtatatcatcatagaagaaaattctacactatgtgtaaattcgacgaggaaaaaaattcagtcggcaggtcgtgcaagggaaatggacggctctggctttgtttacccaataactaatgttggcagcaacttagtatgtcatattgccatgctctgaccagtgtgtcgccttcacatctccaggattccaagcagtccaatcttgcgtgagccgtgagtccagcagccacgacactacaagccatcggaggaaaaccccactggctacgaaaatggcacgcaaaaaatacgagccatttgccaatttcaccaggacggagagatatttcacttcgtctccatgggctttggcttccgtctaagtgggctcatctcttccttatcgacgctgtgggcacggaggcggccacgtcgcccccatccccctctcctcctcttcctccccaaatccccacgcaactgcgcaccggagagagagagaga

SEQ ID NO: 338 - DNA, 1179 bp, Zea mays
  CDS (309)..(1037)
cccacgcgtccgcccactttcattgagagacgaacacgcgagtagagaatttctcctgcctgctcacgaccgccctctcgccggtcgccggtcgccgctcgcaacgcaagtcggaagaggaatctctccaagctccaatcctccgatcctgccccaacccaagtcccctccaccaggccgcacacctccgccgcccggcgcgaccttgcatccaccagcctgccctctccttcgcgtgaggcggccccggcgaccgcgtcggcagtgcaagaccagaccgaggcttctcccgttggaaggttccagccatggcgagcgccgatctgctgcggaaggaggaggagttctactcctccctctttgattccgcaaaaggcgacggcgtcaagtcgcgctcgcaggtgattgagaggaagattgaatccctcgaggacatggccaccaaggtcagcaaccggagatcaagaagatggttgaacgaccgcttgctgattgagcttgtcccacgccttcatgttgaagaaatcaaaggcctctttgctcctccaccatggggtgaggagctgcccttgtcagcattctgcaggacaagtgttagtgactgggaggccttcaggagcatcgacatggatgctgaggcaagattgatgcaacacatgaaacgatcatccgaaaaacaaaggactcatgtcgacgaagatgaattgattgctctgaatgcttggcgtcgtataggtcgccaaacaagagaagctattaagaaaaaatttctacctgatctacttcaaatatatgaagaacaggttagggccttcattgaaggtactggtgacagcgacgtgcttgtgctgaatgtccaggacccgttccagaggctgcttctgcacggtgtttgtgagttctataacgtaacctcaatgaccacaagcagtgtaagggacgggaagccatggaagagcaccaccatcaagaagaggcatgtcaccggtcttcctccgagaatcacattagttagcttcctgaggatgaggaagaattagtcgtcccagtaacatgtggatgtgagggtcctacactaattcgcctggatgtgtactaaaaagacaaatttgttgctttaggtcgcatctagcatgtaatcaaatgtaaaatatccatgtcaaatgtaaaatacattgc

SEQ ID NO: 339 - DNA, 849 bp, Zea mays
  CDS (114)..(599)
ctcaagtgctcagtgctcaccgctctgcccctgcctcatcacacgcgcgcacggcgcacagataccttttctctcctctcccgtcccactctcctgggcaatcccggcccggcatggcgagcccgtcctcgtccccctcgcggaaggctctgagcaagatcgcctgcagccgcctgcagaaggagctcgcggagtggcaggtcaacccgcccgcgggcttcaagcacagggtcaccgacgacctccagaggtgggtcatcgatgtagcgggggcagcaggcacgctctacactggcgaaacctacaagttgcaggtggatttccccgagcattatccgatggaggcacctcaggttatatttctgcatccagcaccgatgcatccacacatttacagcaatggacacatctgtttagatatactgtatgactcgtggtccccagcgatgactgtcagttctatctgtatcagcatattatctatgctgtccagctcgccagaaaagcaacgcccagctgataatgatcgctatgtcaagaactgtcgcaatgggaggtctccgaaagagaccaggtggtggttccatgatgacaccgtgtgatcggtgttccgattattgttgtcctgtatgcatttagttgccagactatgggagatggacttatttcgaacgacccatttgaccagaaattaacatgctcttgtggtttgtagatgaatgtgcatcagcgtcaggcctgtactttctgattcttacaccgtcgatgatatatagaataatgtttgtatcttgtcaatttacggaacagacatgaaattcaatgcaggtcactggtttctgaaaaaaa

SEQ ID NO: 340 - DNA, 1131 bp, Zea mays
  CDS (90)..(785)
cacgcccgcagcgcctcgcctcggctgctctacctctatcccgcgacccgcgagatcggaatcgcggcgccccgccgccctcctccaaaatggcaccgtctctgctcggggggttcaccaagtcgttggccatgacggtgctctccgagatcggggacaagaccttcttcgccgccgcgattctggctatgcgccatcccaggaaactcgtattggcaggctgtttaactgcactaatagtcatgacagctctatcggcttctctaggttgggttgcaccaaatctgatttcacgtaaatggactcatcatttgaccactctattgttctttctatttggcatttggtcattgtgggaaggcttcaaggaagatggagattcggaagaattggctgaagttgaagcagagctggatgctgcctttaagagtaataaaggtgaatctaaaaataaatttaaggcgaatgatgatatgaagaaacagcaaagaccatttctcatgcagttcttctcaccaatttttctgaaggcattttctattacattctttggtgagtggggtgacaagagccagattgctacaattggcttggctgctgatgaaaacccgttcggtgttgtcctgggtggaatcatagcgcaagcactctgcactactgctgccgttcttggtggaaagagcctagcgtcccagatatctgagaagatggttgaactgtcaagcggagtgctcttcctgctcttcggtatcatgtccttactctctggaccagaaggagaattgtaatccctgcttgagcctttttcagctagctgattaacatggctttctcttcttagacctatcttatttcagtacatgaatgatggcaacgaaagccatccatccatggcgaacaggatggtgatttaacagtttagccgacacgctgtaaacatttcagtcgcccttcaaaaattactacatgttacagaagtctgtagcgattgtatatttgtattctgtcgtgcccagcacgtgaaattttgttatcgcaattacatgcgttaacaaagctttgttcgtgaacctattcaggcaattaatatggggcttatagcaggcctttgtctttaaaaaaaaaaaaaaa

SEQ ID NO: 341 - DNA, 1533 bp, Oryza sativa
  CDS (57)..(1343)
ccaacgcaaaccgcatcgatcaactccttccccaagtcgaagcaaaatccctagcgatgtcgtcgccgccgcccgccgccgccgccgcgatggccgtcgacgacgccgacgacgaccagctcgcctccatgtccacggaggacatcgtcagggcaacccgcctcctcgacaacgagacccgcgtcctcaaggatgagctgcagcggacgaaccttgaggtggaatcctacaaggagaagatcaaggagaaccaggagaagatcaaactcaacaagcagctgccttaccttgtcggcaacatcgtcgagatattggaaatgaaccccgaggatgaggctgaagaggatggtgcgaacatcgatctggattcacaaaggaaaggaaaatgcgttgttttgaagacatccacaagacaaacaatattccttcctgtaatcgggcttgttgaccctgaaaagctcaagcctggggatttggttggagtcaacaaagacagctacttgatactagacacgctaccttcagaatatgattcacgggttaaggcaatggaggtagatgaaaagcctacagaggattacaatgacattggtggccttgagaaacagattcaagagcttgttgaagcaatagtattgcccatgactcacaaggaccggtttcagaagttgggaattcgccccccgaaaggtgttcttttgtacggaccacctggcactggaaagaccctaatggctcgtgcatgtgctgcccaaactaacgccacatttctgaaacttgctggtccacagcttgtccagatgttcatcggtgatggtgcaaagcttgtccgtgatgcctttcagcttgcaaaggagaaatccccctgcatcatttttattgatgaaattgacgcaattggaacaaagcgttttgatagtgaagttagtggtgacagagaagtgcagcgcacaatgttggagttgctgaatcagctagatggattcagtagtgacgagaggataaaggtgatagctgcaactaatcgcgcggacattcttgatcctgctttgatgaggtctggtaggctggaccgaaaaattgagttccctcatccatccgaagaagcacgagctagaattttgcaaatccattcaagaaaaatgaatgtaaaccctgatgtcaactttgaagagttggcacgatctacggacgacttcaatggtgcacaactgaaggccgtttgtgtagaagcaggcatgcttgccctacgccgagatgctacagaggtgacacacgaggatttcaatgaagggatcatacaagtgcaagccaaaaagaagtccagtttaaattattacgcttaattcttccgagagagttattaggcctaaggaaacgctccgtccaaaattgtttgtttgtaacactaccgttttatatatttgtgtggttcaagatgtgattgtacgaaacatgtcttgcgctgttccttctctgcttgatatatactgatagaagttgactcgtcccttgcgtagaaaaaaaaaaaaa

SEQ ID NO: 342 - DNA, 979 bp, Zea mays
  CDS (113)..(853)
caaatctttcagccacccgatccccaaccgcccggcccgacattccctccaaccgccgctgcggctgcgccgcccaccgccgacaggcgcagcagtcaacaggaaccgagccatggcgagcgcggatctgctgcggagggaggaggagttctactcctccctgtttgattccgccaaaggcgatggcgccaggtcgcgctcacagctgatcgagaggaagatcgaggccctggaggacatggccaccagggtcagtaaccggagatcgcggaagtggtttaacgaccgtttgctgattgaactcgtcccgcgtctttacgttgaagagatcaaaggcctattcgctcctccgccgtggggtgagcaagtgcccttgtcagcattctacagggcaaatgttggtgaatgggattccttcaggagcattgacatggatgctgaggcaagattgatgcagcatatgaaaaaatcattggaaaaacccaggaatcatgtcgatgaaggggaatcgattgcgctgaatgcttggcatcgaatagatcgacacactagagaagcaataaagagaaatttccttcctgatctgcttggaatatatgaagaacgcgttagggccttcattgaagacgctagtgacaaagatgctcttgtgctgaatgttcaggacccatttcagagactactgctccacggtgtttgtgagttctacaacgtgagctcgacaaccaccagcagtgtgagagaagatgggaggccttggaaggcaaccaccatcaagaagaggcagggcaccggcgttccctctagaatcacactagttagctttctgagaatgaagaagaatggatcgcagtaacgttagttagcgttcaagaatacaacaaaattgctttagattccgtttaggctgttgcaagacaagtgagtggtcactggcaatgtgttcttatatcgcatcagcctgctggctacggtttgg

SEQ ID NO: 343 - DNA, 2437 bp, Zea mays
  CDS (253)..(2259)
atcgtcgtcgtcgcccgccgctgctaggtttggggtttccggtggccaggacccaagccagctccgtcgggcgccgtggggaactgctgggaggggcggtcgaccggcggtgcctctgcttcgggttctccgtaccggcgtcggaggggatcggatggcataagttggagcaaatctaagtcgttaaattgagaatagtccaaggaaacctaattcatcctattttggcccaagacgacgctttccactagaatgaaggtggcaaatgggttgtctttgaggaaatctaatggtaggtttaaatcaaagcttatgatggaacttgttaaacaatggcgagaacatcaagcaaatatgaggtgcatgaatctatccaagcgtaataacaacatctatgttggggcagaaggagccaacataacttctcccaacgatagcaacatttggccaacgagtgctttagtagcaaagaatagcaacccaagatatgtgctagcctcaaagtgtgcaagccagcctcctacaatgtggctagagaatagcttgaatacttcatcgggtttcaagtgctctaagctctctatcgttaggaatgcacttccttcgaaaacacctaaggcgtctgtctcttggaagtcaaaggatgattcgaatgccataccaagacacctagagcaatctcactgtaaaaagacatctagagcaactcgaactcacttcaaggcgatgccgaatttgattcacaaggcaaagaatgttgatacctcaaatctaaacgatggtacctcgggttcaagttggaggggtcagtcggattcatataagggagaggacataaatatcgggaaggaatgcactaaaacttcagagttgttgaaaagtagagaagcctcaagaaaatcaaacatcctagtggtagatcggaaggatcctaacaaagatgagccagacaaagtgaaaggaatccaagatgaagttatgaccaaagaagagggagtgaaaggccatacctgtgaaggtcgtgcgacgtgttggagttgtcttaagcaggcgaacaccacaaagacaaatgatgctccaaatttaggttcattgttggttggtaacgaacacatgcaaggcctcatgagtaatttgagagataattcatcccatttgtttgaaaagaatcattcaagacaccaaagggatgatccatgtgaatatagagaaacaaacttgaagtttcctaataggatccaatcagttggaggcaatgggaaaaccaatgatgtcacatctaggaggaaacgactcttgttagaagaaaaggctagcgcacacgtgcaaaatgatcttacttatggaccgatgaagaggcggaggtacatagaagccaacgaagatgaagaagagcaaaatgatcttacttatggaccgatgaagaggcggaggtacatagaagccaacgaagatgaagaagattatgtcggcgaccaccatccggtgcatattgaagatgctaccactgaattgacaccgcaggattctatttcaaagcattgcgttgagcgacaatgctattgttgctcaaagcctattgacatacctagatggagtggaacctttaagatagatggaaaggaacacatatcactggctggacatttgtcatccaaatcttgtgagaaagtgtggaaattgtcatcattgccgaaggtggttcaagtgacaaaggttcctagaatggcagtgtggcctaagatatttaaagcatcagaacccagtggtgacaatattggcctatatttcttccctcctgaaatgaggcacgatgaagaactagatcaactagttaatgaagtcatggataaagatttgatcttgcgagctattattggtgaagctgagatgctgatattcccgtctgttctactacctgaaagatatcagacattccaaaccaaacactacctatgggcggccttcaaagcaaaggaggataaaggtgatgcaattgtagaggaggaggttgagaagggaaattgcgtttcaaaccagccagacaaggtacagtctgataatgcttcatttccttcaaaccatggactggaccgtccaagcatggaagctccccctcaaagcagtagcagtgtctttggtattgttgtccgacaagctccaaatcttgaaccagaagtgaagcgatttatccaggagatggaacgcaaaggtgcgttggtaacggttatgaggggggaggcaattggtggagggccatagccaagcaacaccacgaccactatgcattagttgtagagagagtagagagtaaaccatgtcaaactatgctgtagttgtatagagagtctgacacataacgtcgtggacttgagctcttgttcagtttttttgtaaggtacctacaagtttggtcatatgataatttctccggaac

SEQ ID NO: 344 - DNA, 2437 bp, Zea mays; identical to SEQ ID NO: 343
  CDS (253)..(2259)

SEQ ID NO: 345 - DNA, 768 bp, Arabidopsis thaliana
  CDS (58)..(654)
attactcatcatcaagttcctactttctctctgacaaacatcacagagtaagtaagaatggtacagacgaagaagttcagaggtgtcaggcaacgccattggggttcttgggtcgctgagattcgtcatcctctcttgaaacggaggatttggctagggacgttcgagaccgcagaggaggcagcaagagcatacgacgaggccgccgttttaatgagcggccgcaacgccaaaaccaactttcccctcaacaacaacaacaccggagaaacttccgagggcaaaaccgatatttcagcttcgtccacaatgtcatcctcaacatcatcttcatcgctctcttccatcctcagcgccaaactgaggaaatgctgcaagtctccttccccatccctcacctgcctccgtcttgacacagccagctcccatatcggcgtctggcagaaacgggccggttcaaagtctgactccagctgggtcatgacggtggagctaggtcccgcaagctcctcccaagagactactagtaaagcttcacaagacgctattcttgctccgaccactgaagttgaaattggtggcagcagagaagaagtattggatgaggaagaaaaggttgctttgcaaatgatagaggagcttctcaatacaaactaaatcttatttgcttatatatatgtacctattttcattgctgatttacagccaaaataatcaattataccgtgtattttatagatgttttatattaaaaggttgttagatata

SEQ ID NO: 346 - DNA, 1201 bp, Oryza sativa
  CDS (201)..(283), (516)..(1161)
gtataggggtggcaggtagtttatattcactggaaaccgagaacttcactcctcccagcactccacactaggaggatgctcactgtctgactgactgactggctgctgctgctgctcattccttctcctactctgcctgcctcctctgctgtgtccttgggagaattcttcagggacagtatccctgcagaggtgagatcatgggacagtcgaagaagaagttccgcggagtcaggcagcgccactggggctcctgggtctccgagatcaggcaccctctcctgtaagtctctatctcactagtgatgatcactagctagctatgttgctctgatgtgttatgccactgtcgtgatagatacattttgatggatagctagtggttctggtttgttgttgctttctttctttttttctttctctttcatggtatgttagtagctaactcaaggtgcttgggtgcgtgcatgcatgaatgatggatgatgttttttttgctacgtgcgttgtggcagtaagaggagggtgtggctgggtacctttgagacggcggaggaggcggcgcgggcgtacgacgaggccgccatcctgatgagcggccgcaacgccaagaccaacttcccagtcgcgaggaacgccacgggggagctcacaccggcggctgcggtggcagggcgggatggccgtgtcggcggcggcagcggcagctcgtcctcaatgacggccaacggcggcgggaacagcctgtctcagatcctcagcgccaagctccgcaagtgctgcaagacgccgtcgccgtcgctcacctgcctccgccttgacccggagaagtcccacattggcgtctggcagaagcgcgccggcgcacgcgctgactccagctgggtcatgaccgtcgagctcaacaaggacacggccgtgtcgtcggctgcgacggtggcagcagcaacagcagtgtcgtccagcgaccagccgactccgagtgacagcacagtcacaacgacgtccacgtccaccacgggctcgccgtcgccaccacctccggcaatggacgacgaggagaggatcgcgctgcagatgatcgaggagctgctgggcaggagcggcccgggctcgccgtcacatgggctgctgcacggtggtgaaggtagcctcgtcatctgaattccggaagaacaggaaagaaattgaaaatgcaagg

SEQ ID NO: 347 - DNA, 2284 bp, Zea mays
  CDS (385)..(1722)
ggatctttcgctttccttaccccgttagcgttcctgcttgatacactacgactgcagattctttggcagaccgctaccaagtgcaagtgtgcaacgcacacacatcactcacagtctcacggtgtctctgtgcgcgcgcgtgggacacaggagggagagagacacagagaagggggcgggacgatcagctctagctcagctggtatcgtctaaactgcataaaaggggagggaaaaaaagttgcaatgatgcatcccggcgcatagatagagagagagagagaagagagagccccgactcgagagccaagaacgccgtgtgttgtgtttgtgtgcatctatctccgtacacgcacgctcgtacgcaccagctagcacgaccgccatggccgccaccaggagagccttcttccacagcgccgtcgacggcattgcgcgcgccgggccgggggaggccgagcggctgccggcgccgccgcaggtcgggcgaccggtggaaggcgccagcagcatggtcttgggcttccccgtgccgcggcccacgatgccggaccgccggccggccgccgtcacccagcagttctttccgcccactactacggccgcgcagcaggcgacgatggaggagcaatgccacgtgcccgccggtagcgcggcggagcagtgggtccggtcgtcggcgtccaggaagagccggcgcggcccgcggtcacggagctcgcagtaccgcggcgtcaccttctaccgccgcaccggccgctgggagtcccacatctgggactgtgggaaacaggtgtacttgggtggattcgacacggcgcaggccgctgcgagggcctacgaccaagccgcgatcaagttccgcggcctgaacgcggacatcaacttcaccctggacgactacaaggacgagatgaagaagatgaaggacttgagcaaggaggagttcgtgttggtgctccggcggcagggcgccggcttcgtcaggggcagctccaggttccggggagtcacccagcacaagtgcggcaagtgggaggccaggatcggccagctcatgggcaagaagtatgtgtacctgggcctgtatgacacagagacggaggctgcccaggcatatgacaaggctgccatcaagtgctacggcaaggaggcggtgaccaacttcgatgcccagagctacgacaaggagctccagtcgcagccctgggacggcgagctggatctcgagctcagtctgggctgcgccagcagcgatccgtccacggtcgccgtcgaggcgttcagccccgcgacgagcagcagtagccgcaagcagaggacgatgacgctgacgctcggtctgccggaggaggaggagacgggcgccggctaccctcaccctgctgccggcatgttcgggcgcccggctgatggccacgtccacgtagcaccgccgccacaccggcaatggcagcagcagcagcagggacagcacgcagctccagatgcggcgcctgagcgacgagcggcagagccagcagatcggcagcggtggggccggggcgcgcgctggcccatcgccagcgccagcggcattaactgggcctgggcgccgccgtacgccaccgcccgcgccggcaccgacgacgacgacgccagcagcgccgccgctgcagcatcatcaggattcccactgtggcagctgggtgcggcgtcgtccaggtccagctggcccagctgctgagcctttcctgtcgtcccgcgccaccaacagtgacgctgctgggccacgtactgacggcgactggtgacctgctggaaccgccgccggcctgtttcccttttctaggtaaaagcagtggcagaggggcgagctagcgacagcgtgcctcgtcatccatcgtccctgcgccgtggctggcggggtgggaaaaagtctgagcagttttgagcgtccggaggagctcgagatttcctccctcgaatagtcacttggggtggccactagttattatttctttccttccccctcgttgattctgctacccattatagcctctgtatctagctacatgcatgatgctgctctagcgctgttggacgttgatggcacggtgtacggatatggacagggttcgtgtgaccccatgtccactgctaggcctgtttccaaatggagtatttctgcagtaccatggcttatagaaatgccgagtattttaaaccattaggtgcttggttactttcccaaaaactaggttttcaaagctatggtataatgaataccacggtatatatttttc

SEQ ID NO: 348 - DNA, 1966 bp, Oryza sativa
  CDS (372)..(1082), (1176)..(1946)
agaaaaccttgtgtcccccccatgatgcagaaatctaataagagcagcccaacgcttccggttggtggcggtagaccggcctctttaaactaccccatccgccccagatttatcaattactcctcgtcatctcgtctcgtctccgccaccgtgcgcgcgtcccctatattagaccccccaaccgggcaccggacacaccatcaccaacacaccactgcaaacccatccgcctccgcaccgcatcgcacctacaaattgtgcacgctgcaccgctcaaaaaaaagaagaaactaaagtcgtacgtaggacgcggcgtgcgagcgttggtgcggtgcgcggcggcgcgcggggaagtagtgagagcatcgatcatgccgggggcggcggggtactccgggtcggtgaagctgaagtacgtgaagctggggtaccagtatctggtgaaccacttcctgacgctgctgctggtgccggtgatggcggcgacggcgctggagctggcgcggatggggcccggtgagctgctgtcgctgtggcggtcgctgcagctcgacctcgtccacatcctctgctcggtgttcctcgtcgtgttcgtcggcacggtgtacttcatgtcgcggccaaggccggtgtacctcgtcgactactcctgctacaagccgccgcccagctgccgggtgccgttcgccacgttcatggagcacacgcgcctcatcaccgacgacgagaagagcgtgcggttccagaccaggatcctcgagcggtcggggctcggggaggagacctgcctcccgccggccaaccactacatcccgcctaacccgtccatggaggcgtcgcgcgccgaggcccagctcgtaatcttctccgccatcgacgacctcgtccgccgcaccggactcaagcccaaggacatcgacatcctcgtcgtcaactgcagtctcttctccccgacaccgtcgctctccgccatgatcatcaacaagtacaagctccgcagcaacatccgcagcttcaacctgtccggcatgggctgcagcgccggcctcatctccctcgacctcgcccgcgacatgctccaggtaagtactagccagctctttgatgttactactgtttagctaactaactaatcaggtgagccattaacgagcgacatggacggacacgcgcaggtgcatcccaactcgaacgcgctggtggtgtcgacggagatcatcacaccaaacttctactggggaacccggcgggacatgatgctgcccaactgcctgttccggatgggcgcggcggcgatcctgctgtcgaacaggaggagggaggcgaggagggccaagtacaggctgatgcacgtggtccgcacgcacaagggcgccgacgaccgcgcgtaccggtgcgtgtacgaggaggaggacgagcaggggcactcggggatctcgctgtccaaggagctgatggccatcgccggcgacgcgctcaagtcgaacatcaccaccatcggcccgctggtgctgcccatgtcggagcagctgctcttcttcttccgcctcgtcggccgcaagctcatcaacaagaagtggaagccgtacatcccggacttcaagctggcgttcgagcacttctgcatccacgccgggggacgcgccgtgatcgacgagctgcagaagaacctggacctgtccgcgcagcacgtggaggcgtcccgcatgacgctgcaccggttcggcaacacgtcgagcagctcgctctggtacgagctcgcctacatcgaggccaaggggcgcatgcgccgcggcgaccgcgtctggcagatcggcttcggcagcggattcaagtgcaacagcgccgtctggaagtgcctccgcacagtcaagacgcccgccgacgggccgtgggacgactgcatccaccgctaccccgtcgacatcccggaggtcgtcaagctgtgatcgaatccatggtagcc

SEQ ID NO: 349 - DNA, 961 bp, Zea mays
  CDS (41)..(679)
gccccagcagagctcatctctgcctcctgtgtccttctccatgacagagaatctccactccaggaaaatggtacagccaaagaagtttcgtggagtccggcagcgccactggggctcctgggtctctgagatcaggcatcccctccttaagaggagggtctggctgggtacctttgagacggctgaggaggcagcgagagcatatgatgaggctgctgtgctgatgagcggacgcaacgccaagaccaacttcccaatccaaagaagcagcacaggggagcctaccccagctgcgggaagggacgcccgcagcaacttcagcagcggctcctctaccaccaacctgtcccagattctcagtgcgaagctccgcaaatgctgcaaggcgccatcaccgtccctgacctgtctccgccttgaccctgagaagtcccacattggtgtttggcagaagcgtgcaggagcccgtgctgactccaactgggtcatgacagtggagctcaacaaagatgcagcatccactgatgctgcatcacagtccacatcagcaacaactgctccaccagccacgccgatggatgaggaggagaggatcgcactgcaaatgatcgaagagttgctgagcagcagcagcccagcttcaccctcaaacggagatgaccaaggtcgcttcatcatctgaaaagcatggatcaaacagcacaagtcaccatcccagatcagagtttcgctaggtcggttggtacacaagcagttcaggttgcttcagtaatatagatatatgtctattactaaatccaacttacaagaactataaagtttgcaattgtgtgcagttctatgtacgtgaaaagctctacatacacatgttcctatcaagatactttgttacacatcaatgtcagtgatataattgcttataaaagaaataaatagattatgattgtgttactgctaaaaa

SEQ ID NO: 350 - DNA, 2864 bp, Zea mays
  CDS (441)..(2390)
ccacgcgtccgcccacgcgtccgcccacgcgtccggtctttggtcccggagggaaaaggacaaatcactcacacagagggaacaaaagggcacaggaatcgcgacagcgtgggaggcgtacggcgcaccgcccggccgccggatctgcgccggcgacgcgcccggacgtcggatctacgccgccgcaggaggagggaggcggcgctctggccgttccttgcccgcgagcgcccagatccgtcccgccgccggatatatatatcaatcaatgcccctgtgatatcgagcttcagttgatgcagtggtgaaaacatcttctcgaaaaactgctggctgcaagttgcaaaagtttgtctttcccttgttgtgttgttgcttccttctctggtggagtacacgggagaagtttgcagatacaggcagctcctttcaaatctcctatgtccagggatttggactgtcctgttcagacacagatggctgtggcagtcctggaccggagctttagcagcgaatatcctggaggtagcagaattgaggggaggcaactgagctggaagagagtatttgtccaaactgacaatggttctgtccttggcatcgagctggagagaggagaaaacgtacaaactgtgaaaaagaagctccagatagccctcaatgtgcccactgatgagagctcattgacctttggtgacctagttctgaataatgatcttagcagcattcgcaatgactcacccttgtttctcaaaaggaatcagattcaccggagcaattccacaccttgcctctcacctacaggtaagaatgttttgcaaagagaccggagtggacccattgaaatccttggctgttcaagtccttcatctcggatgaagcagcttgctaaggatgtcattaaagccataatgaatgatgttgacccagtcgctgttaacagtgggatgggtggtgcctactacttcaagaacatttggggagagcgtgtggcaattgtcaagccaactgatgaggaaccatttgctccaaataatccaaaaggttttgtggggaaagctctgggacagccgggcctgaaaaggtctgtacgggttggggagacaggcttcagagaggttgctgcttacctcctcgactatggtcactttgcaaatgttcctcccaccatgctggtcaagataacacacacaatcttcaatgtgaacgactgtgttggctgcaaaagtaaagtgttctgcaacaaatcagaggctgtgagcaagattgcatcgctgcaggagttcattcctcatgatttcgatgccagtgaccatgggacctcaagcttccctgtatctgcagtgcataggattggcatccttgacattagaatcttcaacactgacaggcatgctggaaatcttctggtcaagaagcttggtcctggcgccgacaattttggagagcagacagaactcattcctattgaccatggtctctgtcttccagaatgcctagaagacccatacttcgagtggatccactggccgcaggcatctgttcctttctccgaggaggagcttgagtacattgcaagacttgatcctgtaaaagatgcagaaatgctacgcatggagctacccatgatacgagacgcatgtctcagggtgctggtgctatcaacagtatttctcaaggaagctgcagcgtctggcctctgcctctcggagattggagacatgatgagcaggcagttcactgcgaaggaggaggaaccgagtcagcttgagctgctctgcatggaggcaaggaagtgggttgaggaaagagagtcctttcttcccaacgaagccggagttgaagatgacgatgatgacttcacccagttccttatcgacggcgaggatgattatccggatgccttggaaccatcagctttctgcaagtttggtagcatgaaggcaagttctaggaatccactgtccaagctagatgagcgtgacgaggaagacggagacgggaccgaggaggacgacgacgacgacatcttgaccggtgcattgcctcagaggatctcgtctatctccaagctgtcgtcatccatgaaggggcttggcttcattgggaaacccaagccctaccgcacgtgccttcggaagggtaaagcgacaggcagaactaagtacaccggcaaagccagcgagcatcagtccggcagcaggagcgccaacgagctgctcccgcccagcgccagtttcgtgaagctgtcggacatgagccctaaacagtggagcgcattcctcgacaagttccaggagctgctcccaggtgccctgagcgcccggaagcacgctgccggtgtcgtcggccagcgctcgatgccgaggctgggcacgtcttgccagttttgagagtagcagaagagaagccaccgaacccaaggtatgacgaacgcgcttctgttcgagctctggtgtgcagcagccaagcaggtacggagtattatatatgcttgtagtaggtgtctggagccggtggtggtagagagggtccgagaataagatcatccatggcatgtgagatgaggttgcgggagaaggaagggggttgtgtgtgtttgtgcatagtgtttcgcataagaggtccgttgttctttttttcttcttctctgtatatagttaagtactcctactgctactgcatcgcagcaccgggcacgggctgggatctcggccgttgttatctgaacgatggtggtgagtgtgctggcgtcgcctgctctctgctctgtctttgccgctgtaccattttggaggcgcttaccatattatgaactttgaactatgatatgatgttcgctaaaaaaaaaaaaaaaaaaaaag

SEQ ID NO: 351 - DNA, 2363 bp, Zea mays
  CDS (253)..(2115)
cccacgcgtccgcgccaggcgcagatggaatgagcgaccgggctctgctccgccgctagcctgccgccgcaccgcgccgtcgatcgccgcgccatgaacggtccccgcggctaccccctttctccaccggcaccttacccccgtatggcgtgatccaatgatagcaccaagagcgcaccttcccctctccctgacggcgtcgtcctccccgcacggcggcgcgcgcacccgcaccaagaagaggaagaaaccatgtcccccaacctggacagcgccatcaagagccaggtgccggcgctgctcctgaggcgtctcttcggcgcgtcccggcgggacgaggccaagcagctccagcggaccccggcgccggtggggaggcggagggtgttcgtgcagacggagaccggctgcgtgctcggcatggacctggaccgcggggacaacgcgcacaccgtcaagcgccggctgcagctcgcgttcaacatgcccaccggcgggacctcgctcaccttcggcgatcgcgtcctggagaacgacctctccttcttacgcccggactcgccgctactgctcacccggaacagcatcaaccggagctgctccaccccgtgcctctgccccgtctccaaggacttcgagcacaaggactgcagcggactggttgagatgctcggctgctccagcagctgtgcccgggtgaagcgcctcgtggacgacgtggtgactgccatcaggagcggcgtggatccggtccccattagcagcggccttggtggctcgtactacttcaggaacgtcttgggcgacagggttgctattgtgaagccgacggacgaggagccctttgcgccaaacaatcccaaggggttcgtcgggagggcgctcggtcagccgggcctcaagagatctgtgcgagtgggagagacggggtttagggaggttgcggcgttcctgttggaccatgacaacttcgccaacgttcctgccacggctctggtgaagataacacactccattttcaacataaactgcccggtaaatggaggaaacctggcaccggctcatgaccagcaacagcaagttaacagcaagattgcttcgttccagcagttcatagcccatgacttcgacgccagcgaccatggcacgtcaagcttccctgtcgctgctgttcataggatcggcatactagatatccggattttcaacactgacaggcacgccggcaatgtgctggtgaggaagcttaacggtggcacaggccgctttggttgccagacagagctgttcccaattgatcatggcatgtgcttgccggagaacttggaggacccttacttcgagtggatccattgggctcaggcttctattccgttctctgaggaagagctcgagtacatcagaaatcttgatccaaggaaagatgtgcagatgctgcgccgggaacttccgatgatacgtgaggcctgcctacatgtactggccctgtgcacaatcttccttaaggaggctgcagctttcggactctgcttggccgagataggcgagatgatgaccagggagttcagagggatggaggaggaaccaagccagctggagcttatgtgtatggaggccaggaagagagtagcagagtgggagcccttctctgccacagctgaacatggagaagataccgatttccagttctcggtggatatgctaggagaatacagtgatgtagtgcgatcaccaaggttcaatggctcaggttccaaagtgtccagtttcagaagccctttgtctaagctcgtcgagagcgtcgacgagggcagtgatggccatgaagatcaaaacgagtctgatcgagtcttgtatgctggatggaatacatctagcgttcctagcaaagctatgggccatagtggcaatgcctcaaaaagtgcaatgaacaggagtgccgatgaacaacttccatcaagtatgtgttttgtcaggctgtcggatatgagtgcagatgagtgggatgtattcctcgaaaaattccaggagctgctgaaagagacactgcacgagagcgcaagggcagcagcaggtcaaaggatgaagcagcggctaggcacttcatgcaagttttgagcagggcaatagcgcatcagagaagaaaaaatatgcagtgctacttgtattgcttgcttatggagtgagtacaggatgaagatatcatcgtatgcggcaccttcaaccttgtgcaacgatctaggttgcagcagccatgtccagcaggtagataggaccacaagcatatgtagtgacggtgtggagaactgctacgcgtgtttattagctatatgtttacgaaggggaatgcttaataataaaaa

SEQ ID NO: 352 - DNA, 1602 bp, Zea mays
  CDS (55)..(1470)
ccacgcgtccgctcctcctaactacgcctgcctgtttcctcccccgcaggattgatgagctcggcgagggtgagaggccccttcacgccgccgcagtggatcgagctggagcaccaggccctgatctacaagtacctgtccgcgaacagccccgtacctcacagcctcctcgtccccatcaggaggagcgggagcctcgcatcgtctccctacccgcctccctacttcggcacgagcacattcgggtggggctccttccagctgggctactccggcaatgcggatctggagcctgggcggtgccgccggacggacggcaagaagtggcggtgctccagggacgcggtcgccgaccagaagtactgcgagcgacacatgaaccggggacgccatcgttcaagaaagcatgtggaagaccagcctggccatgccgcgaaagccatgtccgcggtggccgtggcggctgctgctgctgctgctacccagcatgctgctgctctggccggcgccggagctactgctgctgctggcctcgctgtcaatcggcaccggcagccggggaagagctatgccacgggtgcgactgatccatgctctctgcaatatagcagggaactggcgaacaaactgtcgaacgagagcgaaaacatgcaggactctgacaatgtctcgatgctgacttccatgaacacaggaaacactgcaggcagcgtgtttccgttctcgaaacagaacactgctcttttcgaagtgagcagctcaaggccagagtttggtcttgttccatcggattcactgacgagttcacctcatagttccttgaagagtgtcaaaaatctgctcagctcacggagtctgagtgagcaccagagctccgcctccctgcaacactttgtggactggcccaggacgccacctgcccagggaggtctttcatggcccgaggcagaggacatgcccagagctcagaggtcccagctctcagtatccgctccaatggcatcctccgagctatcatcggcctccacatctcccatccacgaccacgagaagctgattctgtcacctctcaagctgggccgcgagtataccccatctggcgtcgtcagcgctgcagcgaacagatacgaggttagccagctagaagcgacctgggcgacgatgttccgcgactcttcgacgggcggcccgttgggggaggttctggccaagaacaacagcaacgcggaagcaagaggttgcccgtcggcggcgccacctctaaccgactactactgctgggattcaggccacggcatgcagtcgtcccccgtgggagttctgcagaggacgaccgccttcggatcggtctccagcagcacgggcagcagccctagggtcgagaaccacggcgcctgctgcgatggtaccagcaacctgatggatgatctcggttcagttgtagtgagacatcccagcatccgcctcttgtgagcccgctgggttctggccatggaaaaagcgtgagggggagcatttaccacgtagtttgtcatttgagactgatctcctgtttctgtcacctgagttcttcttttgttgcccttaaaaaaaaaaaaaaag

SEQ ID NO: 353 - DNA, 1891 bp, Oryza sativa
  CDS (193)..(1380)
ttacaaaaccccagccaccgagagctctcccgctccactcgccgcacaccaccaccctcacccctccccccatccgcgtgatctcccgagcagctagagcgcgcgcccgcggcgcctgtactgcgagaccgcttcgctcgcttccggtcggtgaagaggcggtcggtcgcagctgaagtagttgttgcagagatgatgatgatgagcggtcgcccgagcggcggcgccggcggaggtcggtacccgttcacggcgtcgcagtggcaggagctggagcaccaggcgctcatctacaagtacatggcgtccgggactcccatcccctccgacctcatcctccccctccgccgcagcttcctcctcgactccgccctcgccacctccccttccctcgccttccctccccaaccttcactggggtggggttgctttggcatggggtttgggcggaaggcggaggacccggagccagggcgatgccggcgtacggacggcaagaagtggcggtgctccaaggaggcgtacccggactccaagtactgcgagaagcacatgcaccgtggcaagaaccgttcaagaaagcctgtggaaatgtccttggccacgccgccgccgccgtcctcctccgccacctccgccgcgtcgaactcctccgccggcgtcgcccccaccaccaccaccacctcctccccggcgccctcctacagccgcccggcgccgcacgacgcggcgccgtaccaggcgctctacggcgggccctacgccgcggccaccgcgcgcacccccgccgccgcggcgtaccacgcgcaggtgagcccgttccacctccacatcgacaccacccacccgcacccgccgccgtcctactactccatggaccacaaggagtacgcgtacgggcacgccaccaaggaggtgcacggcgagcacgccttcttctccgatggcaccgagagggagcaccaccacgccgccgccgggcacggccagtggcagttcaagcagctcggcatggagcccaagcagagcaccacgcctctcttcccgggcgccggctacggccacaccgcggcgtcgccgtacgccattgatctttcaaaagaggacgacgatgagaaagagaggcggcaacagcagcagcagcagcagcagcactgcttcctcctgggcgccgacctccgtctggagaagccggcgggccacgaccacgcggcggcggcgcagaaacctctccgccacttcttcgacgagtggccgcatgagaagaacagcaagggctcctggatggggctcgaaggcgagacgcagctgtccatgtccatccccatggccgccaacgacctcccgatcaccaccacctcccgctaccacaatgatgaataatctcttgaagaagccaagaagtgatcaacacgcggaagaaatcaacagcttctttcacggcgtgcgagctgcatgctcatgctccaggatcgatcgatcgatcattgcatctccaaactaatcacgcttcgatctttcaggacttcatcaatgacaggccgaaacctcctacgagttctctgatgatattcttattttttttcccacttcttttcgttgagctttttgtaatgttgcttcgagtgttactcctacattttctccgaaatggcctcagaatgatgcggtcgggctgattaattaggttagactcttcctgaaccaactaggaatagattttctgcctggttcctgtcagtccttgtaatatctgcagcagcttgtgagccaagcgtgttcgcttttgtgaacgccctttttcttctttccgattcctctgcctgtgatagtactcgctccgcgaaaaaaaaaaagagcaaaccgtggattcttgtgtcaaaaaaaaaaa

SEQ ID NO: 354 - DNA, 1505 bp, Zea mays
  CDS (96)..(1202)
atcacctccgccgctctccaccatgaatcccatccaccagcacggcatcgtacccaatccttcgtgactgttgcctccgcgcatctccgggagcaatggaaggaggccgagatgtgttcttaggtgcggcggcaagggcgccgccgccgccgccgtcttgcccgtttcacggatccgctaccgccacccgctccggtggagcgcagatgctcagcttctcctccaatggcgtagcagggttgggtctgtgctcaggtgccagcaagatgcagggtgtgttgtcgagggtgaggaggcccttcactccgacgcagtggatggagctggagcaccaggccctgatctacaagcacttcgctgtgaatgcccctgtgccgtccagcttgctcctccctatcaaaagaagcctcaatccatggagcagccttggctccagctcattgggatgggcaccatttcgttccggctctgctgatgcagaaccaggaagatgccgccgcacagatggcaagaagtggcggtgctctagagatgctgtcggggaccaaaaatactgtgagcgacacataaaacgtggttgccaccgttcaagaaagcatgtggaaggccgaaaggcaacaccgaccactgcagatccaaccatggctgtttctggtggttcattgttgcacagccatgctgttgcttggcagcagcagggcaaaagctcagctgctaatgtgactgatccattctcactagggtccaacaggaatttgctggataagcagaatctaggtgaccagttctctgtatccacttccatggactcctttgacttctcatcatcacattcttccccaaaccaagccaaagttgcattttcaccggtggccatgcagcacgaacatgatcagctgtatcttgtgcatggagccggcagctcagcagaaaacgttaacaagtctcaggatggtcagctgctagtctcgagggaaacaattgacgacggacctctgggcgaggtgttcaagggcaagagttgccagtcagcatccgcagacatcttaactgaccattggacttcgactcgtgacttgcgtcctccaaccggagtcctacaaatgtctagcagcaacacagtgccagcagagaatcacacgagtaacagtagctatctcatggcgaggatggcgaattctcagaccgtcccaacactccactgagtgttcatcaggctggtctttgttgggaccacaaaataactgaagccatgttgatgtcctgagtttgctgatactaggttttcagtcgagtcttgtaactcctgttttagagctgttatatgttcacgtcatgtcgcctttcattttcggttcattcagatgggtgttctaataatttctttccttcttacctgtgaaggatttgagttccaatctgagacgtgggtttgttctaacttggaggtatttatgaatattaggcacttctgatttccattgaagcgagatttctttaaaaaa

SEQ ID NO: 355 - DNA, 900 bp, Nostoc PCC7120
  CDS (49)..(843)
gtttgcaacgtttagtttaatatcgcagtatgtttcaaccgcagggaaatgagtagtactttatatcgaaggcaactactgaaattattgggtatgagtgtcttgggaacctcattttctagttgtgtcacatctccagctagggcaaaaacggtaaactggggatatatcggcaaagtaggcccagagcattggggtgagctttcccctgactttgccctttgccaaataggcagaaaacaaacgccgattgatttgcagattgcagatgtgaaagatgtccacagcagcagtcaagatttgttagttaccaattatcagccaacggcattacacctaatcaacaacggtaaaacagtccaagtcaactatcaaccaggcagttatctcaagtatgctcaccaaaaatttgagctgcttcagtttcactttcatcacttcagcgaacatcgggttgatgggaaattatatgatatggaactccatttagttcaccggagtaaatctggcgacttagccgttatgggtattttcttgcaagcaggagcatttaacccgacgctgcaaattatctgggatgccacacctcaaaaccaaggaacagacaaaagaatagaggatataaatatagacgcttcccaatttctcccagcacaacacagattttttacttattctggctctctgacaaccccaccctgttcagaaaatgttctctggtgcgtaatggcgacacctatcgaagcctctcctgcacagatagctaagtttagtcaaatgtttccccaaaacgcacgtccagtgcaacctctcaacgatcgcctagttatcgaagccatttaaaatttttctgtcaacttccccggattttgtgttgctatgtcatactaagagatgaga

SEQ ID NO: 356 - DNA, 2025 bp, Chlamydomonas reinhardtii
  CDS (156)..(1232)
cataacttcaaagcctaaacgtctattcctcgtgccaaggcactttctccggaagcgcacccacctctccgcgccgctcgccttcacgcgtgctctcagctcaacaccactgtaactcaggccttgacgggcttgttttatcaaaaccagcaagaatgtcatccgacgctatgactatcaacgagtcgctgatggaggtggagcacactcccgccgtccacaagcgcattctggatatcctgcccggcatttcaggcggtgtggcccgtgtcatgatcggccagccctttgacaccatcaaggtgcggctgcaagtgctgggtcagggcactgccctggcggccaagctgcctccgtcggaggtgtacaaggactcgatggactgcatccgcaagatggtcaagagcgagggcccgctgtccttctacaagggcaccgtcgcgcccctggtcggcaacatggtcctgctgggcatccacttccccgtcttctcggccgtgcgaaagcagctggagggtgatgaccactactccaacttctcccacgccaacgtcctgctgtcgggcgcggctgccggtgccgccggttctctgatctctgcccccgtggagctggtccgcaccaagatgcagatgcagcgccgcgccgctctggctggcacggtggccgcaggcgccgccgcctcggctggcgccgaggagttctacaagggctcgctggactgcttcaagcaggtcatgtccaagcacggcatcaagggcctgtaccgtggtttcacctccaccatcctgcgtgacatgcagggctacgcctggttcttcctgggctacgaggccactgtcaaccacttcctgcagaacgccggccccggtgtgcacaccaaggccgacctcaactacctgcaggtcatggccgccggcgtggtggcgggcttcggcctgtggggctccatgttccccatcgacaccatcaagtccaagctgcaggccgactccttcgccaagccccagtactcgtccacgatggactgcctcaagaaggtgctggcgagcgagggccaggcgggtctgtggcgcggcttctccgccgccatgtaccgtgccatccccgtcaacgccggcatcttcctggcggtggagggcacgcgccagggcatcaagtggtacgaggagaacgtggagcacatctacggcggcgtgatcggccccgccacgcccaccgccgcgcagtaaatgtggccgcggctgcggctacgtgcttgagcgcccgcgtgtgctctatctagctgctgcaacagctgctgttgcgcacgcggcgcaaggcgcaacctcctggcatgacaacatggctcaaaaggtgtcacgtgtgtgtgtgtgtgtgtatgtttgtgtgtgcgtgtggagagtctggcataggtagatgtggtcgttagctttctgcttcgttccccatcgtgaggcgcatacatgcggcaacaagccagtggatgcactctgggcagaacgtgcgtgtgtgctcgtttttcctagcttagtggtggcagcagcggcaacagaaagaggtaggcagaagcaggagcggtcgagggaacaggacagctgctgaatacaaaggcgtcagacctgaacgtaattttgtgcgggcaccataccccgcttacggtccaagggcatgatgcctttttgatgcacacatcacccctccccgcgcatgtatgttaaatgatgattttgactgctgtttttgagagcggaacaaggggaactgcagtactggctcggacatgagaggagaggccggcgagagaggctcatgacaaaaagtggaatgggcttgcagatgtatatagcagggcaaactggcaaaaggagcgatacctttcgtaagcacagggctgaggtgcatggtcgtggaaggtcacgggagttgagccgctacaccggctgtcagtgctggtctgtttctccatcgggaaacgcgggtcaatatgtaatcgtgatgggtttcaaaaaaaaaaaaaaaaaa

SEQ ID NO: 357 - DNA, 1801 bp, Synechococcus sp. PCC 7942
  CDS (271)..(1674)
ctggtgcaagccctcgcgactgcgttacctgctggtgcagaggtctttctgcaatccgatgtgctggaagtgcaggcagagatgtgcgaacactttgcggcggaaccccgctttcagcgcacctgcttggactggctgccggaaaatccgctgcccgtcccgaccgagcgcgaaattgccgttcaaaacaaacagttgccagtctaccgtgctctcttcattcggcagccagcggactaagctcttaaggcaagcgttgacgcgatcgcgatgactgtctggcaaactctgacttttgcccattaccaaccccaacagtggggccacagcagtttcttgcatcggctgtttggcagcctgcgagcttggcgggcctccagccagctgttggtttggtctgaggcactgggtggcttcttgcttgctgtcgtctacggttcggctccgtttgtgcccagttccgccctagggttggggctagccgcgatcgcggcctattgggccctgctctcgctgacagatatcgatctgcggcaagcaacccccattcactggctggtgctgctctactggggcgtcgatgccctagcaacgggactctcacccgtacgcgctgcagctttagttgggctagccaaactgacgctctacctgttggtttttgccctagcggctcgggttctccgcaatccccgtctgcgatcgctgctgttctcggtcgtcgtgatcacatcgctttttgtcagtgtctacggcctcaaccaatggatctacggcgttgaagagctggcgacttgggtggatcgcaactcggttgccgacttcacctcacgggtttacagctatctgggcaaccccaacctgctggctgcttatctggtgccgacgactgccttttctgcagcagcgatcggggtgtggcgcggctggctccccaagctgctggcgatcgctgcgacaggtgcgagcagcttatgtctgatcctcacctacagtcgcggtggctggctgggttttgtcgccatgatttttgtctgggcgttattagggctctactggtttcaaccccgtctacccgcaccctggcgacgctggctattcccagtcgtattgggtggactagtcgcggtgctcttggtggcggtgcttggacttgagccgttgcgcgtgcgcgtgttgagcatctttgtggggcgtgaagacagcagcaacaacttccggatcaatgtctggctggcggtgctgcagatgattcaagatcggccttggctgggcatcggccccggcaataccgcctttaacctggtttatcccctctatcaacaggcgcgctttacggcgttgagcgcctactccgtcccgctggaagtcgcggttgagggcggactactgggcttgacggccttcgcttggctgctgctggtcacggcggtgacggcggtgcggcaggtgagccgactgcggcgcgatcgcaatccccaagccttttggttgatggctagcttggccggtttggcaggaatgctgggtcacggtctgtttgataccgtgctctatcgaccggaagccagtacgctctggtggctctgtattggagcgatcgcgagtttctggcagccccaaccttccaagcaactccctccagaagccgagcattcagacgaaaaaatgtagcgggctccccaacaaattcctgtgcacccgactggatccaccacctaaactggatcccaaaggtatccggtggatctagggtcataacgaactccgaccgcgatcgcgtccgcgaactgaacctcca

SEQ ID NO: 358 - DNA, 1383 bp, Chlamydomonas reinhardtii
  CDS (62)..(994)
cttttgtagacccacttgtcagtgggcactgcccctagaagcggcttcttgaccagagaagatgcgctcagccgttctacaacgcggccaggcgcggcgagtgtcttgccgggttcgggcggatggttcgggcgtggattcgctgccctcgaccagcgccagcagcagcgcacgccctctcattgatcgccgtcagctcctgaccggtgctgctgcgtcggtcataaccttcgttggctgcccttgccccctgtgcaagcctggggaggcaaaggccgcagcttggaactatggcgaagttgcgggtccgccaacctggaagggtgtgtgtgcgacgggcaagcgccagtcgcccatcaacatcccgttgaacacatcggcgccgaaggtcgacgcggagatgggcgaattcgatttcgcctacggcagcttcgagaagtgcgacgtgctgaacacgggacacggcaccatgcaggtgaacttccccgctggcaacctggcgttcattggcaacatggagctggagctgctgcagttccacttccacgcgccctcggagcacgccatggatggccgccgttacgccatggaggcgcatctggtgcacaagaataaaagcaccggcaacctagctgtgctgggcattatgctggagcccggcggcctgatcaagaacccggcgctgtccactgctctggaggtggcgcccgaggtgcccctggccaagaagccctcgcccaagggcatcaaccccgtcatgctgctgcccaagaagagcaaggccgggacacggccgttcgtgcactaccctggctcgcttaccacgcccccgtgttcggagggggtggactggtttgtgttcatgcagcccatcaaggtgcccgacagccagatcctggacttcatgcgcttcgtgggcgacaacaagacatacgccaccaacacgcggccactgcagctgctcaacagccgcctggtcgaatacgagctgtgagcggacacgagtgtgctagggtcagtgagcagcgtgtgaacatgaagattacaagtttgctgacagagagcgggcggagtgcccatgcatcgcatcgtaacagcccgcgaagtacgacttaacatgacataaaagtgcaatgcgcatattgactggtttggcccacggtggggaaggcgtacgcgcggttccatcaagcagcctttggggaggcatcgccttgcacgcacttgccgtatgtaggcgtgctggtgaatgaggtatggggcgagagacccgcgaactaaacttaagtagattacccatgtatcctttatttggcttgcgtgccctctcaattggggcaccgatgcaggggctggaaggccccgtgtaacacatgacactca

SEQ ID NO: 359 - DNA, 2345 bp, Zea mays
  CDS (113)..(1906)
gcagagcagcgcaggcgccctgcacctccactctgcagctctgctccccctccctctctcccgctcctcctccttttccttctccagctcggccgcctcagcccgcgccgcgatgtcagaggaggacgaggaccagccgccggccaagcgacccagcccgtcgccgcccgcggaccaggtgctcgacaacgtgctcgagacggtgctccagttcctggacgccccgcgggacaggagcgccgcctccctcgtctgccgctcctggcacagcgccgagtccgccacccgcgagtccgtcgccgtccgcaacctcctcgccgtgtcggccacccgcaccgcgcgccgcttccccaacgcgcggagcctcctcctcaagggccgcccgcgcttcgccgacttcaacctcctcccgcacggatgggacgcctccgccttccgcccctgggccgccgccgtcgccgccggggccttccccgcgctcacctcgctctacctcaagcgcatccccgtcaccgacgccgacctggacctcctctcccgctccctcccggcgtcattccgtgacctcaccctgcacctttgcgacggcttcacctcgcgcgggctcgcgtccatcgcctcccattgcaggggcctgcgagtgctcgacgtggtggagtgcgacatggccgaggagcaggaggttgtggactgggtggccgcgtttccgcaggagccctctaacctcgagtcgctctccttcgagtgttacgagccgcctgtggccttcgcggcgctcgaggcgctcgtggagcggtccccgcgcctcagacgcctgggggtcaatctgcacgtctcgctcggccagctgtgccgcctcatggcgcacgcgccgcgcttgtcgcacctgggcaccgggtcgttccggccggcggatggcggcgaggaggggacaggattcggggaggttgtctctgcattcgtggccgctgggcgagcgcgcacgcttgtttccctctccggcttccgtgacctcgcgcaagagtacctgccgaccatcgccgtggtgtgcgcccacttgaagagccttgacttaagctactccgcggtcaccccgaatcagattctgatgttcattgggcaatgctacaaccttgagacactatgggtacttgactcggtgcgcgacgaagggctcgacgccgtgggaatttcctgcaagaagctccagtctcttcgtgtgctcccgttgaatgcacatgaggacgccgacgagttggtgtcagaggttggccttaccgccatctcacggggctgccctgctctccgttcgatactatatttttgccagaccatgaccaacgctgctgttgtggacatgtcgcggaactgcccggagctgaaggtattccggttatgtataatgggacggcaccagccggaccatgcgactggggagcctatggatgaaggattcggtgccatcgttcagaattgcagcaagcttaccaggctatccacgtccgggcaacttactgatcgggcatttgagtacattggcaggcatggcaagtccctgcggacgctctccgtagcatttgctggaaacagtgatgtggcgctgcaatacatcctccagggctgtccaaagctagagaagcttgagataagggactgccctttcggtgacgctggcctcttcgccgggatgcaccatttctacaacatgcggttcgtctggatgtcaggctgcaacctgaccctgcaagggtgcaaggaggtggctcaggtgctgccacggatggtggtggagttgataaatggccagtctgatgagaacgaaaggaatgaaagcgtggacatcttatacatgtatcggtcactcgatggtccaagggaggatgttccaccgttcgtgaagatcctgtgaagctgcgcttctgcggagatggctgggtatcgctatcagtgtagtattcaggctgctgcacttgatatgctggctgagtgcagatcatttaacggaatatatatgtaagttgttgagctgcagatgtggtacatttttatctcttagaaagatttcgaagcactgtactggagcggggcgggcgggggtatcatgtagtaggagttcatcagatgtggtacatttttatctagtaggagttcatcagtgtatccaaagcgttcacggcaggaggactaagtgcagcagagcaggcttcttcgagggggcctcatggctgcctcagttttgtttgctgctctggagggggctctggtttgaggaccatattttctgtgccggtgcaaccaccatgttttccttcaaattttcgaaatgaaacctgtcatatcagact

SEQ ID NO: 360 - DNA, 2082 bp, Glycine max
  CDS (123)..(1304)
attcggctcgaggtagtagagcactgaattggatatgtgtctatcacctaatctaagtcatcgtgtggtggtggttttggtcggtggcaaagagagaagaaacaaagcctgttcttcttaccatgtcggatcatcttccgcgcgaagtgctaaccgaaatcctctcccggttaccggtcagatccctactgagattccggtcaacgtccaagtcatggaagtccttaatcgacagccagcacttgaactggcttcatctgactagatccctgaccttagcctccaacacgagcctcatcctccgtgtggactccgatctataccagaccaatttcccaaccctagaccctcccgtatcccttaaccaccctctcatgtgctacagcaacagcataaccctcctcggttcctgcaacggccttctctgtatatccaacgtcgccgacgacatcgccttttggaacccctccctccgccaacaccgtattcttccttacctccctgtcccccgccgccgtcaccccgacacgacgctctttgccgcccgcgtctgcggcttcggcttcgaccataaaactcgcgactacaagctcgtccgcatctcttatttcgtcgaccttcatgaccgctccttcgactcccaggtcaagctctacacgctccgcgccaacgcctggaagacacttcccagcttgccctacgcgctctgctgcgcccgtaccatgggcgtcttcgtcggaaactccctccactgggtcgtcacgcgcaaactcgaacccgaccaacccgatctcatcatcgccttcgatctcacccacgacatcttccgcgagctcccgcttcctgacaccggaggtgtcgacggcgggttcgagatcgacctggcgctgttaggtggttccctctgcatgaccgtgaactttcacaaaacgagaatcgacgtttgggtgatgagggagtataaccgtagagacagttggtgtaaggtgttcacgctcgaggagtcgcgtgagatgagatcgttgaaatgcgtgaggccgttgggctactcgagcgatgggaacaaggttctgttggaacacgacaggaagaggctgttttggtatgacctggaaaagaaagaggttgcccttgttaaaattcagggtttgcctaatttaaatgaagccatgatttgtttgggaaccctcgtaccaccatacttcttacctcgtcaaatttgtaggaagccgcgtgctttaggatgcgaacgtcccaggaagacgagggatgacttcctgtcgcagggtttcaaattgacattatgaggaagtctaagaagaagaagcaatggtacatgggggtagctgaaactggctcggcgggtttgttttgcagttgattcaagccaaagggaggttgaggaaaagtaagaaaatgttgcttccgttacaatgactgtaatgtatagttaaattaatactatcagctacatattttactttgggatgtgtgccacgtttgacgaactctgaaacaaacatgctcttattggttacttgctgagttatctgactctgatgatgaaattcgtggccctggttcacaggacgagttaaattgatcaagagcaggaacagagacaccgttttgcctgttaagatataagactctttccttgtacagtttttgcaccttttgttttcttagcgatttaggggcgaacaaagccccccaccaaagtgaaagaaagggctgcagacctgccattcagaatgttgaagaaggaaacaatgactgaagaacagataccaaatatacaaatgctgctttcctcacttattaacagtctccaattactaagatcccgtaagacactcgctttccgcaatagaaaaaaaatggcctatatggttttgtctaagcttggattgcctcagtggtttggttgtaaagaagtgtcatgtatgtacgtgtgttaatctggttgtaccagcaaactgtaattaaatttttgcagttaacttgacatgaaatattgttgtttttgtttattggtaggtggactttgcaaattgaaaaaaaaaaaaaaaaaaaaaaagg

SEQ ID NO: 361 - DNA, 2101 bp, Glycine max
  CDS (228)..(1916)
acagagcgcagaaaataaaataggtgaaatgaatatcgatttcaattccgccactgaatttcgaaaccaaaaaaccattccaacgaagaagatgaacctcgaagaagagggttagttacttctgagtgagtgagtgagttagtggttcctctgaggaacggtgaggaccttcaatttctcaagttctcaaccgttcgttttctctttcgttcccctaaccgccgtggatgggacaatctgtttcctccgccgccgtcgctagccgtcgcgagagggaccaaggccaccgctccgtcaactcttccaagaccagattcaccgcctcggtttcgccgatggccggttattcctccggcgccgccgaagaaggcgaaaaccatcgcgtggaggccgttgccgatgaatccaccgactacatctccgatctcccgaacgagtgcctggcttcggtgtttcagtttctcagctccgccgatcggagccgctgttcgctcgtttgccggcggtggctccagatcgaaggacagagccgccacaggctttctctgaacgccgaactggatctgtttccggcgattccgtcgctgttctctcggttcgattcggtgacgaagctcgcgctgaagtgcgaccgcagatccgtgagcatacgcgacgacgcgctcgtgctgatctcgcagcggtgccctaacctcacgcgcctgaagcttcgcgcgtgtcgcgagctcaccgacgcaggaatggaagcgttcgcgaagaactgcaagggattgaagaagctctcgtgtggatcgtgcacgtttggatccaaaggcatgaacgcggtgctcgacaactgcgccgcgctggaggagctctccgtgaagcgcctccgtggaatcgctgacactgcagcggcggagccgatcggtcccggcgtggctgcggcgtcgctcaaaactgtttgcctgaaggagctatacaacggacagtgtttcggaacgctgattctcggcgcgaagaatctgaaaaccttgaagcttttccggtgctccggcgattgggaccggctctttcaattattggtggatcgagtcacgaaaattgttgaggttcacctcgaaaggcttcagattagcgacgttggattgcaagcgatagcgaattattcgagtttggagattttgcatcttgttaagacacctgaatgttctgatattggacttgttgctattgcagacaggtgcaagcttttgaggaagcttcatattgatggatggaaggcgaatcgaattggggacgaaggtttgatagctgttgcaaaaggttgccctaatttgcttgaattagtgctaattggggttaaccctactaaggcgagtttggaaatgttggcgtctaattgccagaatctcgagcggttggctttgtgtggaagtgattcggttggtgatcctgagatatcttgcattgctgcaaagtgtgtggctttgaagaaactgtgtattaagagttgtcccgtttccgatcaagggatggaggcattggggaatgggtgtccgaatttggtgaaagtgaaggttaagaagtgtaaaggggttacccctgagggtggtgattggttgaggaggactagagggtcagttgctgttaatttagatactggtgaggcagagcttcaggaagccagtgctagtgatggaggggcacaggacaatggtgtagagttccctcaaatgcctgcccaaatcgctgctgcatcgagcagcactcggtctagttcgtcgaggtttgcgcttatgtctgcgaggatttcagcggctgcattgaggagcactcggtctggttcgtcgaggttagggcttttgcctacgaggatttcagcggctagcacttttaggagatggtctggtggtagcactagtgcacgccatggttagggacagggccaaagcaaaacctgagtctttgaccatttttcattgtttttggttgtcgtatcatttgatttttatatttcttgtacttaaatttgaaatttatgccgtgtgatgtttattgcctttggaattgaagcttcacggttgcaattgacaatcgcatttttttcctttctaaaaaa

SEQ ID NO: 362 - DNA, 2255 bp, Zea mays
  CDS (519)..(1958)
gcaaggcaagtagccgctgcgcggtgctgccacctgacctgactgccgtcccggtccccggtccatccgaacgccgttacggggccgcccaccgcgacggaacggaaaggtgcggtcaacccaccccgtcccagtcccatcaccgccgggggccgggtggataaacaaacccagcggccccggccccctgtccgcctcattcccttccttcctttgctcctcccctgcctcgcctctctcccctctcctcgcctccagctcctgctcggcccgctcgcgtccagctgcgcgcgcgcctgcggtggccgtgaaggacagcccgagggacgcgccgggtgcactgatctgggggccgcgtgtccccggtggtggggcgaggcggcgccggcttccaggaatgggcagcttgtagtggctgtttcttttgcatatgcgctttctattgttgttgtcatttcaaaggaggccatagtctcctggattttgtatgccttgttatctggaattggtgaccatagatgtcatttcgtagcatagtccgtgatgttagggatggcttcggcagcttgtcaaggagaagctttgaggtgaccctcgcaagcatttatggccttactgggcatcacaaagggaagacccagagctcatcacatgtgctcgacgactcaccttccataattcgtgaaagtcgatgggcgaatctacctcctgaactcatccgtgatatcatacggagactggaggctgatgagagcacctggccagcgcggaagcacgtcgtttgcttcgcagctgtttgtaggacatggagagaaatgtgtaaagagattgtgttgagcccggagttttgtggcaagctcaccttccctgtgtctctaaaacagcctggtcctcgagatggaaatacaatggtccagtgttttataaagaggaataagtcaaaatccacttaccatctctacctgtgccttagcaatgttgttacttcagaaagtgggaaattcctcttatcagctaaacgacaccgcaaaaccacatgcaccgagtacactatatcaatggattctggcaacatctcaagatcaaaaagaacctacattggaaaaataaggtctaacttccttggcacaagatttttaatttatgatacacaaccgccctataatggggctgtagttcctcctgccggaaggacaagcaggaggttcaactccacaaaagtctctccaaagctgccttcagtcagttacaacatcgcacaggtatcgtatgagttaaatgtccttggcacgagaggtcctaggcggatgcgttgcatcatgcactccatacctgcatcatcagtggagccaggtggcacagtgcctggacagccagagcagattgtacctcgagccctggaggattcattccgcagcacggcttccttctcgcagtcgttccgtagcactgcctcattctccaagtccatcatggactcatccatggatttcaatagcgctcgcttctctgacatcgctggcagcagcgctcgcttcacgggcgttcctggtagcagcgctcgcttcgcgggcgttcctggcagcagcgctcgcttctcgggcattgctggcgccagactggacaacgacgaggagagtgaaaccaaggagaggccactggtgcttcgtaataagccgcctaggtggcacgaacagctgcagtgttggtgcctcaacttccgtggccgtgtgacaattgcctcggtgaagaacttccagctgatcgccgcggctaccccgccaccggcaggtgcgccaaccccctctcagcctgccccgtcagatcccgacaaggtgattctccagtttggcaaagtggcaagggatatgttcacgatggactatcgctaccctctctcggctttccaggcctttgccatttgtctgagtagctttgatacaaagttagcctgtgaataaatggagaagaacaaaggtaaaggagaacatcaggttgcttgcattaggccatcagtgtacctctttccatctggctctcgtgttgccttggttgtatttgtgcttaatgtagccatgaatttggtggcccatatatggacgcatgtgttgttgttggccctctcccttagaagtgattaaaagttgcatttggaccacatgttacccgatctgtaatatacttgcagtggcatcgcatgccgcgtgataacaaagttcccgttcgtgattggacttgtatggttaaaaaaaaaa

SEQ ID NO: 363 - DNA, 1562 bp, Zea mays
  CDS (517)..(1269)
attcggctcgaggtgggattgtgggaagatgcctcgggatggcgcgcaggcggcgccgccaccggagcgcggcgagatggacgaggtggtagaggcggacccggatacggaggcggaggatcaggaggagaggtgggcgaggctgctgccggagctgctctccgacgtggtgcggcgcgtcgaggcgtccggcggcgagcggtggccggcgcggaaggacgtcgtctcctgcgcctgcgtgtgccgccggtggcgggaggccgccgtctccgtcgtgcgtccgccggcggagtccggcaagatcaccttcccctcctcgctcaagcaggtcgattgcatggcttcccttatatggcgtcatcagcggttttgatacgtaccggccattcagatatttaggatatagtttgagaagtttcctggccaattcagtgtcgtagtgttttttatttgacatctgtgtacctaaatcttacaccatttctcaaaacacagccagggccaagggagagaccaatgcagtgctttatcaagaggaataagaacaactctacattctacctctaccttggcttcacaagttcacctgtggataaagggaagtttctcatggctgctagaagatttaggcgtggtccccataccgagtacattatatctcttgatgcagaagacttatcacaagggagcaatgcatacatggggaaactgagatctgatttctgggggacaaacttcaaaatatatgatagcaagccaccatatgatggtgctaaagcatcaagtagtcgatctagtcgtcgtttcggaagcagaaggattagtccccaggtatcggctggcaattatgaagttggacaggtttcatacaaatacaacttgctcaaatccagaggccccaggagaatgtattgcactctcgaatgcccttcagcccaagagacttgggaaaactcactcaagacaaagttcaggcgccccctgggccccacaactttacgaaataaagcaccccgctggcatgagcacctgcaatgctggtgcttaaacttccatgggcgggtaacagttgcatcagtcaagaatttccagcttgtggctgctgccgaccccagtgagcctactaccaacgtggatgatgaaacggttctgctgcagtttggtaaggtcgatagcgatatgttcacaatggattaccggcaaccactctccgcgtttcaagcatttgccatcagcctcagcagctttgggaccaagctagcctgtgaatagcgatgcagtttgatgctcttcgtgtggctatatggtttgtgttggtggttgcttgcttgtttcttgttgttacgatgtgatccgttcttcgttttagttgagtatttatgtactatttgtaccacaagagatgtaataaactattgtattgtcaaacggatttgttcaaggaaattatgtgtaatgaacttttgctctagttccatgcaaaagacatttcaatgtacatctgttcatggtgaaaaaaaaaaaaaaaaaaaaaaaaaaaaaaaaaaaaaaaaaaaaaaaag

SEQ ID NO: 364 - DNA, 1511 bp, Oryza sativa
  CDS (4)..(1221)
gcgatgtctttcaggagcgtgatccaggaggtgaagggcgagatcggcgccatctcgcggcgggggttcaggtcgcggccggggcgagtccggcgagtggcggcggcggcggaggagccgccggacgagtcgtcggcggcggcgctggtgatgcgggagagctgctggacgcagctgccgccggagctcctgcgggaggtgctggcgagggtggaggagtcggaggggtggtggccgcgccgccgcgacgtggtggcgtgcgccggcgtctgccggagctggagggggatcgtcagggagatcgtgcgcaccccggaggcgtccgggaacctcaccttcccaatctctctcaagcagcctggcccgagggatgctcctatgaaatgtttcattgtaaggaaccggaccactcagacatattacctgtacattggactgactgatgcattaactgatgatgggaagttcctacttgctgcacgcaaatgtcgtaggaccacatgcactgagtacctgatttcgcttgatatgaacgatatatcaaagaggactgatagttatgttggcaaactaagatctaacttcttgggaaccaaatttactatctatgatgcccatccaccttatgctggagatgtgatttcaaagggtcagtctgcacgtgtgattggttcaaaccatttatcccccaggatacctgctgggaattatccagtctcacatatttcatatgaattgaacgttttgggttctaggggcccgagaaggatgcactgcgctatggattctatccctgtatcagcaattgaacaaggaggaacagctccgacgcagactgaatttcctttgagttaccatgaatctttcacatcaattccctttttcaaatcaaaatcagttcgagcgaataattcaactgcttcattactcactcaaaatggaagcaaactggtgttgaagaacaagtccccgaggtggcacgaacatctgcagtgctggtgccttaacttccatggacgggtaacggttgcatcggtaaagaacttccagctggtggcttcagatgagagtaacccaaccaaccaggaacacgatgatgtgatcctccagtttggtaaagttgggaaggacatgttcaccatggattaccgctatcctatctcggcatttcaggcgtttgcgatatgtctgagcagctttgacaccaaaatagcgtgcgaatgagtgaaggtgtgattctttcttccatgatcgaatgaaccgtttcctgatgacccacattgcaagctggccatgcactctgcttagttgcttccaccttttggaagcatgcagaatagagacataaataaaagttgctttaaatctaacattttagttgggtagggatatgtaacctgcaatttagctttcttgaagtatgttcaacctgcaacatttgagtgacttgtaagtcttgagtttaactacaggtgttggataaccacaattgacagctcaaaaaaaaaaaa

SEQ ID NO: 365 - DNA, 1412 bp, Zea mays
  CDS (49)..(1122)
agaagaagaaaaaggagaggcccgcgactgtagtgggattgtgggaagatgcctcgggatggtgcgcaggcggcgccgccaccggagcgcggcgagatggacgaggtggtagaggcggacccggatacggaggcggaggatcaggaggagaggtgggcgaggctgctgccggagctgctctccgacgtggtgcggcgcgtcgaggcgtccggcggcgagcggtggccggcgcggaaggacgtcgtctcctgcgcctgcgtgtgccgccggtggcgggaggccgccgtctccgtcgtgcgtccaccggcggagtccggcaagatcaccttcccctcctcgctcaagcagccaggtccaagggagagaccaatgcagtgctttatcaagaggaataagaacaactctacattctacctctaccttggcttcacaagctcacctgtggataaagggaagtttctcatggctgctagaagatttaggcgtggtccccatactgagtacattatatctcttgatgcagaagacttatcacaagggagcaatgcatacatggggaaactgagatctgatttctgggggacaaacttcaaaatatatgatagcaagccaccatatgatggtgctaaagcatcaagtagtcgatctagtcgtcgtttcggaagcagaaggattagtccccaggtatcggctggcaattacgaagttggacaggtttcatacaaatacaacttgctcaaatccagaggccccaggagaatgtattgcactctcgaatgcccttcagcccaagagacttgggaaaactcactcaagacaaagttcaggcgccccctgggccccacaactttacgaaataaagcaccccgctggcatgagcacctgcaatgctggtgcttaaacttccatgggcgggtaacagttgcatcagtcaagaatttccagcttgtggctgctgccgaccccagtgagcctactaccaacgtggatgatgaaacggttctgctgcagtttggtaaggtcgatagcgatatgttcacaatggattaccggcaaccactctccgcgtttcaagcatttgccatcagcctcagcagctttgggaccaagctagcctgtgaatagcgatgcagtttgatgctcttcgtgtggctatatggtttgtgttggtggttgcttgcttgtttcttgttgttacgatgtgatccgttcttcgttttagttgagtatttatgtactatttgtaccacaagagatgtaataaactattgtattgtcaaacggatttgttcaaggaaattatgtgtaatgaacttttgctctagttccatgcaaaagacatttcaatgtacatctgttcatggtgaagtgatacttctcccttttctaaaaaaaaaaaaaaaaaaaaaaaa

SEQ ID NO: 366 - DNA, 1996 bp, Zea mays
  CDS (257)..(1600)
ggctccgaatcggcggccacttctcattcctcacttccgtcctcgcgcaccaccccctccatccgttccggatggtgccttcgaaatcccgtccggcgccctagcgtagctcgggctcggccaggctccgggcccgccgcgccgttccgcagtccagctccacctccagatcttttcttgagtttaaggaagatgcttgcctttatttagaaggccctttttggtacgtcagcagtgttctttcctataggagtaaatgccattccgtagcatcgtgcgtgatgtaagggatggtttcgggagcttgtctaggaggggatttgaggtcaggtttctgagtcatcgcagagggaaatctcatggtgctgtccatgagctgcacgacccagtgcttgtggtacagagtagctgctgggctagcttgcctcctgaattacttcgagatgtgattgagaggttggagaccagtgaggatacatggccttctaggaaacatgtagttgcttgtgcagctgtctgcagaacatggagagagatgtgtagagagattgtcaagagcccagagttttctggaaaaatcacttttcctgtttccttgaagcagcctgggcctcgagatggaactattcagtgttttattaagagggataaatctacccaaatctacagtctgtaccttagttttagctctgccgtgcctgtcgaaaatggcaaattccttctatccgcaaaaaggaactgccgtgcaacatatacagaatatataatatcaataaattctggtgatacatctaggtgtacaagtaacaacacatacattgggaaattaaggtcaaatttccttggcacaaaatttgtaatatacgatactcatccgccatacaatggaactagtcaaacagtggcagggaaaacaagtcagagattctactccaagaagggatcaaccaaggtttcttgcaggtggtacagtattgcacaaatctcatacgagctgaatgtcttgggaactcgaggcccaaggcggatgaactgtgtaatgcactccatcccagcttcatgccttgaggctggtggcagtgtcccttgccagccggacagcattgcagcccactctgttggcggatcattcagcagtgtgtccttgtcaaagtcatcgactatggaccactctatgcatttcaccagttcccggctctctgatgccataacaggagatggcattgtgaacagaggccaggcattgaatgatgctgacgatgaagagtgcaaggacatgcctttgatcctccgcaacaaggccccaaggtggcacgagcagcttcagtgctggtgcctcaacttccggggccgggtgactgtcgcctcggtcaagaacttccagctagtcgcggcgacacagcctgccgccggagccctgaccccatcacaggcagccccgcagccagctccgcctcctccgccggaccaagagaaggtcatactgcagtttgggaaggtcggcaaggacatcttcaccatggactactgctacccgctgtcagccttccaggccttcgccatctgcctgagcagcttcgacaccaagttggcctgcgaataaatcctacctacaattctggtacctaccaaataatcaaaaacactgattgtcgtggtgttcgtccaagaaccgagtttagctgagacgccattgggcaccatgtgctggtgccttgttaactcagaaacgcgtgggggctgaatctgtttcagcagcttccttgtgataatctgtagctgctgcttcgctgctgttgtatcctatgctttcatttctttccggttccgctgtagcttcttaccccccggtgacattagttcggtacccgtatctggatatttttttagccttcttcgttggattgttcaccggtgatggcatgtattaacagagatagttacatacagatgtaatgaattcaggtctggataaaaaaaaaaaaaaaaaaaaaaa

SEQ ID NO: 367 - DNA, 1452 bp, Zea mays
  CDS (100)..(1200)
cgaaatccaactcaccggtgtccttggcttcgttcttttcaccggtctgctaccgactcacgcccggcgaactctagccgcggccacgggtcatcacacatggtctcctggcggcgcagcgcgtcctggctgtcgtcggcgtcgcgctcctcgctcggcgccgccgtcggcggggaggccaaggtcacgccggaggcggatccggcggcgcagcacgacgaggccgacgaggagcgctggtcgcgcctgctgccggagctgctcacggagatcatgcggcgcgtcgacgccggcgccgagcgctggccgccgcgccgggacgtcgtggtctgcgcctgcgtgtgccgccggtggcgcgacgccgcggtctcggtcgtccgcccgccgctcgagtgcggcaggatcaccttcccgtcgtcgctcaagcagcctggaccaagggatgcgccgatgcactgttttatccggagggacaaaaaaatttcaaccttttctctctatctcagcttaacgcaggccctaacggataaagggaagttccttttggctgctcgaaggttcagacaaggagcacatacagaatatatcatctcttatgactatgatgatctgcacccaagaagcagttcatatgttggaaagttgagatctgacttcttggggacaaagttcatcatctatgatacccaggcgccatatgacggtgccaaaccttctaggacccgatccactcgccgctttgcaagcaagcagataagcccacaggtttcaggcggcaatttcgaagttggacaagtgacctacaggttcaacttcatgaaatcaagagggccgagacggatgcagtgcaatatccagtgccctgtaggccagggcagcgcttcggatccatccaaggagaaaacaccctcgccgagttccttggacctgaagaacaaggctccaagatggcacgaccatcttcagtgttggtgcttaaatttccacggccgggtgaccgtcgcctccgtgaagaacttccagctcgtcgccacagctggctccggtggtccatggggcgtcggagacgaggagacggtgatcctgcagttcgggaagatcgaggacgatgcgtttacgatggactaccggcagcctctgtctgccttccaggcgttcgccatctgcctcaccagctttggcacgaagctggcctgtgaataaatggttgccggtttaccaactatgttggggatcagattgtagggggtagtctgaactagttgccctgagcacctcagatgggagaaaactggcgataagaaacagggcggacgttgtccctataagctttgactccttgtaatcgcctaaatgattgatttatatatatatgatgtgcgcctatgttgttgaagagatgacgatgacttatcgttgtaaatggcactccacttcgtttggtgacaaaaa

SEQ ID NO: 368 - DNA, 1619 bp, Zea mays
  CDS (83)..(1390)
tcgctctagttatggcggatcttgacatggagcattaggagtttctttcgtcgaaggcggaaggagcttgctgtaagctgcaatgtctctcaagagcattgtgcgggagctgaaggagatgagggacggtatcgggagcatgtcgagacgcggcggcagcggctccgacgggcgtgccttccacggccgctcggggtcgcggcattcttggcccagcctgtgggcggagcagcaacagtcgcatcggcagggccagggcctgggtccgggcccggaggggccgcatcatcagcatcaggggcggtgggcgaacttgcctccggaactgctgctggatgtgatacagagggtggagtccagcgaggcgacgtggccggcgcggcgccaggtcgtggcatgcgcagccatttgccgatcatggcgcgaggtcaccaaggaggtggtgaagacgctcgaggagtgtggcaggatcaccttccccatatcccttaagcagccggggcctcgtgaaatgccggtccaatgttttgtgaggagggagagggcaacatccacatatctactctacctagggctcagcccatctatgaatgtggagaaagacaagttattgcttgctgcccgtaaggtcaggcgtgccacaaggacttattttgtgatatcactggtctctgatgatttctctcactctagtagcacctacgttggcaaactgaagccaaacttcctcggcacaaagttcacaatcttcgacagccagcctcctcctgacgctgtagtgctaccaaacaataagacaagcaaaaggcagtccaagcaagtatcaccgagactgccgctaggcaattacaatgttgctacagtcacgtacgagctcaccgtcctacgcaacaggggtccaaggagaatgcaatgcaccatgcactcaataccagctgagtgcatccaggagggcgggaaggcccctacccctacaggcgccatccagtcgcttgacgagccagtgtcgtccaccttacctagtgccaaagggaaggaagtggctgtagaattctcttcgacaagcctcagcgccgatctgtctggaccggcctgcgtgaacggaacacctctagtgctgaagaacaaagctcctcgttggcatgagcagctgcagtgttggtgcctcaacttccgggggcgtgtcaccgtcgcgtcagtgaagaacttccagctcgtcgcctctgttgatccttccctaaacatccccgcagcggagcaggagaaggtgatcctccagtttgggaagataggcaaggatatattcaccatggactaccggtacccactctcggcgttccaggcctttgcgatctgcctgaccagcttcgacaccaaaccggcctgcgaatgattgacggtagtttaaaatcgcgggtggagtcttgtgtacgtccgtgttcttccagggcgatgtaaattctttatcttgccatgctgggcctctgctgcccaggcgaaatggtagcttgtgaggtggagatgagcgatagcatctgtaccataggaagagatttgagcgaccttgtttacccaactgttatatgtattattgctgggatgtttggctgtgaaaaaaa

SEQ ID NO: 369 - DNA, 1476 bp, Zea mays
  CDS (125)..(1327)
ggcgaccataactaagatgtgagatttggtggcgtcagctcggctggtgggtgattcttggtgcgtacacagacacatccctggaggcctggaggcttggcgaggaggacagtgcaggagagagatgtctttcaggagcctgattcaggacatgaaggacgagttcgggagcatctcgcggcacagcctgcggtcccggtctcaccgctccgccgggaacgcggcgcgggcggtggccgcgggaccgtcggaggcgatggatcagagctgctggtcgcagctgccccccgagctcctgcgggaggtgctggtgagaatcgaggcatcggagagctggtggccagcgcgcaaggacgtggtgtcaggcgccggcgtctgccggacctggaggggcatcatgaaggaggccgtgcgcgtcccggaggtgtcagggaagctcacgttccccatctcgcttaagcagcctggcccaagggatggcactcttaaatgtttcatcaggaggaatcgaactactcagacatattatctgtatattggattgacagaagcattggctgatgatgggaagtttctacttgctgcacgcaagtgtcgtaagcccacctgcacagactacctaatttctcttgataaggttgatatgtcaaagggaagcagcacctatattggcaagctaagatcaaacttccttggaacaaagttcactgtctatgatgctcatccaccatatgatggagctgcggtctcaaagagtcgctctgcacgtgtggttggtttgaagcaggtctcccctagagttccggctggaaattatcccgtttcacatatttcttacgagctgaatgttctgggctccagaggtccaagaaggatgaactgtgttatggattccatccctgcatcagctgttaaggaaggagggaaaactcctacacagactgaatttccacttagcagccttgactctttcccatcatttccattcttcagatctaaatcagctcggatagacagttcaacgtcgcaatcatccagtcagagggaagataggttggtgctgaagaacaagtctcctaggtggcacgaacaactgcagtgttggtgcctgaatttccgtgggcgggtcactgttgcctcggttaaaaacttccagttggtggcttctgaggacaatggaccagagagccaagagagtgacaaggtgattctccaattcggaaagatcggaaaagatttgttcaccatggactacggttatccaatatcggcatttcaagcttttgcaatttgtctgagcagttttgatacaaaaattgcctgcgaatgaggcaaggtgatttccccccttctctattccccttgcttgtattatggacatgcagtaaaattttattgaacatgcaatttccaatgtcaaggatgattggatgaagctctccacacataaaaaaaaaaaaaaaaaaaaaaaaaaaa

SEQ ID NO: 370 - DNA, 1791 bp, Zea mays
  CDS (333)..(1700)
cgaagctacccctgttcctctgcgatttgggctcgtcctgtgtccttcctgttgctcaaaagctcgctcattcgatgtccctgtctgaaaggcgacaaatcccactggaattcggagcacagagctttgaatccaggggccaaaactttttgctcatctcccttgcggaaaagcgcctcctctgcgtctgaaagtcggatcttttttcacagattcgatttgaagttcccgagcagctcgaggaccgcggtgtcggtaagacttgctttgaagatcttgatcaccacaagagatttgctgaatttccggtcactgtactttttccactggacatgtcctttcgcagcatagtccgtgatgttagggaaagctttggtagcttatcaagacggagccttgaggtcaggatttctggtttgcctggtctgtctggtggtcatcatagagggaaatctgttggatctgtgagtgacctgcgcgacagacctgtagtagttgatcaaagcaggtgggttggtcttcctcctgaattgcttcgagatgtaatgagaaggcttgaggaaggtgagagcaattggccatcccggaaaaatgttgttgcctgtgcagccgtctgtggaacatggagagagatatgcaaggatatagtgctgagcccggagttctgcgggaagctcacttttccagtatcacttaaacagccgggaccaagaaatggaataatccagtgtttcataaaaagggacaaatcgacatcaacttattatctttacctatgtcttagccctgttgtcctcagcgaggatgggaagtttctgctagcagctaagaggaatcgccgtacaacatatactgagtacatcatttctgtggatcctaaaagtatatcacgatcaagtgatggctgtgttggaaaaatgaggtcaaattttcttggcactaaattcatcgtgcatgacactcgagcaccacacaatgctgggagccttgtctcctgtgagcgcggcagccgcagaatctcctctaggagggtttcccccaaggtacccactgccagctaccccattgcccgggtgaactatgagctaaacctgcttggcacaagggggcccaggcgtatgaattgcacgatgcattccatcccagcctcaacgctggaccctcaaggcatggtgcctgagcctggccaacccaagcagatcttcgtccctggctcgtcgtccttcgaagattcctttcgcagtgcaaacaacaccccttccagctcaaggttctcggtcgcagaccgctccttggattggagctcctctcgattctcagagacgagcggattggctcagcaggacgacgatgacagtgaccaggctaaggagaggcctttggttctctgcaacaaggagccaaggtggcacgagcagctgcagtgttggtgcctcaacttccatggtcgggtgaccgtggcttctgtgaagaacttccagttgatagctgcaccacaactagattctgaaccgtcacagcaagctcagcagcaaacccagccttcgaattcgtcttcagcatcggatcatgacaaagtgatcctgcagtttggtaaggtcgccaatgacatgttcactatggactaccgatacccactctcggcattccaggccttcgccatctgtttgaccagcttcgacagcaagctggcttgtgaataaattgtacataaagaacaggaatacatgtagattgtatctctgcagtaagtatttacagtgtgtgtgctggtgtagtttaaaaaaaaaa

SEQ ID NO: 371 - DNA, 2202 bp, Oryza sativa
  CDS (83)..(1867)
ttggtttagccccatgccacctggttcgggctagatctccggcgagacggccgctgggagcagccgatccggccccgatccgatgggtggcgaggtgccggagccgcggcggctcaaccgggcgctcagcttcgacgactgggtccccgacgaggcgctgcacctcgtgatgggccacgtcgaggacccgcgggacagggaggcggcgtcgcgggtgtgccgccgctggcaccgcatcgacgcgctcacgcgcaagcacgtcaccgtcgccttctgctacgccgcgcgccccgcgcgcctccgggagcggttcccgcggctcgagtcgctctcgctcaagggcaagccccgcgccgccatgtacgggctcatccccgacgactggggcgcctacgccgcgccatggatcgacgagctcgccgcgccgctcgagtgcctcaaggcgctccacctccgccgcatgaccgtcaccgacgccgacatcgccgcccttgtccgcgcccgcggacacatgctgcaggagctcaagctcgacaagtgcatcggcttctccactgacgccctccgcctcgtcgcccgctcgtgcagatccctgagaactttatttctggaagagtgccatattactgataagggtggtgaatggcttcatgaacttgctgtcaacaattctgttctggtgacactgaacttctacatgactgaactcaaagtggcgccagctgatctagagcttcttgcaaagaattgcaagtcattgatttcattgaagatgagtgagtgtgatctttcagatctgattagtttttttcaaacagccaatgcgctgcaagactttgctggaggagcattctacgaggtaggagagctcaccaagtatgaaaaagttaagttcccacccagattatgcttcttggggcttacctacatgggaacaaatgagatgcctgttatcttccctttttcgatgaaactcaagaaactggacttgcaatacacttttctcacaacagaagatcattgtcagattattgcaaaatgtcccaatctactaattcttgaggtgaggaacgtgataggagatagagggctagaagttgttggtgatacatgcaagaagctacgaagactccgaattgagcggggtgatgatgatccaggtctgcaggaagagcaaggaggagtttctcagctaggcttgacagccgttgctgttggttgccgtgaattggagtacatagctgcttatgtatcggatatcaccaatggggccctggagtctattgggactttctgcaaaaatctatacgactttcggcttgtgctacttgacagagaaagacaggtaacagatctgccacttgacaatggtgtctgtgctctgttaagaaattgcacaaagcttcggaggtttgctctctaccttagaccaggagggctttcagatgatggccttagctacatcggacagtacagtggaaatatccaatacatgctactgggcaatgttggtgaatctgaccatggattgatccgtttcgcagtgggctgcaccaaccttcagaagcttgaattgagaagctgctgcttcagcgagcgagctttgtccctcgctgtactgcagatgccctccctgagatacatatgggtgcaaggatacagagcatctcaaacaggccttgacctcctgctcatggccaggcctttctggaacatcgagtttacacctccgagccctgagagttttaatcatatgacagaagatggagaaccctgtgtggatagccatgctcaggttcttgcctactattcccttgctggaaggaggtctgactgccctcagtgggtgatccccttgcatcctgcgtgattgtaaatatgtcaagctgtgtataccttcctatctatccctggggcataagcatggccttgtatggttattgtaagaaccttagcttgccacctttgtgattgtgcccgaataagctactactagtactttagctggggtctatagtgcaataagttgttgtcacttgttctacgtatctaatcctaggaagatgtatactaagttcctctgtaactgtaagagtgatctgtgctttggttgcgagatgtacattgtaagtatcagaaatcatgtgttactggtttttttgccataatatatgcctatataagccgggaaaaaaaaaaaaa

SEQ ID NO: 372 - DNA, 2336 bp, Zea mays
  CDS (167)..(1936)
gcaggagacagaggggctccccccccacccccgagcccaaacgcagctagctccccattccacccaagctcccgcagccagatgctctcccccgctcgagccccaccgccgccgcccgtccccgccgccgggtagaccgcccgatccgacggcgcccgccgcacccatgggccgcggcggcgcgcgcgcggcccccgccgccgcggtgccgccctggcacgcgctcccggacgaggtctgggagcacgccttctccttcctccccgcggactcggaccggggcgccgccgcgtgcgcctgccacgcctggctccgcttcgagcgccgctcgcgccgccgccttgccgtcgccaactgctacgccgcgtccccgcgcgacgccgtcgagcgcttccccgccgtccgcgccgtcgaggtcaagggcaagccccacttcgccgacttcggcctcgttccgcccgcctggggcgccgacgccgcgccctgggtcgccgccgccgccgccggctggccgctgctcgaggagattagctttaagcgcatggtcgtcaccgacgactgcctcgagatgatcgcggcctccttcaggaacttccaggtgctgcgcctcgtctcctgcgagggcttcagtacagccggcctcgctgccattgccgctgcttgcagaaatctaagagaacttgaccttcaggagaatgagattgaggattgctctattcattggctcagtctatttccagtatctttcacttctttggtaactctaaatttttcatgcctagagggggatgtcaatatcactgtacttgaacaattagtaaccagatgcagcaacctcaagactctcaagctcaacaatgctatacctcttgacaagcttgctaacctccttcgcaaggctcctcagattgtagaactcggaacaggaagattctctgcagattaccatccggatctcttttcgaagcttgaagcagcatttgctggctgtaaaagcttaagaaggctctctggggcttgggatgccgttccagaatacctgccagcattttattgtgtatgcgaaggcctcacatcactaaatctgagctatgctactgtacgaggccctgaactgattaaattcattagcagatgcaaaaatttgcaactcttatgggtgatggacttgattgaagaccatggtcttgctgttgtggcatcgtcttgtaacaaactgcaggagttgcgggttttcccttctgctcctttcgaagcagctgagcaggtctctttgactgaaagaggtcttgttgatgtatctgccagttgcccaatgctggagtcagtcctctacttttgcagacggatgaccaacgaggcccttattaccatcgcgaagaaccggcccaacttcacttgcttccgcctatgcatcattgagcctcacacaccagattacattacacaccagcctcttgatgcaggttttagtgccattgtggaatcatgcaagggcctcaggcggctttctgtttcaggccttctcacggacagtgtatttaaatccatcggggcacatgctgaccgtcttgagatgctctcgattgccttcgccgggaacagtgatttgggcctccattacatcctatcgggctgcaagagcttgaagaagctagagattagggactgcccatttggtgacaagcccttgctggcaaacgctgccaagctggagacaatgcgatccctttggatgtcgacgtgctcaatgaccttgggcgcatgccggcagcttgcgcgcaagatgccccgtcttagtgtggaggtcatgaatgatcctcgacggggattccccttggactctctaacagatgagagccctgttgagacgttgtatgtctaccggacaatttcaggtccaaggtccgacacaccagcttgtgtccagattctctaaggggcagctgtggtctacaaaggtactatggaagcatccattttcaatcacatcatgtaccttcaacaccttactagcataacctggatcgtctccttgaagtagcaaggctggtgacctcggtaatcctgtcataatctctgcttagctgtacaactgtttctgggagtttagggtgagagactcagggtccctttcaggtgttaataactgtagggaggacactcgatgagttacaggaactactagatagcgtcttgaggaaacttgggtttgttttcttagcgtgcctagttcttttcatgtataaaaaaatatgggatcattccaatgctgccacaatgtactgtactattggaacaattgtacttggagcctctacttttttgaaaaaaaa

SEQ ID NO: 373 - DNA, 1695 bp, Glycine max
  CDS (80)..(1441)
attcggctcgagcactatttaccccattttctctaaatccaaacaggccccaaaagaaagagagggaaaattctcttccatggcctcttcacgccctgccaatgtgggaatccttgccatggacatctacttccctcccacctgcgtcacccaggatgctttggagggtcatgatggggtgagcaaagggaaatatactattgggcttggacaggattgcatggccttctgctctgaggttgaagatgttatctcaatgagcttgacggtagttacttcacttcttgaaaaatttaatgttgatccaaagcaaattggacatttggcggttgggagtgaaactgttattgacaaaagcaaatcaattaagaccttcctgatgcaagtttttgaggcaagtggtaatactgacattgaaggtgttgattcaactaatgcatgctatggaggaacggctgctttgttcaactgtgtgaattgggtggagagtagctcatgggatggacgttatggacttgttgtttgtacagacactgcggtatatgctgaaggacctgctcgtcccactggaggagctgctgcaattgccatgcttgtagggccagatgctcctattgcttttgaaagcaaactcagaggcagtcacatgtctcatgcatatgatttttacaagccaaaccttgctagcgaatatccaattgttgatggaaaactctcacagacctgttatctcatggcacttgattcctgttaccggctttactgtgagaaatttgaaaaattggaggggaggcctttttcaatgtcagattctgattattttgtgtttcattctccatataacaagcttgtgcagaaaagttttggccgactatacttcaatgacttcttgagaaatgccagttttgttgatgaagttgccagggaaacccttgcaccatatgcatccttatctggtgatgagagttatcaaagtcgtgatcttgaaaaggcaaaccagcaagctgcaaaacatctatatgatgcaaaggtgcagcccagcacactaatcccaaagcaagttggtaacatgtacactgcatctctttatgcagcatttgcatctcttcttcacaataagaacagttcgttggtaggtaaacgggtagttatgttttcatatggaagtggtttaacagctacaatgttctccttccagcttcaagagggtcaacatccgtttaacttgtcaaacattgtaacagtgatgaatgtttcggacaagttgaagcagagagttgagattcctcctgaaaagttcgttgaaacattgaagatcatggaacaccgttatgggggtaaggactttgtgacaagcaaggactgtagctacttaactccaggcaccttctatctcaccaatgttgattccatgtacaggagattttatgccaagaaggactaggttattggttagttgatgatcgctgatatattcaaatatggagttaaaatgtattttcttatggttcacctgtatttgatcccataaggttgtgtatcaaaatgtttataagatgtttcatttttttgtggtgatcaggttgtaaccaaaataagaataagtttatttgcgaattggcaattgtttttaaatgcactaataatccaaatatattagtagtttcttcttgagtgcaaaaaaaaaaaaaaagg

SEQ ID NO: 374 - DNA, 2262 bp, Saccharomyces cerevisiae
  CDS (220)..(1695)
aagcttcgtatatacaatagaaaaattttccatacaatattacataatactatagagtaatcatacccacaatctccatggctgcggtatcgtgtcgaaaatgaaccgggctattaattatacgagtgtgttgaaagtaggctccattcggcctcatcgggcggaactgtttgggtgcctcgccaattttcgtagccaaattactataaaaggtgcagcatgaaactctcaactaaactttgttggtgtggtattaaaggaagacttaggccgcaaaagcaacaacaattacacaatacaaacttgcaaatgactgaactaaaaaaacaaaagaccgctgaacaaaaaaccagacctcaaaatgtcggtattaaaggtatccaaatttacatcccaactcaatgtgtcaaccaatctgagctagagaaatttgatggcgtttctcaaggtaaatacacaattggtctgggccaaaccaacatgtcttttgtcaatgacagagaagatatctactcgatgtccctaactgttttgtctaagttgatcaagagttacaacatcgacaccaacaaaattggtagattagaagtcggtactgaaactctgattgacaagtccaagtctgtcaagtctgtcttgatgcaattgtttggtgaaaacactgacgtcgaaggtattgacacgcttaatgcctgttacggtggtaccaacgcgttgttcaactctttgaactggattgaatctaacgcatgggatggtagagacgccattgtagtttgcggtgatattgccatctacgataagggtgccgcaagaccaaccggtggtgccggtactgttgctatgtggatcggtcctgatgctccaattgtatttgactctgtaagagcttcttacatggaacacgcctacgatttttacaagccagatttcaccagcgaatatccttacgtcgatggtcatttttcattaacttgttacgtcaaggctcttgatcaagtttacaagagttattccaagaaggctatttctaaagggttggttagcgatcccgctggttcggatgctttgaacgttttgaaatatttcgactacaacgttttccatgttccaacctgtaaattggtcacaaaatcatacggtagattactatataacgatttcagagccaatcctcaattgttcccagaagttgacgccgaattagctactcgcgattatgacgaatctttaaccgataagaacattgaaaaaacttttgttaatgttgctaagccattccacaaagagagagttgcccaatctttgattgttccaacaaacacaggtaacatgtacaccgcatctgtttatgccgcctttgcatctctattaaactatgttggatctgacgacttacaaggcaagcgtgttggtttattttcttacggttccggtttagctgcatctctatattcttgcaaaattgttggtgacgtccaacatattatcaaggaattagatattactaacaaattagccaagagaatcaccgaaactccaaaggattacgaagctgccatcgaattgagagaaaatgcccatttgaagaagaacttcaaacctcaaggttccattgagcatttgcaaagtggtgtttactacttgaccaacatcgatgacaaatttagaagatcttacgatgttaaaaaataatcttcccccatcgattgcatcttgctgaacccccttcataaatgctttatttttttggcagcctgctttttttagctctcatttaatagagtagttttttaatctatatactaggaaaactctttatttaataacaatgatatatatatatattttttttataaagaattgtatatctatatttataacacaataaatctaatctcaacttttttctttaaagttaagcccaaccgattttttttctcattcataaccccgacgtgttttccatgtattcagacaatgctaatgttaaaggtggaatatcagccaatttatgtagaaccagtggcctgatgcgttgacaaaatgcggaaccagcaccatcatccgtgtcgttggataaaaggcacaaaaacgtacaggccactttagaaacatctgagagttcttgagggaatttgacctctggtatgctgttttgtcttgcaggtgtaatttccttagagtcattcaaaaatttggattttagtgccgaaatgggtacctgggattctctttccccgtctgcaatacccaaagctt

SEQ ID NO: 375 - DNA, 1295 bp, Zea mays
  CDS (249)..(947)
ccacgcgtccgtgcttctgctacctttaaggaactattgacaagacataaagcaaccgttgctgaatttctctccaacaattatgattggttttttgaagaattcaactctaggttgctgtcatcaaccaacttgatagcttgcctttttgcgccgctcctcagccatcctctccatctcggtgtcacacactccgcatacgcacctacgagagtcgagtgacagcgagcgagcgagcgagcgaagccatggctctccgcaccctggcatcgaagaacgccctatccttcgcgctcggcggcgcggcccggccgtcggcggcgtccgcgaggggggtgacgacggtcgcgctccccgacctctcctacgacttcggcgcgctggagccggccatctcgggggagatcatgcgcctgcaccaccagaagcaccacgccacctacgtcgccaactacaacaaggcgctggagcagctcgacgctgccgtcgccaagggcgacgcctccgctgtcgtccagctccagggcgccatcaagttcaacggcggcggtcatgtgaaccattcaatcttttggaagaacctcaagcctattagcgaaggtggtggggagccgccacatgggaaacttggctgggccatcgatgaggattttggttcatttgaggcacttgtaaagaggatgaatgcagaaggcgctgctttacaaggatctggatgggtgtggttagctttggataaagaggcaaaaaagctttcagttgaaactacagctaatcaggatcctctggtgactaaaggtgcaagcttggttccgctgttggggattgatgtctgggagcatgcgtactacctgcagtacaagaatgttaggccggattacctgaacaacatctggaaggtgatgaactggaaatatgctggagaggtgtacgaaaatgttcttgcttgaattgtcttaatggacaatactcatctgcgcgggtttgttttcggctgtttgaccatgtgaaataaagatggacttgtgtacctgctggaccaagtgtacatttcgctaagatagactaacgcacaatggcctgccgattttgtccatcctgtattcctgcttgcgtgccactccactttctgctgctcgtagtggcaggcacatagtatgtgcttaacgttagactacggcacggccctttcagagttcgagcatggtgatgcccaaaagaaccatttctactcttgtctccattaataaaatctgccgaggtgccgatgtttgcttgaaaaaaaaaaaaaaaag

SEQ ID NO: 376 - DNA, 800 bp, Arabidopsis thaliana
  CDS (94)..(675)
tcatcttttgtctcaccttttaatttgctaccctatccatacgcacaataaggctattgtacgtatgcaaattaataataaaggagagtagcaatgtcattcgaattacctgcactaccatatgctaaagatgctctggcaccgcacatttctgcggaaaccatcgagtatcactacggcaagcaccatcagacttatgtcactaacctgaacaacctgattaaaggtaccgcgtttgaaggtaaatcactggaagagattattcgcagctctgaaggtggcgtattcaacaacgcagctcaggtctggaaccatactttctactggaactgcctggcaccgaacgccggtggcgaaccgactggaaaagtcgctgaagctatcgccgcatcttttggcagctttgccgatttcaaagcgcagtttactgatgcagcgatcaaaaactttggttctggctggacctggctggtgaaaaacagcgatggcaaactggctatcgtttcaacctctaacgcgggtactccgctgaccaccgatgcgactccgctgctgaccgttgatgtctgggaacacgcttattacatcgactatcgcaatgcacgtcctggctatctggagcacttctgggcgctggtgaactgggaattcgtagcgaaaaatctcgctgcataataactgatggcaaatgcagcattgcctgaagcgctacgcttatcaggcctacgcggatcatcgatgtaggtcggataaggcactcgccgcatccggcaagataaatcgcacgttgtcagcaactg

SEQ ID NO: 377 - DNA, 834 bp, Arabidopsis thaliana
  CDS (142)..(747)
ctgcaggttcaactatctcagatagcggaagcgaccttagtcaatctcgggtggcttgtgctgcaggagacgctcagacgagggaagcgtccggtttttattaatctaggtaaagacaacctgctcaagagaacacactgcatgtcctacgaattgccagcattgccctttgactacacggcactggcgccttacatcaccaaggaaacgctggagttccaccacgataagcaccacgcggcctacgtcaataactacaacaacgccgtcaaagacaccgacctcgatggccagccgatcgaagccgtgatcaaagcgatcgcgggtgacgctagcaaagccggtctgttcaacaatgcggctcaagcttggaaccacagcttttactggaactcgatcaagcccaatggcggtggcgctcccaccggcgcgttggccgacaaaatcgccgctgacttcggcagtttcgagaacttcgtgaccgagttcaaacaagccgcagcaacccagttcggcagcggctgggcttggttggtgctggacaatggcaccctcaaaatcaccaaaaccggcaacgccgacaccccgattgcccatggtcaaaccccgctactgaccatcgatgtctgggaacacgcttactacctcgactaccaaaaccgtcgtcccgactacatcagcaccttcgttgagaagctggcgaactgggacttcgcctctgccaactacgcagctgcgatcgcttagattgcacctgaactaatgctgctctgacagcgatcgctaacgctcggctccggtcgggcgttgcgcgttttaggctgagaaagccgc

SEQ ID NO: 378 - DNA, 2035 bp, Zea mays
  CDS (208)..(1683)
ccacgcgtccgcgaactgagcaagcttttcgacagagaacgtatccctgaacgtgttgtgcatgcacggggagccagtgccaagggtttctttgaggtcactcatgttttctccccccttctcgccttctccttctcccccctagtctagaggcgttgctccccaatcccttcggcccgcccgctcgacgtgatcccaccggcagccatggatccatacaagcaccgcccgtctagtgggagcaactccagcttctggaccaccaactccggcgcccccgtctggaacaacaactctgccctcaccgtcggacagcgaggtccaatcctccttgaggattatcatctaatcgaaaagcttgctcagttcgacagagaacgtatccctgaacgtgttgtgcatgcacggggagccagtgccaagggtttctttgaggtcactcatgatgtctctcaccttacatgtgctgattttctccgtgctcctggggtccagacacctgttattgtccgtttctctacagttgtgcatgagcgtggaagccctgagaccttgagggatccacgtggttttgctgtcaagttctacaccagagagggtaactttgacctcgtgggtaacaacatgcctgtgtttttcatacgagatgggatgaaattccctgacatggtccacgctttcaagccgaatccaaagaccaatttgcaggagaactggagaatagtagatttcttctctcaccacccagagagcctacacatgttcaccttcctctttgacgatgttggcatcccactcaactacaggcacatggagggctttggtgtcaatacctacaccttgatcaacagggatggaaagcctcaccttgtgaaattccattggaagcctacttgtggtgtgaaatgcttgctcgacaatgaagctgtgactgttggaggcacctgccacagccatgcgacgaaggatctatatgattccatcgcagctgggaattaccctgaatggaagctctacatccagactattgatcttgaccatgaggataagtttgactttgacccgctcgatgtcaccaagacctggcctgaggatatcatcccgctgcagcccgttggacggatggtcctgaacaagaacgtcgacaacttctttgcagagaatgaacagattgctttctgcccagcgattattgttcctggaattcactattctgatgataagctgctccagacgagaatcttctcctatgctgatacccagaggcaccgccttggtccaaactatctgatgcttcctgtgaatgcaccaaaatgtgcccaccacaataaccaccatgatgggttcatgaacttcatgcacagggacgaagaggtgaactacttcccttcgaggtttgatcccgcccgtcacgcggagaaggtccccattcctccccgtgttctaacaggctgtcgtgagaagtgcatcattcagaaggagaacaacttcaagcaggctggcgagagatatcgttccttcgaccctgcaaggcaagaccggttcatccagcgatgggttgacgcactgacagaccctcgcgtgacccatgaacaccgtaccatttggatctcctactggtcccagtgcgacgccgctcttggccagaagctggcttctaggctgaacctgaagccgagcatgtaagatcgacgaggaagaaagcaggcaccggtggccaaggatgcaacgcaacatggagcgtgtgatgtttacaccaatataattgaataaacaggggatgtgcgcgtcgttgtacttatgctgatgctgatggtcggtggtcgattatatatactggaacttctggtgtatgctcttctcttctggggagacgtaatgtaacgaagaagaatgtgtcattgtggcctgtggtacaaaccctgctgtgtatgggcctgtctataagaaacagcgatgagctgtgacgttatgtttctgacagtttatttactaatgagcacatctttaatttactagaaaaaaaaaaaaaaag

SEQ ID NO: 379 - DNA, 2164 bp, Zea mays
  CDS (30)..(1511)
ccacgcgtccgctagctagctgaatcacaatggatcctaccaagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggcgcctcggccaagggcttcttcgagtgcacccacgacgtgacgtcgctgacgtgcgccgacttcctgcgcgcgcccggcgtgcggacgcccgtgatcgtgcgcttctcgacggtgatccacgagcgggggtccccggagacgatccgcgacccgcgcgggttcgccgtgaagttctacacccgcgagggcaactgggacctgctgggcaacaacttccccgtcttcttcatccgcgacggcatcaagttccccgacgtgatccacgcgttcaagcccaacccgcggtcgcacgtgcaggagtactggcgggtgttcgacttcctgtcgcacctccccgagagcctgcacaccttcttcttcctcttcgacgacgtgggcgtgccgtccgactaccgccacatggaagggttcggcgtgaacacgtacacgttcgtgagcgcggcggggaaggcgcagtacgtgaagttccactggaagccgacgtgcggcgtgcggtgcatcctgacggacgaggaggcggcgctggtcgggggacggaaccacagccacgcgacgcaggacctgtacgactccatcgcggcggggagcttcccggagtggacgctgtacgtgcaggtgatggacccggacacggaggagcagtacgacttcgacccgctggacgacaccaagacgtggccggaggacctgctgccgctcaggcccgtggggaggctggtgctggacaggaacgtggacaacttcttcaacgagaacgagcagctggcgttcgggccggggctggtggtgccagggatctactactcggacgacaagatgctgcagtgccgggtgttcgcctacgccgacacgcagcgctacaggctgggaccaaactacctgatgctgcccgtcaacgcgccgcgctgcgcgcaccacaacaaccactacgacggcgccatgaacttcatgcaccgcgacgaggaggtggactactacccgtccaggcacgcgccgctgcggcaggcggcgccgcccacgccactgccgcccaggccagtcgccgggaggagggagaaggccaccatacgcaagcccaacgacttcaagcagccaggggagaggtaccgctcctgggacgccgaccgacaggaccgattcgtgaggcgattcgccgactcgctcggacacccaaaggtcagccaggagctcaggtccatctggatagacctcctcgccaagtgcgacgcgtcgctggggatgaagattgccacccggctcaacatgaagccaaacatgtgatgcttctgctgaataataatgaagacacgcatgcatgtcgtcgtcaggaacaagagaaataatacaagaccagcacgcatgggcatactctatattatagatggccaaaaagcacgaggcccgtgagcccggcacgaagcccgctttttgggcccggtccgagcacggcacggtagaataagcgggcgggcttgaacaggaaactaggcacggcgggctagcccggcacggcctgtttacctctaagcccgttaaacccgtttttttttacactaaaacgtgcttaccggcccgtttagcccgcttttcggcccgttatttcgtgctaaacgggccggcccggcccgtttaggcccgctgcgggccgggcttggacagaaacttaagcccgctggctcagcaggcccggcccggttttggccgggcttcaccggcccgtttggccatctctactctatatatatgtatagcccgtgcccgtgtccgcatttgtaccaatacaagccaagcctagtcaagtggatgtgtattattgttgcgctatcacatacatgtacccctgctacctgaagatggatgtgtatcgagttatcaaattaaggcaccagcagcaaacgctatatatatattgcataaaaaaaaaaaaaaag

SEQ ID NO: 380 - DNA, 1294 bp, Zea mays
  CDS (197)..(1063)
ccacgcgtccgcaactggaggccaatagaatcgctcgcttgcgttatcttgttcgcctcgtcagttgttgtttcctcccttcccatcccccactgctcagcagtcagtcagcactcgccacccacacgcctccgctccgcccacggttccactccaactctccgatctccaggaatccgcggctgaggcgccggcgatggcggctcccatggtcgacgccgaatacctgcgccaggtcgacagggcgcgccgccacctccgcgccctcatctccaacaagggatgcgccccgatcatgctccgcctcgcatggcatgatgctggaacttatgacctgaagacaaaaactggtggtgcaaatggttcgattagatatgaagaagagtacactcatggttcaaatgctggtttaaagattgctatcgatctccttgagcctatcaaagcaaagaatccaaagataacatatgcagacctgtatcagcttgctggagtggttgcagtcgaagtgactggggggccaactgttgaatttattcctggcagacgtgattcgtcggtgtgcccccgtgaagggcgtctgccagatgctaagaaaggtgcaccacatctgagggacatcttttatcggatgggcttatcggacaaagatattgtagctctatcagggggacatactctgggaagggctcaccctgagaggtctggattcgatggtgcctggacaaaggagcctcttaagtttgataactcatactttcttgagctgttgaatgaggaatctgagggacttttaaagctcccaactgacaaggcactgttatcagatcctgaatttaggcgctatgtggagctctatgcaaaggatgaagatgcgttcttcaaagattatgctgaatcacacaagaaactctctgagcttggcttcacgcctcgcagcacagcaccatccaaatcagatcttccaaccgccgccgtgcttgcacagagtgcctttggggtagcagttgctgcagccgtagttatcgctggctacttgtacgaggcttccaagaaggccaagtagagggcgaagttcttctccacatggctttgctttagtaagtctgaagatcgaataacaggaccatatctgaagatcgaataacggatcatataaatgagttactcggaaaatgttctgaaatccttacgaacagaacgttgccttcatgtttacactgtactcatgagtcacagtgatatggagatggcatagcctactattggaagtaaaaaaaaaaaaaaaaaaaag

SEQ ID NO: 381 - DNA, 1595 bp, Zea mays
  CDS (57)..(1397)
gcgtgagatcgaggagaagaaggcaagcaggcagagaaagagagagagagagagagatggatgaggagtacgacgtgatcgtgttggggacggggctcaaggagtgcatcatcagcggcctcctctccgtcgatggcctcaaggtccttcacatggacaggaatgactactacggaggagaatcttcgtccctgaatctaaccaagctctggaacaggttcaagggcaacgacagccctcccgagcacctgggcgtcagcaaagagtacaacgtcgacatggtgcccaagttcatgatggcaaacggcgcgctggtccgcgtcctgatccgcaccagcgtgaccaagtatctcaacttcaaggctgttgacgggagctttgtgtacaacaatggcaagatccacaaagtcccggcaaccgacgtggaggccctcaagtcgaacctgatgggcctgttcgagaagcggcgcgcccggaagttcttcatatacgtgcaggactacgaggaggacgaccccaagtcccacgagggcctggacctcaacaaggtcaccaccagggaagtcatctccaaatacggattggaggatgatacggtggactttatcgggcatgcgctagcacttcaccgggacgacagctaccttgacgagcctgcaatcgacactgtcaagaggatgaagctctatgcagaatcactcgcacgctttcaaggagggtccccttacatctaccctctatacggtctgggagagctccctcaggcctttgcccgcctgagcgctgtttacggtggcacgtacatgctgaacaagccagaatgcaaggtcgagtttgatgagagtggaaaagcgtatggagtcacttctgaaggggagaccgccaagtgcaagaagatcgtctgcgatccttcgtatttgccagacaaggtgaagaaggttggaagggtggcccgcgcgatatgcatcatgaagcatcctatcccggacaccaaggactcgcactccgtgcagatcatcctccccaagaagcagctaaagcgcaaatccgacatgtacgtgttctgctgctcctacgcccacaacgtcgcgcccaaaggcaagttcatcgccttcgtctccaccgaggccgagaccgacaagcctgagatcgagctcaagcccgggatcgacctgcttggccctgtagaggagaccttcttcgacatctacgacagatatgaacccgtcaacaaccctgacgacgactgctgtttcctcacaaatagctatgactccaccacccattttgagacgacggtcaaggatgtgctcgccttgtacaacaagatcactggaaaggagcttgatctctcagtcgatttgaacgcggctagtgctactgagcaagaagctgcttgaacaccccggcggcctctttttttgcagctctacacaatagctatttcttcgattttttttttaaaatgttccatagatggataagtttattgatgaaatccattattgtatgttttttggagttccgtttttgtcacatgcatgtaatgaacaacggtggcaatcatctataaaggttccattattcgctcgcga

SEQ ID NO: 382 - DNA, 1675 bp, Glycine max
  CDS (45)..(1418)
gaaaccctaaaccccgttttcggtgagatcgagatcgatcgaacatggatgaggagtacgatgtgatcgtgttgggcacgggtctcaaggagtgcattctcagcggtcttctctccgtcgatggcctcaaggttctgcatatggataggaacgactattacggaggagaatccacttcgctcaatcttattcagtttgaactgcgaaatgatgattttctctgtcctcctcttcagctttggaagagattcaggggagatgacaagcctcctccacatttgggcgctagcagggactacaacatcgatatgaaccccaagtttattatggctaatggcaatttggtgcgggttctcatacataccgatgttactaagtatctctatttcaaagctgtggatgggagctatgtgtttaataaaggaaaggttcataaggtgcctgcaaacgacatggaggccttgaagtccccacttatggggctatttgaaaaacgccgggcacgcaagtttttcatttatgtgcaaaactacaacgagagcgatcccaagacccacgaggggatggacttgacaagagtgtctactaaagagttgatagcaaaatacggccttgatgataacactatagacttcattggtcatgctttggcgcttcatagcgatgatcgctacttggctgagccagcactggacaccgtgaagagaatgaagttatatgcagagtctcttgcacgctttcaaggagggtcaccttacatatatcctttgtatggtttaggagagcttccccaggcatttgcacggcttagtgctgtttatggtggaacatatatgttgaataagcctgagtgcaaggtagaatttgatgaggaaggaaaggttgttggtgttacatctgaaggggaaactgcaaagtgtaaaaaagttgtttgtgatccatcatatttgcctggcaaggtgaggaaggttgctagggttgcaagggcgatagccatcatgagccacccaatccccagcactgatgattcccattcggtgcaaattattttaccacagaaacagttgggtcggaagtcagacatgtacctattttgttgttcgtatactcacaatgttgctccaaagggaaaatttattgcatttgtatcaaccgaggcagagacagatcagccggcaattgaactgaaacctggaattgaccttctaggacctgttgatgagatattttttgatatctatgacagatatgaaccagtcaacgaacccactttggacaactgctttatatcaacaagttatgatgctactactcactttgagtcgactgtggatgacgttctcaacatgtatacattgataactggaaaggttattgacctcagtgtggatcttagtgctgctagtgctgcagaagagtaaagaaaactcggtgatgatctgttgctgatgggttccgtgatgatggacttgacaacgaatgttattaacgttttataataaatattttctttttttaaaacaagatttgtgtggctggggaactttttcccgtccagaagctctgttgtgtgttcacatacattgccttctgcagtggttttagtttggtaatgtagtgttattttcatattgttaaatgttaattgcacgtctctccaaccatttcaaaaaaa

SEQ ID NO: 383 - DNA, 1696 bp, Zea mays
  CDS (463)..(1203)
cggacgcgtgggcgcggcgccggcgcgtcgggtcgtgcccatcacgttgtctccactccgtcgcctctcctctcctctccgtccctgcgccacgcgggggagattaaagcgaagcgcctccccgctcacctctcctctcgtcgtgcgttggatcaaagtatcaaaccaatctcccctcgccgtccggccggcgtgcgcgcggggcctctttttttggagccttgcgccgcggcccgttcctcctgtccgaaataatccgcctcgacgtgttcgcctccccctccccctccctctctcccctcccctcgcgactcgtctcgtgcgtgactgcgtgctcgctctccttttcgctgcgctcatctcggtatctgtgccagcgctcgcctctccccgccggcccgccctccttcctttccttgtctagccgaaggccgaagccactgcgcgcgcgtgcgtgcgacgatgtcgtcggcggtggaggccatctcctgccccaaggtcgacgtccccgccggcccggagccgggggagccggccaaggaagcggcgccgcccgcggagcactgcgacacggcgcccaacggcaagtgcgcgccgcgttgtcacggggaggaggaggaggaggaggaggacgaggaggacgaggagaaggcccccaaggccatcgacctcggtcccatggtcagcatcaaggagcagctcgagaaggacaaggacgacgagagcctgcggcgatggaaggagcagctcctcggcggcgtggacttgaactccgtgggagagacgctggagccggacgtgaagataatgagcctgtccatcctgtcgcccgggcggcccgacatcgtgctgccgctgccggtggagcccaacggcaagggcgtgtggttcaccctcaaggaaggctccccgtaccggctcaagttcaccttctccgtcagcaacaacatcgtctccggcctccgctacaccaacaccgtctggaagacggggctcaaagttgacagagccaaggagatgctcggcacgttcagcccccagctggagccctacacgtacgtgacgccggaggacaccaccccgtcgggaatgtttgcccgggggtcctactctgccaggaccaagttcctcgacgacgaccgcaagtgctacctggagatcaactacaccttcgacatccgccgggagtggccgtcgacgagctgaccatccttccctccctccatcggtggcctgagcagaccagtcgtttcgttctgtgttcttccttttctatgttgcctcgtcctgtcctgtcactaggttttttgtttgttcaccgtcagcttgttcgctgcggcttgctgcggctgcaatccggctgcggctgcggcttctacagtatttttctctctatggattgcagctgcagcagtccaaacagctgcaacagtgtcggcttgtagccagccgaacacgccccgtgttgctgcgtgcgtgacgcacggtgcgtctatgtgccctttcccatgcgccagttgtctgctgtgttgacaccgttactagacagtgcaaatgtcaggtcggtctaccggactgtgcgtgcgtcagcgtgttcaacttgtcgatcagggtctcgttttttccgaaccgcctgttgagttaagacttcagagcaatgaagctgcgttctgcgtagtaaaaaaaaaaaaaaaaa

SEQ ID NO: 384 - DNA, 660 bp, Zea mays
  CDS (13)..(408)
tagagcgccgccatggctcaggtaaggggcagtgctcgtggcactggcagtggcagcagcgccgccgcgctggcgctggtcctcctgtgcgcgctcctccgcggcgagttcgccgagtcggcggtgtacacggtcggcgaccgcggcgggtggagcttcaacaccgctagctggcccaacggcaagcgtttccgcgccggcgacgtcctcgtgttcaggtacgacgccagggcgcacaacgtggtgcccgtgagcgcggcggggtacagctcgtgcagcgcgcccgagggcgccagggcgctcgccaccgggaacgaccgcgtcacgctgaggcgcggcgccaactacttcatctgcagcttcccaggccactgccaggccggcatgaaggtcgccgtcaccgccgcctaggcactgcagggcggccaatcagccggcggagagcgccgcgctcacggagtaaagcacgtagctaattagacggtgctgccttgctgttcaataatatcgtctgtcgtcgcgtacttcataacctgcgcggcgtgttagtagttgtttggtggtgtttggcgactggcactacagagaagtgtcagatcgagtgatgtacttgctaccaacaataaaggtatacacggtttgtgtgttcacttgaaaaaa

SEQ ID NO: 385 - DNA, 724 bp, Zea mays
  CDS (109)..(489)
ccgatctgcatttcactcgttccacaccgtcgttggccggcccatagctctccccctcctggttagtgtagtgagcgcagcgacgagtgcaacggtgagagtaccgagatggctgagggaagaggcagtgcaagggccatcggcgccatggcgttcgccgttgcctgctgctactgctgcgtcgccatcgccgacgcagccaccacctactacgtcggggacagcaacggctggtccttcagcagccccagctggcccaacggcaagcacttccgcgccggagacactctcgtgttcaggtacatcccctggatccacaacgtggtggccgtggacgaggacgggtacaacggctgcacgacgccgccggggtcgcggacctacacgtccggcgccgacagcgtgacgctcgccaggggggacaacttcttcatctgcacccggttcggccactgcaacctcggcatgaagctcgtcgtctatgccgcgtgatctgtcagagctagcgactggtggtggtattgttgactgggtgcgctcaatgatcggctgtgcttgctctcgagcgaactggtctgtttgatttgtgctatttcgtgtaggctcagtcagtcgcttggttctaatccgtaacggcttctactacttttacaatgttgttgtaacaatacaaacatccagctttaattgaagctaacggatatcgcatgtttgaacaaaaaaa

SEQ ID NO: 386 - DNA, 863 bp, Glycine max
  CDS (83)..(463)
ggacacaatcaatcccattattaaagggataagccttcaaccttgcaacacaacactacaacctaaggtctgcactacgagaatgtctcagggaagaggcagtgcatctttacctattgtggtcactgtggtttcactactgtgccttttggttcttttggaacgtgctgatgcagcaacttacaccgttggaggacctgggggatggaccttcaacactaatgcttggcccaaaggaaaaagattcagagctggtgatatcctaatcttcaattatgattcaacgacccacaatgtggttgctgtggacagaagtggatacaacagctgcaaaacgccagggggtgctaaagtgttcagttcagggaaggaccaaatcaaactagcaagagggcagaactacttcatatgcaactaccctggtcactgcgaatctgggatgaaagttgccattaatgcagtgtgatggtgcttaatacttcttgagttgaagtgaaaattaagttaatggtcaattagctagcattagtaaatgttagtgtgtgctcatgtatgtactttttttatatgaagctgttatatatatttattaatcactatagttttgtgaagcaaagtgggagtgagctggcttggtagatcaattgttcctatgtttggtatgtgttgtgtagtgggagtataaaaatggtccattagtcacgggctcttcttattagacattggatctacatattttgaagttattgaaagtctcagagccaattatctgtatctgtgtgtcggtgtcacagtgtatggttctattactgattttgtttgcttcaataaattaaatttcctaaaaaaaaaaaaaaaaaaaa

SEQ ID NO: 387 - DNA, 1075 bp, Zea mays
  CDS (323)..(868)
gcattcatcactttcctgactcacctcactcgatcatcctccagtcttgtcgtcgcctgctagcttgaatattacgccagcatctcgccaggaaaatggcgggcactactccgcgccgcttgctcctggtcatcgtccccctcgtcgccgtcgtgccggcgtccgcaaaagactacatggtcggcgactcgtccgggtggaagtccggagtggactacgctgcctgggccaagggcaagccgttcgccatcggcgacacgctctgtacgtgccaaataaagctcgtcgtcagattcagatacgtacagtacagtagccgccaatgctgtgtccatgcatgcatcatgttctcgtatataatgtcagtggcacgttcgttcgatcgtccgcgtgtatatctcagtatctcgtgaaggagaaatccagtgaccccgcgcggcctgccggttcttgcgttgcagcgttccagtacagctcggcgcactcggtgctggaggtgagcgaggcggaccacggcgcgtgctcggcgagcaacccgctgcggtcgcaccagggccagagcaccaccatcccgctcaccaaggccggcacccgctacttcatctgcggcgcccccggccactgcgcctcgggcatgaaggtcgccatcaccgtctccggcggcggcggcggcggcagcagcagcgccgacaacaccgcgactccgtcgggtccctccgtgcgggcgatgaacacgaagccggcgttcggtctccggtccggtggcgcgacgacgacggacgagtcggactccagcgcggctggcagcggcgcccgcctcgcgatgggcctgctgttcggggccgcgggcctcgctgcaataatgggctgaattgaggacccgctagggaaaaggcagtgcggtttcacgaatttcctatttagtttcctgcgttctctgcttgcgtccccgagtcgcgaggctgagtgttcggccgtgcatatttttcgtatacttttgctgtgtttttttggggctattcgttgttcaatactgttgtttcagaataaaatttcatccttgaccattcaaaaa

SEQ ID NO: 388 - DNA, 1003 bp, Zea mays
  CDS (62)..(646)
ccacgcgtccgctgcaagctcatccgtctctgtcgatcagcaagaggccggggtcagaggaatggcggcgacgtcgcggctggcgctggccctcctgctggccgccttggtggcggcgtggcagctgccggcggcggcggtggcggccaactacacggtgggcgacgagaaggggtggaacccggacgtggactacacggcgtgggtgaagaagcacaagccgttctacaagggagactggctcatcttcgagtaccagaacgggcggtcggacgtggtgcaggtggacgaggtcggctacgacaactgcgacaaggccaacgcgctgagcagctacagcaagggccacacctacgccttccagctcaaggacgccaaggactactacttcatctgcagctacggctactgctacaacggcatgaagctccacgtcacagcaaagtcatcatcctcatcctcctcttcctcgtccggatctgactcctcctcctcctcctctgacgacgactcttcctccccctcgccgcccgccaagaagtccaaggccaagaccagcgccgcgccgccaccgtcactcctcgctgccacgcccatggctgccgccgccgccgccgccgctgctctgctcctcaacaggatgctctgatctggtctggtctggtctgctctgcgtatgtagtcacgtcacgtggctccagatcttgcttgggcgctgatgagctacactacactacactagtttttttcttctgcttttagtttttttccccctcaccacttgagattggggaggcatcttctgcttctagcttgcttgctgcttcttgaattgcgtgactgttattggttggttcttgcttccattattttgcctttttctttctttctttcttgcttccagcttgttgttgatgcagttttttttttcaagagacaagattagtataatgtcaagtgtgaatgaagagctctatttatttatcaaaaaaaaaaaaaaaag

SEQ ID NO: 389 - DNA, 1264 bp, Zea mays
  CDS (56)..(1105)
acttggcgggcgaaaggcgaaaccgacgtgctcccgggcgggcggcgacagcggcatggagcgagagcggcaggcagtggcgaggaacaggaaggtggtgctgcgcgggtacatcgaccgcgcgcccagggaggaagacatggagctcgtcgacggcggcgccgtggagctgcgcgtccccgagggcggcggcggccccgcggtgctggtgaagaacctctacctatcctgcgacccttacatgcgcggcaggatgcgggacttccgcaactcctacatcccgcccttcaaacctggatcacctattgaagggtttggcgtggggagggtggtcgactccactcatccaggattcagtgctggtgacgttgtttccgggatgactggatgggaggactacagtctgatcaccaagcctgaacagctcaggaagatccagcaaagcgacataccactctcctatcatctgggccttcttggcatgcctggctttacagcttatgttggattctatgagatctgttcaccaaagaaaggggagtttgtttttgtttctgctgcatcgggagcagttgggcaaattgttggtcaacttgcgaagctccatggttgctatgttgttggaagcgctgggacagatcagaaggttgagctcttaaaggaaaaattcggatttgatgcggctttcaattataaggaagagcctgacttgactgctgccctgaaaaggcacttccctgaaggcatagacatctacttcgagaacgtaggcgggccgatgcttgatgctgtactactcaacatgcgagtacatggccgcattgcggtatgtggcatggtttcccagcacggggtgactgctcctgccggaatccacaacctgttctccttgataagcaagaggatagagatgaaggggttcatccagagcgattacgtgcacctgttcccgcagttcgtcgatgacatcaccaggcattacagagacgggaagatcgtgtatgtggaagacatgagcgttgggctggagagtgggccggcttccttcgtcggtctgttcagcggtaaaaatgttggcaagcaggtcgtctgtgtgtcgcgggattgaaaggcctggattttgttccctactggccagtacccttaaataaaatcaggaaaacattattttcaactccgagaaggaccccactagccagtaccacggtcgtaaatctcaaggtcatgtttattttttctcctgtattaaaaaaaaaaaaaaaaa

SEQ ID NO: 390 - DNA, 1323 bp, Glycine max
  CDS (103)..(1128)
attcggctcgagattactccctatattaacccaacaatgcaaaacaacacactgaactctcttcactgaaacgacacacacaaaaaaaagctttagtttaggatgacccaagtgaggaacaagcaagtggttctaagagattatgtcaccggattccctaaagaatccgacatgaacattgttgaaggcaccataatattgaaggttccagaaggttccaatgatgtccttctaaaaaatctctacttgtcatgtgatccatacatgcgactcctcatggccaaggaccgttctttcggagatggctccttcacccttgcctctccattgaaaggatatggtgtgtctcaagtgctggaatctggacgtccagattacaagaaaggtgatttagtgtgggggattactaaatgggaagagtatagcttggtcccctcatctctcatacatttcaaaattgagcacactgatgtcccactttcctactacactggaattcttggtatgccaggaatgactgcttatgctggtttctttgaggtaggttctcccaaaaaaggagacactgttttcgtttcagctgcctctggtgctgttggtcaacttgttggccaatttgctaagttgactggttgttatgttgttggaagtgctggaagtaaagagaaggtggatctgctgaagaataaattaggatttgatgaagcttttaactacaaagaagagccagacctcaatgcagctttgaaaaggtactttccagaaggcattgacatttactttgagaatgttgggggcaagacacttgatgcagtactcccaaacatgaaatttcatggccgcatacctgtctgtggaatgatctcgcagtacaatcttactcagttcgatggtgtaacaaatttggcaaatctcatatttaagcgggttaaaatggaaggttttattgcaactgatttctatcatttatatccaaaattcttggagtttgtcctgcctcatatcagagaagggaaggttgtgtatgtggaagacattgctgagggccttgagaagggccctgcagccttggttggcctctataccggtcgcaatgttggtaaacaagtggttgttgttactcacgagtaaaattatataaatatattgttattctctaagctttaattccgaattttcaattttctgttggatattgaaccttgcttttatggtttatgcagtcattcttctattttgttgatagaaattactacattagtgacattttgtgataaataaaacctctaatatatgctaatttgttaaaaaaaaaaaaaaagg

SEQ ID NO: 391 - DNA, 1216 bp, Zea mays
  CDS (6)..(1079)
ccccgatggcgacgacggcgacgaaccggcgggtgatcctcaaggagtacgtggagggatatcctcgcgaggagcacatggagctgctccagggcgccgaggttcccctccgcctgacgggcgccgagccggccgggtccgtcctcgtcaggaacctctacctctcctgcgacccctacatgcggcccaagatgtcgcgcccgctgcgggagtcctacacggccgccttcgtcccgggcgacaccatcacaggctacggcgtcgcgcgcgtggtcgactcctccgacccgcgcctcgcgcccggggacctcgtctggggcatcaccggctgggaggactacagcgtcgtgacgccgcccgccaccaggctcctctccaagatctcccaccacggggtcggggagggggcgggcgtgccgctgtcctactacaccggcatcctcggcatgccggggctcaccgcgtacgtgggcttccacgagatctgcgcgccgaagaagggcgagaccgtgttcgtgtccgccgcgtccggcgccgtcggccagctggtgggccagttcgccaggctcgccggctgccacgtcgtcggcagcgccgggtcccgggagaaggtggagctgctcaagaccaggttcggcttccacgacgccttcaactacaaggaggagcccgacctcggcgccgcgctcaagcgctgcttccccgacggcatcgacatctacttcgagaacgtcggcggcgccatgctcgacgccgtcctgctcaacatgcgcgtgcacggacggatcgccgtctgcgggctcatctcgcagtacaacctggcggacggggagaaggacgccgtgcgcaacctcgccgccgtcatctccaagcgcctccgcctgcaggggttcatcgagcccgaccacaagcacctctacccgcagtacgaggcgtgggtgctgccgtacatcagggacggcacgctcgcctacgtcgaggacgtcgccgaggggctcgagagcgcgcccaaggcgctcataggactcttccacggtcgcaacgtcggaaagcagctcgtccgcgtcgccgacgacgagtgagacgcgcctcacttcgattggaccagacgatccatgtgtcactgttgctatgtttcgattccccattttcattttaataattaattgtgccaatggatgcttttgttcggaaaaaaaaaaaaaaaaaaaaaaaa

SEQ ID NO: 392 - DNA, 1165 bp, Zea mays
  CDS (47)..(1051)
ccacgcgtccgctttaacgcccgaaacgaacacctgaaactacaacatggcggatctgatcaaggcagtcgatatccgaggcggtaaaggcgagcgagatgccctcttcatcaaccctcagacgccaaagccctcgcctactgaaggacaggccctcgtccgtgtcaaagcctttggcataaaccgcatggatatagtccagcgacgcggcttttacccgcttccgcctcaagcccccgcaacgctgggcgtcgagttcagcggcaccatcgagtcccttgggcctggtgaccacggtgcctttaagcaaggtgacgaagtctttgggcttgcctacggtggcgcctacgccgagtaccttgccgtcagcacacgcatgttgctgcacaagccgtcgtccatggactttgtgacatgcgctggcatcccggaaacctggatcacggcgacacaggcactgcaccttgtgcttggcttcaccaaaggtaagtcgatcttgtggcatgctggtgcctcgggcgtgtctattgctggcatccagctgtcaaagattgccggtgcatcccaggtctttgccacggccgggtcccaggaaaagtgcgactttattacctcgaagctcggagccaccgcggccttcaactacaagacgcaggactgggcggaggagatcaagaaacacaccgacggtaacggcgtcgactatatcgtggactttgttggtgcaagctacttccagcagaaccagacggccgctgcacgggacggacgtatcgtcctcctgggtacgctgggtggtgtcaagatccccgaagccgacatctcgcagatcctgtacaagaggctccgaatcgagggcagcacgctgaggagccgggacgaggagtaccagggaaagcttcgtgaccgcctcgaagagtatctcccagactttgagtcgggcaagttgaagatccttgtggacaaggttctgccatgggaggagatccaggaggctcacaagcacatggaagaggccaagaatctgggcaagatcatatgtactatctcgtaggtaccatccataactcgaaaataggagacaactcttgacgacgccacgcttgtgttcgtcaaagcaaagaaatccatcgctttcctcaaaaaaaaaaaaaaaaaaaaaaag

SEQ ID NO: 393 - DNA, 3950 bp, Emericella nidulans
  CDS (384)..(1961)
gaattcttgaggagctagccgagtacggcactagcgctgtttccccgggatccgctggttccggagcgtgcgcggtgcctggtacaagggtagtttgcaactccggggtggtgatcatacgatatacccgttatgatttagattcagccaatattggtaagtcctttcggcagagcgctcgtctctatcgccgatcatctttgtgtgcggatggtcgtcgtgcagtactctgtaccccgttctactctagtgtcgcggcggacacggaagctagtaattccgttccgaaggcgatctcggagcccggtcagcgagtcaccgagtcacctgcaaatgcaatgcggcggccatgatccgttcacatcgccctcgtgcctgctgaaatgagtccgctgaacggcgtcgctcgttcctttccgcggcccttccaggccgtgaccaggcggccttttcgagttgtccagccggccatcgcctgtccgtccaacagccggtcgtttaaccattctcgatcattacgatcaacggggtctcagtcccccgctccatccccacgcgactcctcgaatcccgcgctgtccttcccttgcctcgacgcccaggaggccaagtccgctcttctttccgcgcgatctcttggttcaggccctgaaccctcctataccgccggccaccacgaacgattccattccgacgaaccgctgctccttgattggggcggtttgcttccagaatttgatatcgcatatgagacatggggccagctgaacgagaagaaggataatgtcattctgctgcataccggtctgtctgcatctagccatgcgcacagcaccgaagcgaacccgaagcccggctggtgggagaaattcataggtcctgggaagacgctagatacggacaagtactttgtgatctgcaccaatgtccttggagggtgctacggtagcacggggccctcgacggtggacccgtcggatgggaagaagtatgctacgcggtttcccatcctgacaattgaagatatggtgcgagcgcagttccgccttttggaccatcttggggttcggaaactctacgcgtccgtcggctccagcatgggtggtatgcagagtcttgcagccggtgttctgttcccagagcgagtgggcaagattgtgtcgattagcggttgtgctcgaagccatccgtacagcattgctatgcgccatacccagcggcaggtgttgatgatggatccaaattgggctcgaggtttctactacgattcgatcccacctcattcaggcatgaagctcgctcgcgagattgccaccgtcacgtaccgcagcggaccagaatgggagaaacgctttggtcggaaacgggctgatccgagcaaacagcctgcgctttgccccgactttctcatcgagacgtatctcgaccacgccggtgaaaaattctgcttggaatacgatgccaacagcctgctctacatctccaaggcgatggatctgtttgacctagggttgactcagcaactcgcgacgaagaagcagagggcggaggcccaggcgaagattagcagcggaacaaacactgtcaatgatgcgtcgtgcagccttacacttcctgaacagccataccaggagcagccatctgcctcgacatccgccgagcagtctgcttccgcttcagagaccgggtcggctccgaacgatcttgttgccgggcttgcgccgctgaaagaccatcaggtgctggtaatcggagtcgcaagcgacattctcttcccggcgtggcaacagcgcgagatcgcggagactctgattcaagcagggaacaagaccgtggagcatattgagctgggcaacgacgtgtctctctttggtcatgacacattcctccttgatgtcagaacgtcggaggcgcagttcgcaagttccgtactagtcggctcgcacataattgtacaatagaggtcaatgataacgaagcgtatttttcagtggactccaggagagtcgttatattttcgcaggcaagacgatgtcttaattgcttattcccggttacaatgactggggtgcgctggtgtcttcccagcggaatatatactgtggcgctaatgacaaacaaaacatttctaagccgatattgcctccgacatgaactcgaccttgacgttaaatcatacggacagaaaagaatactatctggctcaatcagtggattactgcatccagcttcactgtgaagagcagatcaagtgtcctcttatcagtcgctagcggcaggctcactttggcggttctcattctttagaggtttaaccatatagaataaccgtgaaggttgtacccaagagcagaaagggacctttgtcctcccatattcggtgcaacatcattaatatatcaatcgcaatggaaatggatttgctttgtgcgactgagtttgttgcttacattctgttgcttacaatatacctccgtacattacatggmccaattgatcactgggtwgagsggtcctccgtacattacatggaccaatgatcactggtgarcgggtgtcasctcgcggcggctgtttttccaccttcacctccccgatgcctcttcgtctaaataccgattacccttcctatcttgtgttttcgtcttcgagttactgatggagttggacaggtgaaaaggaaccgaatgaaacatattacactggcgcatgactggcgatatgacgttcacacacgattcctacactattgcgtggatatgcgccttaccgatagagttggcggcggcaaagatattcctkggacgaagttcmtcctcgacttcatcaaccaaaatcggatctcaatgtctacactcttkggagtattggcggccataatatagtggtggtctgtctccctgcggtgtctatgggacaacttcggctactgcgcggtggcatacttgaagtctacctacccgaatatccagttcgccttgacggtcggcatcggcggcggggtcccattaggaaaacctgatatacgtctgggcgatattgtggtcagcaagccatctgataccttcggcggcgtcattcagtatgattatggcaaaacggtgggcaatggacacttttaccatacaggatcgctcaacaagcctccgccgatactgctcaagacgatcgcccagatggagagtgattatatgctcggcaaaatctcactttgcaatatcatggccagcagcctgcataaagaggaagtgcagacacagtttccgagaccatcaaaagatcagctcttcaatcaacttacgaaccacgttgggaacaagtccgactgctcggcttgtgatacgagcgagctagtggatcgccctgaacgcacgacagaagagcctcaggtccactatggtctaatcgcttctggaaatcaggtaatgaaagatgcgagaacacgcgactctatcgctcaaggccggaacattctgtgttttgagatggaagctgcaggactcatggatgaaatcccgtcgcttgtaatacgaggcatctgtgactactgcgactcccataaacataaggagtggcagggtacgcagcatttgttgccgctgcctatgcaaaggcttgctcacattaattccgatacatggcaagggtgctgttcgaaatggagtcaaagaggatccgmattggatggtcccctttcgaaagaacccgggatttgttggtcgrraaggaaaatcagcaaaatcgatggattgatccaggagatccatggacctttaaaaatcagcaatctgcggactaggcagacgttggaaagacccagattgctcttgaactagcttatcgcacgcgcgaacatattctggatcccatgtacgacctatgcgagtattgaacaagcttgcgtgaatatagcccaacttgttggaatgcagggattaaagccaggggaa

SEQ ID NO: 394 - DNA, 2001 bp, Synechocystis PCC6803
  CDS (801)..(1547)
cattctcttcatctgttgttccgattcccgggtggaccccaatttaatcacccaatcggaagtgggcgacctgtttgttattcgcaacgctggcaatattattcccccctatggagcagccaacggtggggaaggggcagccatggaatatgccctagtggcgctggaaattaatcagatcatcgtctgtggccattcccactgcggagccatgaaaggtctgctcaaactcaactctctccaggaaaaacttcctctggtgtacgattggctcaaacatacggaagccacccgccgtctagttctagacaattacagccatctggaaggggaagatttgattgaagttgctgtggcagaaaatattctcacccaactcaaaaacctccagacctatcccgccatccattcccggttacatcggggagacctttccctccacggctggatttatcgcattgaagagggtgaagtactggcctacgacggtgtactccatgattttgtcgccccccaaagtcgcatcaatgccctggagccggaggatgagtacgctctccatcccaactcacccctgatttcctacgatgcgtttaaggttcccggcaaggaacgtcctggtcgtgagaaagcaacagaatccccagctccccaactgtctcctttacctggttttggccatttgcccagggaacaggcggagcgcatttatcgaggctcccgttagactgggttaaaccccattgcaacctttgtcggataaacgcaaacaatgccaattttaggtaggaattgaccggatgctgaattcactaattgctgactttaggattatttttgagcgagatcccgctgcccgcaattggttagaggtgctgttttgttatcctggcttgcaagctttactaatacatagattttctcatcgtctttatactctcgggctacctttctttcctcgcctaatgtcccaccttgcccgctttttcaccggcattgaaatccatccaggggcccagattggccagggcgtgttcattgaccatggcatgggggtagtgatcggtgaaacggcgatcgtgggggactattctttgatttaccaaggggtaactctggggggcacaggaaaagaaagtggcaagcgtcacccgaccctgggggaaaatgtggtggtgggagctggtgctaaggtattgggtaacattgccatcggtgataatgtccgcattggggcggggtcagtggtgttacgggacgtgccagcagattttacggtggtgggggtgccagggcgcatggtgcatccttccggggaaagggttaatcctttggaacatggtaagttaccagattcggagggcaaagtaattcgcctattattagaaagaattgaattactagagcaacaggtggccaccttacaacagcaacaatcggaacaggcctgggaatcggattatcgctcctgctctgaaactgaccgggaaccggtgctctgtcgccttggcgatcgcgaaattgaagaatttttggggggcaccctctgatattctcccggtagccataactgggatgggatgtggaggggcataggaggtgactatttgttggttcacttaggaattttggacagaactttggtggttaaccacacactgtcgccaaacttgccccattttgctccgagggaattttctggggttggtgttgcgggaaaagccttggcgatcgcctttttttgtcctcaatttttggccggatgttttttcctgtttaataaaatctttctaattgtcttaagatgtgaacgcaaggccgtcctcaagggcggggtttcagacccattttttcgatgaataaccaacaactttggcaacgttatcaagattggctttattaccatggtggcctcgatttttacctggatgtgagccgcatgggatttagtgatgctttggtagaagatttgcaacccaagtttgccaaagcttttcaaga

SEQ ID NO: 395 - DNA, 701 bp, Synechocystis PCC6803
  CDS (36)..(638)
tatttcaatactcaccaagttttaagcaaacagcaatgacagaggtattaagggtaggacagccggcaccggatttcaccgccacggcgatcgtcgatcaaagcttccagaccgtcaaattaagcacctaccgtggtaagtacctggtgctgtttttctatcccctagatttcacctttgtctgtcccacggaaatcattgcctttagcgatcgccatagcgaatttactgccctagatacggaagttgtgggcatctccgtagacagcgaattttcacacctggcctggattcagaccgaacggaaaatggggggcatcggcaacattaactatcccctagtgtcagatctcaaaaaagaaattagccaagcctataatgtcctcgaacccgatgcaggcattgccctgcggggactattcattattgaccgggaaggcatcttacaatacgccaccgtcaacaatctctcctttggccggagtgtggacgaaactctgagggtactaaaagccattcgccatgtgcaatctcaccccaacgaagtttgcccagtggattggcaggaaggagacaaaaccatgatccccgacccggaaaaggctaagacctacttcgagacagtggcggaaccttaggtttgcccagccaaaaatgccgaccctaaatggataattttgactactaggctgactggtgag

SEQ ID NO: 396 - DNA, 1001 bp, Saccharomyces cerevisiae
  CDS (108)..(698)
ttgttttttgctacttacattgtttatcttgaaatatccaaagtgaacactattactgttttttgctcaagaatatattagccttacaagaacgtaaaaaaccaatcatggtagcagaagttcaaaaacaagccccaccatttaagaaaaccgccgtagtcgacggtatcttcgaggaaatttcactggaaaagtataaaggtaagtacgttgttctagcttttgtcccattggctttttcatttgtctgtccaactgagattgttgcgttttccgatgccgccaagaaattcgaagatcagggcgcccaagttttatttgcctccaccgactctgaatattccttactggcatggaccaaccttcccagaaaagacggtggattaggtccagttaaagttcctttgcttgctgataagaatcattccttatccagagactatggcgttttgattgaaaaagaaggtatagctttaagaggtttgttcataatcgacccgaagggaatcattagacatatcactatcaatgatttatctgttggcagaaacgtcaatgaagctttgagattagtcgaaggtttccagtggactgacaaaaatggtacagttttgccatgcaactggaccccaggagccgccaccatcaaacctgacgttaaagattccaaggagtatttcaaaaatgccaataattaatcttcgcacgataacgctaggccctattaaataattaaaaatacatcaccctatatatgataagaaagatggttttgtattattatgaaattgacttgaaagaatagtgtaacaaaagaaaaagaaactgtaattgaagaatgatatgcatttctatgtgtatattaacttaatcatctttatatccagaagacgcaaatgaccattcgacgtatttttcccatgcaggtttgttttcgtataatctgcctgcaagatccaaataacttcctactgttaacgaatccattgagtatggtttct

SEQ ID NO: 397 - DNA, 1581 bp, Saccharomyces cerevisiae
  CDS (730)..(1512)
gattgtttaactatctcgccatatttagtgagggaagcgcgaactgtcgttgattgtttatgtgtttattttatgtttatcgttcttagagggtggcgcgcactgtgcgcgcatatgtgggccatacgcagacatatataaagaactaagaaaaggtgaaatgggactctacgatggcgctaatggtaaggtctcttttctatttgcctaattcagatacaatatataattgccaacctcaaagaagaagaattatgggcatattgaccttctccggtttccctcccgcgctctcgtatccgtctgcatttgacctcgagcaagcgctccactatgtctatatgtttaccagtaaaacttcttaacgtttgtgatattttttgaacttcaaccacattcagtatgcgtgtgtatataaagatattcctgatagcactatgtttatctttatacaatatacaaaaggtcacccaggacgagcagcgcggctatttttctatcattccgtgaatagcgaccaacggtcggcggctatttttttttttgcaattttttcgggatgggttccccggcaaaagctagccccggagatttttaattacgtaaagaaacaaggggccggatgttgctgctattggtatataaagagagaaggagagatatagaaaattgtgcttctagattctcgcagtaggatgagataaatttcaaagaagcaggaagcaaaggatgtttagtagaatttgtagcgctcaattaaagaggacggcatggacccttcctaagcaggctcacttgcaatcacagacgattaaaacatttgccacagcacctattctgtgcaaacaattcaaacaaagtgatcaaccaagactaagaataaactctgatgctcctaactttgatgctgacacaacggttggtaaaatcaatttttacgactacttgggcgactcttggggggtcttgttttctcacccagcagatttcacccctgtctgcaccaccgaagtcagcgcattcgccaaattgaagccggaattcgacaagagaaatgttaaattgatcgggctttcagtggaagatgttgagtcccacgaaaaatggattcaagacatcaaggaaatagcaaaggttaaaaatgttggtttcccaataattggtgacacttttagaaacgtggcattcctatatgatatggtagatgccgaaggattcaaaaatatcaatgatgggtcactgaagaccgtgaggtctgttttcgtcatcgatcccaagaagaagattagactgatttttacctacccttccaccgtcggaagaaacacttctgaagtgttaagggtaatcgacgccttgcaattgactgacaaggagggcgtagtaactccaattaattggcagccagctgacgatgtcattattcctccctctgtctccaatgatgaggcgaaggctaaatttggtcaatttaatgaaattaaaccctatttaagattcaccaagtcgaaataagctttgaaataaacgactttactatatacaggtatatgaagtatctctaactaaaacttttatcta

SEQ ID NO: 398 - DNA, 1001 bp, Saccharomyces cerevisiae
  CDS (103)..(750)
aaaagatatagaaaagggaagagaaatatcattgttattacatccactggatgaagtaatactacgagctttatacaggtaatattaaagttccttaatagaatgggtgaagcactacgtagatcaaccaggattgcaatatccaaaagaatgttggaagaggaagagtccaaactggcccctatttcgacaccggaagtgcctaagaagaaaatcaagacgggtcctaaacataacgctaatcaagcagtagttcaagaggcaaataggtcatctgatgttaacgaattagagataggcgatcctattcctgatttgagtcttttaaatgaagataatgactctatctccttgaagaaaatcaccgaaaataacagagttgtggtgttttttgtgtatcccagggcaagcacgcctggttgtactagacaggcctgtggatttcgtgacaattaccaggaactcaagaaatatgctgctgtctttggactgagtgcagattctgtgacatcccagaaaaagtttcagagtaaacaaaatttgccatatcatttactaagcgatccaaagagagagtttattgggttgctaggagccaaaaaaacgccactttctggttctattagatcgcatttcatttttgttgatgggaagttaaaattcaaaagagttaagatatcaccagaagttagtgtaaatgacgccaaaaaggaggttttagaagtcgctgaaaagtttaaagaagaatgaagtttaataaccccctttttgtttctctagaggagtacttatcggtaaaatattccaaacccttccctttatatatgtagataaacgaagatattctaactctctcacacttataaaatatcgagcctgcagaaggtcataaatatttatatacaaatgggaaagtacttaacgatccgacttgatcaatatcaaatatcgtggcctggtttacattgagaacgggcactatttctttggacgaaatgttg

SEQ ID NO: 399 - DNA, 1572 bp, Saccharomyces cerevisiae
  CDS (657)..(1187)
ctgatatgagcgtgcgtgtgagtgactttacacttgtctatccacgtcctgaagttgttcgtgttctttggatattcgtgttcaagctaataatgagcctttaaggtaatacaatttataaaccaccaccttggcctcgatctattgcgcttatgttgtctattagtaatcaagaaaagaaccctaaatcatcggcgtcccctgtggggctctcggaaaaaccggtcctgacgtcactgaaaagatttcggcacatggtcatgggaccagagaaaaattaatccgacatgtggaatatttccttccgttaaggtagtgagcgcggattttttctgatttgtaattatacggggagctctggccaaaaaggtcagtatttggtgatgaagttgaatatcatcttttgattttcttctgtatcattctttttctttttccacaccccttccggacggtattcacatattgttgagaggttaaatgaaaaataaaggggtggaaaattaaggacgagatgtaagggaaaagcataaacgaaacattatataaaggagcacaatttcctctcccttgccaattgtgcatataccgtttctttataacgaaatttcaacaaaccagaacaacacaagtactaccaataaccacaacaaaacatgtctgacttagttaacaagaaattcccagctggcgactacaaattccaatacattgctatcagccaaagtgatgctgacagtgaatcttgtaagatgccacaaacagttgaatggtccaaattaatttctgaaaacaagaaggttatcattaccggtgctccagctgctttctccccaacctgtactgtcagccatattccaggttacatcaactacttggatgaattagttaaggaaaaggaagttgaccaagtgatcgttgttactgttgacaacccgttcgctaaccaagcgtgggctaagagtttaggtgttaaggacaccacacacatcaagtttgcctccgacccaggctgtgctttcaccaaatccattggtttcgaattagccgtcggtgacggtgtttactggagtggtagatgggccatggttgttgaaaacggtatcgttacttacgctgccaaggaaaccaacccaggtaccgatgtgaccgtttcctcagtcgaaagtgtcttggctcatttgtagatgctatgtaatagacaataaaaccatgtttatataaaaaaaattcaaaatagaaaacgattctgtacaaggagtattttttttttgttctagtgtgtttatattatccttggctaagaggcactgcgtatacttcaaggtacccctgtgttttgaaaaaaaacaacagtaaaataggaactccgcgaggttcaggaacctgaaacaaaatcaataaaaacattatatgcgtttcgaacaaaattaaagaaaaagaataaatatagattaaaaaaaaaaagaagaaattaaaagaatttctactaaatcccaattgttatatatttgttaaatgccaaaaaagtttataaaaaatttagaatgtataaataataataaactaagt

SEQ ID NO: 400 - DNA, 718 bp, Zea mays
  CDS (37)..(522)
ccacgcgtccgcccacccgtcccctcctgctcgcccatggctcccatcgctgtcggcgacgccctccccgacggccagctcgggtggttcgacgagaacgaccagctgcagcaggtctccgtccacgcgctcgccgccggcaagaaggtcatcctcttcggcgtccccggcgccttcaccccgacctgcagcaaccagcatgtgccaggcttcatcacacaggctgagcagctcaaagccaagggtgtagacgagatcctgcttatcagcgttaacgaccccttcgtcatgaaggcgtgggcgaagacctaccccgagaacaagcacgtgaagttcctcgccgacggatctggagcgtacaccaaggcgctcgacctcgagctcgatctcacggacaaaggtctgggcgtgcgctcgaagaggttcgctctcctggccgacgacctcacggtcaccgtcgcaaacatcgaggaaggcgggcagttcacgatctctggcgctgaggagatcctgaaggcgctttagaagccgcagcaacgatcggtctagtttgaactcgcctttgaataacttgtcgttggacaaggtctagttcggtgttgtgtatggaacggtcgtcactgagtcatgcacgatttggtatccgtgtgtttatgttcgccggtttgaggaactctctgatccgtcgtgacacaaaaaaaaaaaaaaaaaaaaaaag

SEQ ID NO: 401 - DNA, 1129 bp, Glycine max
  CDS (160)..(939)
cgcgtttggctttagcatttagcattttctctctctctctctccacgctgttactttatcatataacctgactcaccccacccaatcctattcccatcccatttgaacctctccttctcgcagagtgagcgagcaagcgaatatcccaatcccacaccaatggcatgctcagccacctctgcttccctcttctccgcaaacccaacacccctcttctctcccaaaccctctctctccctccaccttaaccctctccccacgcgcccttctccctccctcacgcgcccttctctctccctcacgcgcccttctcactctcgccgctccttcgttgtcaaagcctcctccagcgagcttccgctggttggtaacaccgcaccggatttcgaagcagaggctgtgtttgaccaggagtttatcaacgtgaaactatctgattacattgggaagaaatatgttgtgctcttcttctacccgttggacttcacctttgtctgccccacagaaatcactgctttcagtgaccgacatgcagagttcgaggcactaaatactgagatattgggtgtttcagttgacagtgtgttctcgcaccttgcatggatccaaacagatagaaagtcaggtggccttggtgacttgaactatcctttgatttctgatgtcaccaaatccatatcgaaatcttatggtgttctcattcctgatcagggaattgcattgagaggattgttcattattgacaaggaaggggttattcagcattctaccattaacaacttggcaattggtagaagtgttgacgagacaaagagaactctccaggccttacagtatgtgcaggagaacccagatgaagtttgccctgctgggtggaagcctggggagaagtccatgaaaccagaccctaaacttagcaaagactactttgcagcggtgtagctaggataatagttaagagtggctatctgcatctgtatcaatcagtgaattgcaaaagggtcttgttttttttaatgttttgtaagtccttaaattttgagccgcagggtttggtaatatgcgtgctggtgtactggattttgaagtgtactatgtattaatttgcaatttctgttcattaaaaaaa

SEQ ID NO: 402 - DNA, 996 bp, Glycine max
  CDS (104)..(745)
atcctctctgtatctttggttcagcagccattagcgatttcccttatctctctccatcttaactccaagcacaagaatcatcttcccatttcgtttctgaccaatggcttccctcactgtcccaaaccattgtgttcccactttgcttcgcactcactctctcaactacccatcttcccaaaacctcccacttccttccgcgccatcaaattctcaattttttggcctcaagctatctcattcttccttttccacaattccctcttcttcttcttcactcaaaggctccattttcgccaaggtgactaaaggttcaaagccaccgaattttacgctaaaagatcagaacgggaagaatgttagcctctccaacttcaaaggaaaaccagtagttgtgtatttctaccctgctgatgagacccctggctgtaccaaacaggcttgcgctttcagggattcatatgagaagttcaagaaagcaggagcggtggttgttgggataagtggtgatgatgctgcctctcacaaggcatttgccagcaagtacaaacttccatttactttgttgagtgatgagggtaacaaggtgaggaaagaatggggagtgccaggtgatttctttggatcattgcctggaagagagacttatgttcttgacaaaaatggggtggttcagctcgtctacaacaatcagttccaaccagaaaagcatattggtgagaccctgaaaatacttcagagtctttgagacattctgattcttttgttggctatcttagctggcctgattcagagtcagacaagtatgtaactatgaattgtaagtttgtaaccactgtaattatgtagctgattttggagcctttgatcacattcacatgggggtgatgatatgtattctcctatagagagcaaacatttataacctctccggatggaataatgccttcatttgccacaaatacaatcagattatatctgtatcttttgcaaaaa

SEQ ID NO: 403 - DNA, 972 bp, Zea mays
  CDS (117)..(836)
aagcgcttcgcaagcacaggcagtgatcggcaaccaaatccggacagtcttgagctctctcagtctcagcatttcagttcccagattcacatagccccagccccacaagtagcgaaatggcagctgctccgttcgcgattgccggccggctctcccccgttgcgcgcctcccggtccgcgcctggaggccggcgcacgggtttgcgtcgtccgggagagcccgctcgctcgccgtggcgtccgcggcgcaggagaacagggacaacagtgtcgacgtacaggttagccagaacggcggcaacaggcagcagggcaacgccgtgcagcgccgcccgcgccgcgcgacagcgctcgacatctccccatccccgttcgggttagttgatccgatgtcgccgatgcggacgatgcggcagatgctggacacgatggacaggctgttcgacgacgccgtggggttccccatggggacacggaggtccccggcgaccaccggcgacgtacgcctgccgtgggacatcgtggaggacgagaaggaggtgaagatgcggatcgacatgccgggcctcgcgcgcgacgaggtgaaggtgatggtggaggacgacacgctggtcatccgaggggagcacaagaaggaggagggcgcggagggcggcagcggtggcgacggcgacgggtggtggaagcagcgcagcgtgagctcctacgacatgcggctggcgctgccggatgagtgcgacaagagcaaggtgcgggccgagctcaagaacggcgtgctcctcgtcaccgtgcccaagaccgaggtggagcgcaaggtcatcgacgtgcaggtccagtagacaaactgagctgtcacgacgggtctttgtgtagcactagcgtgggttgggctcttcgcgccgaccgtatcagtactcgtgacccaacgtgtggaataatgtgaataaataaacgcttcaattctgctattcc

SEQ ID NO: 404 - DNA, 1014 bp, Zea mays
  CDS (79)..(732)
caccacaacagcgaaggagaaagcagaccaacctagccacccagggagaaaggccaaaagggaggggagagtgtcgtcatggcttccattgtcgcttccaggagggccgttcctctagttcgcgctctggagaagctcatcgcagcgtcctccgcgcccgggactggctccgccctcaggccggtggcagtcgccggcggcctccgtggctacaacaccggcgctccgctccgacgctacgagggggccgagtcggaagacgatagcgtccgcgagtacgatgggcggcacggcggccgggactacgccgtgcccagcctgttctcagatattttccgtgatccgcttagtgcgccgcacagcattggccgcctgctgaacctgatggacgacttggcggtggcggcgccaggtcgtgcggtgcgccgtggctggaacgcgaaggaggacgaggaggcgctgcacctgagggtggacatgccgggcctggggaaggagcacgtcaaggtgtgggcggagcagaacagcctggtgatcaagggcgagggcgagaaggaggatagcgaggacgaggccgccccgcctccgagatacagcggtcgcatcgagctcgcgccagaggtttacaggatggacaagatcaaggcggagatgaagaacggcgtgctcaaggtggtcgtgccgaaggtgaaggagcagcagcgcaaggacgtgttccaagtcaacgtcgagtagatgtttccaaatagaagcaagtgccggtacgggatggaggattggagcctggaggggcactgccaaactaggattcctctctctcaatctgatctggattctggaatcagatttctcttctttcatttttctcgtctatcttctatcagtatgaaataagcaacgtcgcttcagttttcgtgtcaaggccggtggagtcgcctatgtttattttattttctttgtatttcctacctggacacacgttctctatgccgtgtttggtttccgcagattttt

SEQ ID NO: 405 - DNA, 943 bp, Zea mays
  CDS (112)..(735)
ccacgcgtccgacactgggtaggaagagcgcagaaaaaggaagcagcagctttgatcgggtggagtttcttgctcactgatcgtcgagtgaagcctttgtggtccgtgacgatgtcgaggagagccgcagcgttgttgctcgcgtgcctcgtcgccgtgacagcggcggcgctggcggacggcgcgctgctcccgtggttcggcgacggccggcgcgggctcgacgaggcagcggtgaccgacgtgggcctcctggcggccgacccgttccggatcctggagcacgtccccttcggcttcgaccgggacgacgtggccatggtctccatggcgcgcgtggactggcgcgagacccccgacgcgcacgagatcgtggtcgacgtgcccgggatgcgcagggaggacctcaggatcgaggtcgaggacaacagggtgctgcgcgtcagcggcgagcggcggcgcgctgaggagcgcaagggcgaccactggcaccgcgaggagcgctcctacggcaggttctggcgccggttccgcctccccgagaacgccgacctcgactccgtcgccgccagcctcgacagcggcgtcctcaccgtgcgattcaggaagctggcgcccgagcagatcaagggcccgcgcgtcgtcgggatcgccggaggagacggtggcgccgaggcgaaggagagcatcggaactggcgccggagatggtcatcagaccaagaaggtggagctctgaacagtgaggtgggaattgggatgactcaatgacggagatggctctgcgcgtgtgcgtagttttactagtttatgtgttcgcgtttttcttttttgtgacagcgtatatgcacttgtatggagtggaagtgtgccatgttttactgaggaataaaaacctacagtactagtgtactaaaaaaaaaaaaaaaaaaaaaaaaaaaaag

SEQ ID NO: 406 - DNA, 937 bp, Zea mays
  CDS (28)..(690)
cggacgcgtgggtaaacgtcgaccattatgggaccttacagcaccgccgtcgccgtaagcgcatcgccggtcctgcaggcttcctcactcttgacgcgagcccgtggttcttggaggcccacggtggcggcgttgcggctttctgcttccgtgaaatgccgtcggcgggcactcaccgtgacctgtgcgctcccggagaaagaacggccggcggcattcaacatcccgcccactgctctgctgtgccccgtgcccccgccggacggcaaggaacggtgggacatcaaggaggaagatgaccgcgtcacgctgtggctccaggtgccagggctgtcggcgagcgacatcgaggtgaccaccagcgaggacgtcctcgagatcaaacgcagggtcgtcgccccacagcagccggcgcccgtggacgcgcacggcgtcggcgcgttccacatccggctgctgttgaccaaggagtacgacggcagcaacgtcacggccgatctcaaggccggcatgctggaggtcaccgtccacaagaacccgcaacgccccggcgaacgcgccgtgatgatgggggcgaccaagcccccgcccgagccccgtcaaaacgaggagagcagtaccaaccaaaggtcctcgaccgcaagaaaggaaaccggaacccccatggggagacaaaatccaaatggagtctagctggttgagggctcggaccctgctttgaataagcttctcatttctagctgcggatggactcaaaccagcaatcgccttctgttatatcaattgcctggagagagcttacgctgcttgtagtatcatgtgtgtttccttaaaaaaacccttctttgtttctttatttattatgagggtttttttttggtgtgcggtcacacagagtgaaaacaattccattttctaagcaaaaaaaaaaaaaaaa

SEQ ID NO: 407 - DNA, 862 bp, Zea mays
  CDS (103)..(597)
ccacgcgtccggaatcacacaacagcagctcaaaaaacccaacacacctcaacaagcagagcaaagacccgggattcgccggcgcggtagcgagagcgagagatggacgggaggatgttcggtctcgagacccccctgatggtggcgctgcagcaccttctggacgtgcccgacggcgacgccggcgcgggcggcgacaaggcgagtggtgccgcggcgggcggcgggcccacgcgcacctacgtccgcgacgcgcgcgccatggcggccaccccggccgacgtcaaggagctcccgggcgcgtacgcgttcgtggtggacatgccggggctgggcacgggcgacatcagggtgcaggtggaggacgagcgggtgctggtgatcagcggcgagcggcgccgggaggagcgcgaggacgccaagtacctgcgcatggagcggcggatgggcaagttcatgcgcaagttcgtgctgccggacaacgccgacatggacaagatctcggcggtgtgcagggacggcgtgctcaccgtgaccgtcgagaagctgcccccgcccgagcccaagaaacccaagaccatcgaggtcaaggtcgcctgaggtgggactaggtcgaccgatcgtggctctgaagatgtgggagcagtgccagcgagttgtgaggacctctacctgtgtggaatgtggcgaggaataatcgtagtctgtagtgggggtgcttctggtgtgcgtgtttgcttccttcggtcgcggtgtctgtctaccaattcctatctgatgtatcggcttcggtttcgtatgaaccatgccggatgctttcagtaaaaaaaaaaaaaaaaaaaaaaaaaaaaaaaaaaaaaag

SEQ ID NO: 408 - DNA, 958 bp, Zea mays
  CDS (229)..(690)
attcggctcgaggagagaagtccagacgattcagcgaccgctcttgacgaagctataaaagcgtcaccccacaaggccacaactcgtcccaacccaatcccaatccagagcgaagatcgcgatcagagcaggagcaggcaacgcgcaccgaaatcttccaatccacaagactcgctacttcgcagttggcagactcgcccgcagcgagccgctagcaaccaagcagaaatgtcgctggtgaggcgcggcagcgtgttcgacccattctccgtggacctcttcgaccccttcgacagcgtgttccgctccatcgtgccgtcgtcgtcgtcggcggcggcggcctccgagaccgccgccttcgccagcgcccgcatcgactggaaggagacgcccgaggcgcacgtgttcaaggccgacctccccggcgtgaagaaggaggaggtgaaggtggaggtggaggacggcaacgtgctgctcatcagcgggcagcgcagcagggagaaggaggacaagggcgacaagtggcaccgcgtggagcgcagcagcggccagttcgtgcggcgcttccgcctccccgagaacgccaagaccgaggaggtgagggccgcgctggagaacggcgtgctcacggtcaccgtgcccaaggccgaggtcaagaagcctgaggttaagagcatccagatctccggctgaagaagacatggacgcgaggtgaatggtcgcgtcgcgttcgcgtcgcggcgtcgggtcttgggtttcagcgacgcgactcgtgtgtgtggtactgtggttgctctgctttggtatgtctggtgtgtacgtgtgctgttcagtgtttcgtggtcatcgtctgtacattgtgctgttcggtgagctccccgactcagtgtgttgtgttctgcgagtgaataaataaaaacaaaccagctgtcgtctcgtgtaaaaaaaaaaaaaaagg

SEQ ID NO: 409 - DNA, 904 bp, Zea mays
  CDS (73)..(696)
cttgctgatcacagctagtagggagcgagagttaccttgaaatcaaggcagtacgtacgagtacgatcgacaatgtcgacggtcacttcttgcacctttctgagcctcgggtccccagtgcggccggcagtctcctccgcgagaccggcggcggcggcggtggcttcccgacggaggccccggtccctttctgtgtgctgcgaggccggccggaaaggggatcacaacccaaagacggatctgcatccatttaacatccctgccttcgttctggtgcacccggtggcaccacgtgaggaacggtggcagctggaggaggacgccgacaaggtgaacctgtggttcgaggtgcctgggcagtccaaggatgacctcaccgtggagatcgacgaagacgtgctcgtcatcaagaagaggaaggagctggtgggccagcggagccctgctggcggtggcgtcgcagagtacggctcgcagtcccagcagcagagcaggaggggcaccgcagatggcaaggagctgccggcggcacagcagggccaggccggcgaggtggtctatgcccggatgctcctcccggcggggtacagcagggatggcgtgcaggccgagctcaagtccggcgtgctcagggtcactgtcgtcaaggtcacggagcgagcgcgcaggaagatcgacgtccccattcaagtcaagtagatatgcgtgtatgtgtatgcacattcgtcctgcgcacgtgtcagcaggggtgctttatttacatctgtctcatgtccaacatgcagactacagcggtcgatctcaccacgtactcgatcgcgtcgactacacatgttcatgggctttgtgttcccatgtactcatcaatcaataaaatgagcatatgtgttctccgccaaaaaaa

SEQ ID NO: 410 - DNA, 3598 bp, Saccharomyces cerevisiae
  CDS (508)..(2904)
cttccgagacgttgcatcaaaggccaagacatggcattagtcacccttgttgcaacgatagacgcatactacggacccctcaaacctccctacctgcccgtcgctatcgcattaattttctttttttccactatttttccggcccgccacacctccgactacaagacgccacatctacgttttgtcacacaaaatccaggacaatagccgtctgcaaggcaccaaggttttcagcagttgcttgttgctgctgcctgttaatcacatcaaacccactgcaagggcagtcgatgggtctgtaaacgccttagcaatcgttgttgaagaaagagagctcttatcatcatggggtgcccatcatttttctttttttttcaaattttgggctattcaatgaattgtttcgactatatatggacaatcatcggaagctgtgtattcttggtaaaaagttttcgactgtgtggcagaaaataaccgcaacaattatataacgtcacagaacacatgagtaccatttatagggagagcgactcgttggagtcggagccctcgccaacgccaacaaccattcctatccagatcaatatggaagaggaaaagaaagatgctttcgttaagaatattgacgaggacgtcaataatctcactgcgactactgatgaggaggaccgcgatccggaaagccaaaaattcgacaggcattccatacaggaggaaggtctcgtttggaagggcgaccctacatacttgcccaattctccatatcctgaagtgagatcggcggtgtccatcgaggatgaccccaccatccgcctcaaccactggagaacgtggttcttgaccacggtgtttgtggtagttttcgccggtgttaatcaatttttttccctgagatatccatcgctagagatcaacttccttgttgcacaagttgtttgctacccaattggtaggatactggctctcttgcccgactggaagtgttctaaagtgccatttttcgatttaaacccgggcccatttaccaaaaaggaacacgccgtggtcacaattgccgtggcgcttacttcctctactgcatacgctatgtacattttgaacgcccagggaagcttttacaacatgaaacttaatgtcggatatcagttcttgttggtttggacatctcaaatgattggttatggtgctgcaggtcttaccagaagatgggtcgtcaaccctgcaagctctatctggcctcagactttaatttcagtgtccttgtttgattcgttgcactcgagaaaagttgaaaagacagtcgcaaatggttggacgatgccccgttacaggttcttcttaatcgtccttatcggatcgttcatctggtattgggtacctggattcctctttaccggtctgtcctatttcaacgttatcctatgggggtcgaagacaagacacaatttcatcgctaacacaatctttggtactcaaagtggtctcggtgcgttgccaattacatttgactacacccaggtttcccaagccatgtccggctctgttttcgccacaccattctacgtctccgccaacacctatgcatcagtgttgatattcttcgtcatagtgctgccatgtctttattttacgaatacctggtatgccaaatacatgcccgtcatttcaggttctacttatgacaacactcaaaacaaatacaacgtaacaaagattcttaacgaggattattccattaatcttgagaaatataaggaatactcaccggtattcgttccattttcctatcttttgtcgtatgctttaaattttgccgctgttatcgccgtttttgtccactgcatcttataccacggtaaagatattgtcgccaagtttaaagaccgtaaaaatggtggcactgacattcacatgagaatctactccaagaactataaggattgtcccgattggtggtatttacttttgcagattgtcatgatcggtttaggatttgtagcagtgtgctgtttcgatactaagttcccagcttgggcatttgttattgcaatattaatttcccttgtaaatttcatcccgcaaggtatcttggaagcaatgactaaccaacacgtaggtttgaatattatcacagaattgatctgcggttatatgctgcctttaagaccaatggcaaacttattattcaagctatacggatttattgtcatgagacaaggcttgaatttgagtagagatttgaaattagccatgtacatgaaggtttcccctcgtttgatctttgccgttcaaatctatgccactatcatatcaggcatggttaacgttggtgtccaggaatggatgatgcataatatcgatggcttatgtaccaccgatcaaccaaatggcttcacttgtgctaatggtcgcacggttttcaatgcttccattatctggtctttgccaaagtatcttttctcatcagggcgcatttataatccgctgatgtggttcttcttgattggtttgctattcccactagccgtttatgctgttcaatggaaattccctaaatttaaatttgctaagcacattcatactcctgtatttttcacaggcccaggtaatattccaccaagcacaccttataactactcattattttttgcaatgtcattctgcctaaacttgataagaaaaagatggagagcttggttcaataagtacaatttcgtcatgggggccggtgttgaagcaggtgtggcaatctccgtcgtcatcatcttcttgtgtgtacagtacccaggtggtaagctcagctggtggggaaacaacgtttggaaaagaacgtatgataatgattataaaaaattttataccttaaagaaaggtgagacatttggttatgataaatggtggtaatcatgaaaacataataataaacctgcagaggttcatatcaagttttaattcaaaatttggcacacgtaatagcaaactttagttcatattctgtaatattaagaaattattttcttttctgtcatcctttcatattgcttaacttgaaatactttatctcaacgtttaattatactgttaataatgatatttctatattttagagcacattttggtcgaaacattcaaagcgacccctgcaatatttagcggaggcatctcatccgccttatttttgtaaattaacgatctttagcgcatgccaagtgttcgataacaaattccgactttaagaaaaaacgggcacgagcatacaataaaaaaacttttaaaatttatacctccttgaggtgttctattttatgatagatccgtatttcagataccaaatgttatatacacttttttaagcttggatttttttctgaatacacggaccttacaaatgctataaaaaaaaaaaagattctgtaacttgtaaaattaagggccctaaagggccatatccacctcacatttcactgtgatataagtaggatattttgacttcaatacttaaatttacaagccaaatattttattatgacttcaaaaaaaaaaaggcttctagcattcagaaataatgctgactgtgaaaacaactataactaca

SEQ ID NO: 411 - DNA, 2025 bp, Zea mays
  CDS (220)..(1779)
cggacgcgtgggctctcctctgctaggcacttgtcacaggaaggccccctcgtgttcgcgtcctcttgccttcacacccgggacgggagttccttgctagggggagagcttcccttgctcgtgtcctcactcacgcactcacagactcactcattcaccgacggtcccagtggactgaggtgagacttcggtcggagccggccggacggaacatacaggatggccgccgcgccgccgcccaaggccgacgagctccagccgttcccgcccaaggagcagctgcccggcgtcgccttctgcatcaccagccccccgccatggccggaggccatcttgctagggttccagcatttcgtcgtcatgctgggcaccaccgtcatcatacccagcgcgctcgttcctcagatgggaggcggaaatgaagagaaggctcgggtggttcagaccatactgttcgttgctggcataaacaccctgttccagacgttattcgggacgcgccttccggtcgtgatgggcggctcgtacgtcttcgtcgggccgaccatctcgatcgtcttggctggacggtacagcaacgaagcagaccctcacgagggcgctctcctcgttgcgtcgacgattcagatcatacttgggttcagtggcctctggcgcaacgttgtcaaattactgagtccgctggcagctgttcctctggtatcactggtcgggttcgggctctacgagcttggctttccaggggtagcgaaatgcgtcgaagttggcctcccagaactgctcctgttggttgtgttttctcagtatctgcctcaggttctggacttcggcaagtccgtcttcagccggttcagcgttctcttcaccgtcgccatcgtgtggctgtacgcctacatcctcaccatcggcggcgcttacaagaactctccgcccaagacgcaggtgcattgccgcgttgatcggtcgggccttatttcaggagcaccttggataagtgttccctatccctttcagtggggtgctccgacgtttgacgccggagaagctttcgctatgatgatgacttcgttcattgctcttgtagagtcaactggcgccttcatcggtgcttcgagatatgcgagtgcaactatgattcctccatcgattatcagtcggggcgtgggatggcagggcattggtctgttgctcgattcatttttcgggacagcgaacgggacatcggtttcagtagagaatattggactgcttgcgttgacacgcattggcagccggagagtggtgcagatatctgcaggcttcatgattttcttctctgtccttggaaaatttggagctttgtttgcgtcgattccgctgcccgtatttgccggcatgtactgtctcttcttcgcatatgttggtggcgttggcctgagcctccttcagttctgcaacctaaacagctttaggaccaagttcatcatggggttcgctttcttcatgggcctatcggttcctcagtacttcaacgagtacacagccgttgcaagctatggtccggtgcacactggcgccagatggttcaatgacatgatcaacgtgccattcacgtcgaagccgttcgtcgctgggttggtagcctatatcctggacaacaccctccaggtaaaggagagcgcggtgcggaaggacaggggcaaccactggtgggagaagttcaggagcttcaagaaagacgcgaggagccaagagttctactcgctgccgttcaatctgaacaagttcttcccgtcggtctgatctcaaatggcgccgccgctgaatcaattctggaagcaacccttgttcatatgggcgttaatgaggaacataattctgctggtctggccagtggaagcttctgtgtctccattgttggtcaattttgtgtgttttcggacgagatgggagtaattgaactgtagaaattattacgattgaagtatatcgcgttctttttgtaatctaaaaaaaaaaaaaaaaaaaaaaaaaaaaaaaaaaaaa

SEQ ID NO: 412 - DNA, 2071 bp, Zea mays
  CDS (34)..(1632)
ccacgcgtccggaaagggaaggcgaggaggaggatggccggaggaggggcggcgacgccgccgaagcaggaggagctgcagccacacccggtgaaggaccagcttcccagcgtgtcctactgcatcacaagcccaccgccctggcctgaggctgtcatccttggattccagcactacattgtgatgctgggcacatccgtcatcataccaagtgctcttgttccccagatgggaggaggaaacgaggagaaggcccgggtgattcagacgctgctgttcgttgccggcatcaacaccctatgccagtcattctttgggactcgcctcccagcggtgatgggtggatcctacaccatcgtcgcacccaccatttccatcatcatggccggccgttacagcaacgaagcagaccctcgtgagaaattcttgcggaccatgcgaggaacacaaggcgctctcatcatcgcgtcgacaattcagatcgtgcttggtttcagtggcctttggcgcaatgtcgttaaattgctgagcccattgtctgctgtacctctggtttcgctagctggatttgggctatatgagctaggttttccaggggttgctaagtgtgtggaaattgggcttccggaaatcatcctaatgctcatattttctcagtacttacctcatgctgtccatgcggcaaagcctgtgttcgaccggttttctgtgattttcacaattgcgattgtatggctgtatgcgtacattctcacggttagcggtgcctacaagaatgcccgaacaaagacacaactccattgccgagttgaccgctctggacttgttggtggagctccttggattagtgtcccatatcctttccaatggggggccccaacatttgatgctggtgaatcatttgcaatgatggtggccgcatttgttgctcttgttgagtcatctggggccttcattgctgtgtcaagatatgcaagtgcgactatgatacctccttcagttcttggtcgtggcattggttggcagggcatcggtactttactgggtgcgttttttgggacagctaatggaactgcagtgtcagttgagaatgctggtctgcttgctttgacacatgttggcagccggagagtagtccagatatctgcaggcttcatgatcttcttctctgtccttgggaaattcggggcgatctttgcttcaatcccactgccgatattcgctgccctgtattgcattctctttgcatacattggtgcttgtggcctgagcttccttcagttctgcaacctgaacagcttcaggaccaagttcatcatggggttctccttgttcatgggcctgtcagtaccccaatacttcaacgagtacacgtccgtggctggctatggccccgtgcacaccggcgcccgatggttcaacgacatgatcaacgtgcccttctcgtcgaagccgttcgtggctgtgctggtggccttcttactggacaacacgatccaggtgcgtgacagcggcgtgaggagggacaggggctaccactggtgggacaagttccggagcttcaagacggacagccgcagcgaggagttctactcgctgcccttcaacctcaacaagtttttcccttccgtctgatcctgcagggtctgcacactcttcctcgcagccgcagtagctcgggctggagtcaggcaagaaatgatcctatgcagatgatgctggagcatggactgatggcgttttgtacattcaggggtgaactgaactgtgcaggttgcaggggatagtgctctgggtagcatcagtattccctagtaaccgaaattgaaaaggccgcctgttaaacttctgcaaacactagcatgattacgtctcctagtgctactgttgtttagattggaaaacatggaactcaacggtaagcatagatttaccttgaagcaacccttttcttttgcttagaaagaatttgtgttggggatttttttttcaccatgtaagaactgagagcacttagattacaagggagggtgaataggtgatcctgcaaaaaaaaaaaaaaaaaaaaaag

SEQ ID NO: 413 - DNA, 1700 bp, Zea mays
  CDS (77)..(1414)
tcgtcctcctccgtcgggccggaggagcgtctctttgtcggcgcagcgtgcagagcaccgcagattcagagacacgatgatgtcgcgacagtgtgcaaaccgcatctttcttaccggaggttccagcttcctccatggcctcaaatctagagttgcatccagtaggagtcacggcaccgtcagactcaactggcgctgcgtgagaactaatctctggagggccgagcgccttggtgtcaaggctactccgtctgagcatatcattgcagtactgcaagcgtcagatattttcagtggcatcaggaaatggagcaagttgcaattggtcgccatgacaggggtgatggcatgtgtagttctggtagtcccttcttctgatgcagtcgatgctctcaagacatgcacttgcctgctaaaggaatgcagaatagagctggctaaatgcatagcgaacccatcctgtgcagcaaacgtagcatgcttgaacacgtgcaacaatcgacctgatgaaactgaatgtcagataaaatgcggagacctgtttgagaacagtgtagtcgatgaattcaatgattgtgctgtttcacgcaagaaatgtgttccaaaaaaatccgacgtcggcgagttccccgtccccgatccatcttcgctggttaagagcttcaacatggcagattttaatggcaaatggtacatttcaagtggcttaaacccgacgtttgacacattcgattgtcagcttcacgagtttcatgtcgagggagacaaattgatcgcgaacatcacatggagagtccgcaccccagactctggcttctttaccaggtcaaccgtgcagcgttttgtgcaggacccatcgcagcccggcatactctacaaccatgacaatgagttcctgcactatcaagatgactggtacattatctcatccaaggttgagaacaaggatgacgactacatatttgtgtactatcgtgggcgaaatgacgcatgggatggttatggtggttctgtattgtacacaagaagtaaaactgtacctgaaacaataataccggagctggaaagagctgcaaagagcgtaggtcgggacttctcgacgttcatcatgaccgacaacacctgtggtcctgagcctcctcttgtggagagaatcgagaaaactgtggtggaaggagagaagaccatcgtcagggaggtgaaggagatcgaggaggaggttgaggagctggagaaggaggaggcgtcactgtttcagaagctggcagaaggtctcatggaggtgaaacaggatttcatgaacttcttgcaggggctgagcaaggaggagatggagctgttggatcagctcaacatggaagcgactgaagttgagcaagtcttcagccgtgcactaccgttgaggaagctaaggtagctgcagagcaaaggacttggagaaaacaagccatcaagtactggccgaaacggattctatttgccacagcagtacccacagtagagattgttgaacagatacaacaaacatttttaattttcttttctttttcttttcttttcttttcttttctttgtttacccttttctgtggtcaaaacacatgcctacgttagccctatttgtaaagcatcaagagacaacgtaactttttcttgccaaacagagaaaaaaaacaagtgtacttaagactaaaaaaaaaa

SEQ ID NO: 414 - DNA, 1289 bp, Oryza sativa
  CDS (51)..(1070)
ggcaatcgctccacttgtcgcctatatacgccttggcctctcggcgtccgatgctagtggtagtggcccgcaaatcctcctcctccgctcgcgtcgccgcccaccaaacccgatcccaccgcgccgcgatgccggccggccagccgcacgcgcacgagcccgacggcggcggcgcgagccaccgccggccccagtcgccgccgtcgctccccgcggaggtggtcccggcgttcgcgccgccggagtcggaggacgaggagtcctgggtctggtcccagatcaaggccgaggcgcgccgcgacgccgacgccgagccggcgctcgcgtccttcctctacgccaccgtgctctcccacccctccctcccgcgctccatctccttccacctcgccaacaagctctgctcctccaccctcctctccacgctcctctacgacctcttcctggcttccttcaccgcgcacccctccctccgcgccgccgtcgtcgccgacctcctcgccgcccgctcccgcgacccggcctgcgtcggcttctcccagtgcctcctcaacttcaagggcttcctcgccatccaggcgcaccgcgtgtcgcacgtcctctgggcgcagcagcgacgcccccttgccctcgccctccagtcccgcgtcgccgacgtcttcgccgtcgacatccaccccgcggccgtcgtcggcaagggcatcctcctcgaccacgccaccggcgtcgtcatcggcgagaccgccgtcgtcggcgacaacgtctccatcctccaccacgttacactgggtggcacaggcaaggctgtcggtgaccggcaccccaagattggggatggtgttctgattggcgccggggcgacgattcttggcaacgtcaagattggagccggggccaagattggtgccgggtcagtggtgctgatagatgtgccggcgaggaacacggcggtggggaatccagccaggttgattggcaggaagaacggtgaggttgagaaggatgaggacatgcccggggaatccatggatcacacatccttcattcgacagtggtcggactacaccatttgagggcgacgcgccgaggtctatttctcttcctctctgtataatccgtagtgttgatatgccaaaaactgatgtacttgtcgtgctttgggtaatctgtactgtagtgttgtatcatcagccgttttatcagtcgaatgcccatgctcatgtactgataactggtgattgatgaaatgatgagtcaaataaaagttgtataacttttgattttaaaaa

SEQ ID NO: 415 - DNA, 1696 bp, Oryza sativa
  CDS (131)..(1192)
ttcgctctcgtccccttccctctcctctctcgctcgctcctcttccgcggcgcgcgcgccggcgactcgccgcgtcgggccggccgacaaccgccgcgagggagaagccccctccccttggggggcacccatgacgtcgtgcgggtgcctggtgctcgagaaggtggaggaccacggcggcgaggcggcggggagggggagagggaggctcgcgcagggtggcggcggcggcggcggtggctgcggatcgtgcgcgggggagtggaggagccggtcggagaccatgttccccatctacgtgatggggagctcgcgggccagctccgccgcggcggcgcggggcatagtcgacgccgccggggaccccatatgggaggccgtcaagtcggaggccaagtctgaggcagagaaggaacctattttaagtagcttcttgtacgccagcgtactatctcatgactgtctcgagagggcgttgagtttcgtccttgcaaacaggctcgaagatccaacattgcttgcaactcagttaatagacattttcaatgatgttatgatgaacaacaaagatatacgccgttctattcgccttgatgctcaggcctttaaagacagagatcctgcctgtgcacaatacagttgggcattgttgtacctcaagggttaccattccgtgcaatcctataggatagctcatgtattatggaatcaaggtcgtaaagttctggcattggcactgcagagccgtatcagtgaggtttttgcagtggatatacacccagcggccagaattggagagggaatattgttggatcatggaacgggtctagttattggtgaaactgccattgttggaaactgggtttcattaatgcagggtgttacacttggtggtactggcaaggaaaatggagatagacaccccaagattggtcagggggctcttcttggagctggtgctactatcctcggcaacataaacgtaggcgaaggtgccatgattgctgctggttcccttgttttaaaggatgtacctccccacagtatggcagtaggaaaccctgcaaaggtagttgggtataaagataaggaagacccttctttaactatgaaacatgatgccagaagagattattttgagcatgttgccgttagtttttcagatgacaaagctaatggaagtgttgtgaagtaaaaaaaggttcgatgatgtttggctggcagttcaaaggaatagcatatgtttcgacatttcttcccagaggacagcactgggtatctgattatgcaagggtgcttctcttttttgcccaggtacccatggtcctgaagctccccagttatattttctcgtggcctttggaccgctgtaataatgtgatgtttatttttctggttactttgtaaggactatgtactggtagtggagaccagtacatagttgctactggtagtagagaccagcagcaactatgtacttcagaatacaagctttcttttttgaatcccagtagcatcagcgtagtgcttaagacttagtgcaagctttcttttctgaatcagtagcgtgaagtatattctacagtactagcctattaggtaaagatgtttttcttttgatgtactaacccatcagaaaaaaaatgttacatctggatgggataataaaaaaggaggcaattgttaaattcaaaaa

SEQ ID NO: 416 - DNA, 2078 bp, Zea mays
  CDS (134)..(1873)
tcgctcgttttggaattaactttatgctaacagaatctaggtgtcattaagctagattaagcttgctgcttgacttagtagtgtaaatctgtaaagaaaattacctggtttgggtttagtctctataaaagaaatggaacagaggaatgttctggcattgggtgaacatgttctaaaagctactgtttggaagcggaagcataagactgctatggagcaccctgaaggcaatgatgtgatggtgttctctcagcatgatcaaagaaagcaccctgtgatatttgacgacagagctaaatgtaagaagtctaaattaatttcctgtgggagtggagttatattggagtcatattggaactttaagacaagtgggctgcctgtgcgcgtgcttttctaccaacatggtgactggagtgattttccagaggatgttgtaaatctagcacaacaggacttccagttgaagaagccaattacaactgctgtgttccagaacaagcacatcctgttggacttcattcacatgatttgcatagattatgagatgaccatagacaaaccactagcatgggttgatgataatggcaaacgcttctttccagatttatctgctgggctctacacatctaaaccatctcagcatgagaatggtgaagctgatgagtgtgatggaacgcctacaagtgtagctgaaagttctagttcggtatctgttggtgaagtagtttctcatggtaagaggatcaatgatattgcagaggacaacatgagagcacataacatattgtatgaagctgttggtgaaaatatttcaggtccttcattccatttgaatgaatattctagtggaaccatacaagctactggcaagccaaacgattgtcgacgtattgattcagctgtgcggaatttgttgctcaaaggattaggtcagccgtttagtgaggaagatattattggtatctatagaacaccactgctagatcagcgagggcaagttcgttgtggtctcttccagaaggagatcgaagagaccaggagtcgtcgggggaatgcaaatgtacgttatgcttggcttccttgctcaagatataccatggagcagatggcaatgcggggtgctctggaaatcgcgaagcctcataaggggtccatttgtggtgttgggacttgtcttgctcctgcaaactgtacaaattcatgtgccagatattctgattttcatgaagatggcatcatcagaatgatgttgtgccgtgtaataatgggtaatgttgaggttgttttgcctggatcaaagcaatttcagccatccaatggaagttttgataatggtgtggatgatcttcaaaatccacagaattacatcgtatgggatgctaatgtgcataaacacatatatgctgaatatgctgttattgtccaagcacctctcgtgaccaatgaatgttcgggcttgaaggatagcgtgcccaacatatctgagatcataagttctggttctcgagacaatctaaccaaggaggataggttcgcgccttgtggtgtcgaacaagaagcacctaggctggggcgtgctccaagggccccctcctcaccatggatgcccttttcgatgctttttgctgctatttccacgaaagtgcctcgttcggacatggagttggtcatcagatactatgaagaattcaagaggaagaggatgagccggagcgacctggtggtacggatgaggcaaatagtcggtgataagatattggtttctacaataatgaggcttcaccaccagaagaagcccccatcgatggcagcagcagcagctgggctagcaagagcactcgcaaggggggaagagggagggggagtagccgagtaagattagtttaagccgccttgtcttttgagaaatttatggagcacatatgctttgtcgacatggccagacccaaggtgtcaaaagggagggagatgagctgagcaactgttgtagtgtagtctcaaactcaaagcgtttaggtcttgacatttgacaaactaaaactcagaaacattatcatgagtagtgtttttttaaaaaa

SEQ ID NO: 417 - DNA, 912 bp, Zea mays
  CDS (67)..(834)
gaaagcctgaactgaaataagaacgaagtggaataggacgaaggaaggttctgcatctcagattgaatgtcggaaggaaagaagtacttgattgtgttggctcaccatgagcccaagtcgctgaatcactctttcgctcaacgtgctcaacaggtgctcacggctgctggaaacgaggtcaagctgatcgatcttcatgccgtcaacttcaacccggtctcggatcgacgcaacttcaagacgacggccaacccggagtttctcaaacaacagatcgaggagcgacatgctaccgaacacgatgggttcgctgatgacatcaaggagtccctggaggcagtcgactggtgcgatgtattgattctccagtttcccttttggtggttcagcatgcccgccatcctcaaaggatggatcgacaaggtctgggccagtggaagagtctacggtccgaacaagaagttcaccgctggagtgtggaagggcaagaaggccttcctctccatcacaacgggctcttccgagccgacctacgcgggacctgactctcgcatgggagatatcaacagtctcctcttccccatcaaccatggcatcttagccttcgttgggttcacggtcttgcctcccttcatcgcctactcagcttcgcatgccaccgaagaccagaggaagcagttcctggatgagtacgaacagagacttctgaacctggagaacctcaccccgatctcctatcctcccaacgaagccttcgactccaccggaatcctgaaagcagactggaaggctgctcaagctcaccagaactcgaaccctgctccacgcgaaggctgaaagcctccctcattccctccttccatctgaatgaaaccagctgttggcataccgaggtagcaacttcgaaacatc

SEQ ID NO: 418 - DNA, 3154 bp, Zea mays
  CDS (176)..(2836)
ctcgtccaatgagcgggacggggggcggtgagactagagagtggtggtgttcgagcagctgaaatgcacccgcgaggggctgagctccagcgagggccagcagcgtctcgagatctttggccccaacaggctcgaggagaagaaggagagcaaggtcctcaagttccttgggttcatgtggaacccgctgtcatgggtcatggagatggctgccatcatggctattgcactcgccaacggtggtggcaagcccccggactggcaggacttcgtcggtatcatcgtgctcttggttatcaactccaccatctccttcattgaggagaacaatgccggcaacgccgccgccgcactcatggccaaccttgctcccaaaaccaaggttctgagagatggccgatggggcgagcaagaggctgcaatcttggttcctggtgacatcatcagcatcaagcttggcgatatcgtccctgccgacgctcgtctcctcgagggtgatgcactcaaggttgaccagtctgcgcttactggagaatccctcccggttaccaagggcccaggggacgaagtcttctcgggttccacttgtaagcagggtgagatcgaggccgtggtcattgccaccggagtgcacaccttcttcggcaaggccgctcatcttgtggacagcaccaaccaggtcggacacttccagcaggtgctgacagcaatcggtaacttctgcatctgctccattggggtcggcatcctcgtcgagatcatcgtcatgttcccaatccagcaccggaagtaccgcagcggaatcgagaacctgttggtcctcttgatcggtggtatcccaatcgccatgcctaccgtgctttcagttaccatggccattggttcgcacaagctgtcacagcagggtgccatcactaagaggatgactgccattgaggagatggctggtatggacgtgctttgcagtgacaaaaccggcacactcaccctcaacaagcttagcgtcgataagaacctcgtcgaggtgttctgcaaaggcgtcgacaaagaccatgtgttgctgttggctgcaagggcttcaaggactgagaaccaggacgctatcgatgccgccatggttggcatgcttgctgatcctaaggaggccagggctggtataagggaaatccacttcttgcccttcaaccctgttgataagaggactgctctgacgtacattgatgccgatggcaactggcaccgtgtcagcaagggtgctcctgaacagattcttgacctgtgccactgcaaggaggatctgaggcggaaggtgcactctattatcgacaagtatgccgagcgtggtcttcgttcgcttgctgttgccagacaggaagtacctgagaaaaacaaggagtcccctggtggaccatggcagttcgttggtctgttgcccctgtttgatccgcctaggcatgacagcgctgagacaattcgcaaggctcttgttcttggtgttaacgtcaagatgatcacgggtgatcagcttgctattggtaaggagactggaaggaggcttggcatgggtaccaacatgtatccatcctctgcgctgctcggccaaaacaaggatgctacgcttgaagcgcttcctgtagatgagctcattgagaaggccgatggttttgccggagtcttccctgaacacaagtacgagatcgtgaagagactgcaggagaagaagcacatcgttggtatgactggagatggtgtcaacgatgccccggctcttaagaaggctgacatcggtattgctgttgcggatgctactgacgctgcgaggagtgcttccgatattgtccttactgagccaggtcttagcgtcattatcagcgccgtcctcaccagcagatgcatcttccagaggatgaagaactacaccatctatgcagtttccatcacaatccgtatagtgctcggatttatgctcattgcgttgatctggcaatacgatttctctcccttcatggttcttatcattgccattctcaatgacggtactatcatgaccatctctaaggacagagttaagccatctccgttgcccgacagttggaagctgaaggagatctttgctacgggcatcgtgcttggaagctaccttgctctgatgactgtcattttcttctgggctatgcacaagaccgacttcttctcggacaaattcggtgtgaggtcgatcagggacagcgagcatgagatgatgtccgccctgtacctccaagtcagtatcgtgagccaggctctgatcttcgtcacccgttcccgtagctggtccttcgtggagcgccctggtctgctcctggtcaccgcgttcctgctcgctcaacttgttgccaccttcctcgctgtctacgccaactggggcttcgccaggatcaagggtatcggctggggctgggcaggtgtggtctggctctacagcatcgtcttctacttccccctggacctgctcaagttcttcatccgcttcgtgctcagcggcagggcatgggacaacctcctcgagaacaagaccgccttcaccaccaagaaggactacgggcgggaagagagggaggcgcagtgggccaccgcgcagaggacgctgcacgggctccagccgccggaggcttcctccaacacgctgttcaacgacaagagcagctaccgcgagctgtccgagatcgccgagcaggccaagagacgagctgagatcgcgaggctgagggagctcaacaccctcaagggccacgtggagtcggtggtcaagctcaagggcctggacatcgacaccatccagcagaactacacggtgtgagagcccctctgctgcgatgtcgacgacaacacctttgctgcccgacgggagccatctgattacagataaaaattttcctagctgtaaagctctctataccaccagatactgccatatgatggtatggttgggtacccgtctttctagggagtttcttttctctctctcttttcttattgttatgtttttcaatagtggagtgtgcgcgtgttgtaatcgtttttacctgcgttttcctctaactagccggtgatctcgcgggaagcgaggtgaagaaataatgcaactaaaattctctgccaaaaaaaaaaaaaa

SEQ ID NO: 419 - DNA, 2253 bp, Zea mays
  CDS (222)..(2168)
ccacgcgtccgggggattccacatcgtaaccactgaagacgaggcggcggacgagacggagagcagaaccgcgcagcgaagcagcagcggcgacaagccctcgcgtcggtagaggcgccgtccgccgtccgccccctcaactccggtagccgctggccgctgcaggtcgagtcccgtcgagccgactcgcgcttcccgatctgggtggccgcggcgccggcatggcgcggttcgaggtgaacggcaagtcggtgcaaggcgtggacttgctgcggcggcgccactggccgtcgcgcctcgacttctggcccttccttgcactctatgcgctctggctgctgcttgctgtcccggcgctcgacttcactgacgctctcatcatccttgccgcgctctccgctgctcacattctcaccttcctcttcaccgcctggttcgtcgatttccgtgccttcgtcgggtactctaaggtcaaggatatccatgccgctaacacgtgtaaggtgactcctgctaagttctcggggtcaaaggagattgtacctctgcacaaacagaaaaatgtggcctcaacttcagctgcaggtgagacagaggagatttactttgattttcggaagcagaggttcatctactcggctgagaaagataactttttaaaactccggtacccaacgaaggaattgatcggtcattatggcaagggcactggttatggaactgaggccaagattagcaccgcagtggacaagtggggcagaaatgtattcgaatatccacagcccacatttcagaaattaatgaaggagcaaatcatggaaccattttttgttttccaggttttttgtgttgctctatggtgcctggatgcgtattggtactacagtttgtttacacttttcatgcttttcctgtttgagtctactatggcaaagaataggctgaagacattgactgagctaagacgtgtgaaagttgatagccagattgtgttgacctatagatgtgggaaatgggttaaagtccctggaactgaactactaccaggagatattgtgtcaataggccgctcaactagtggtgaagatagatctgtaccagcagatatgctattgttagctgggtctgcaatagtaaatgaagctattcttacaggagaatctactccacagtggaaggtttcaattgctggacgtggtcctgatgatatgctatctataaggcgagataagaaccatatcctatttggtggcactaaagtattgcaacacactgcagataagtctgtaaatcttcgatcacctgatggtggctgtctagcttttgtattgaggactggatttgagactagccaagggaaattgatgaggactatcttattttcaactgagagggttactgcaaataacaaagaaagtggcctgtttatactctttttgcttttctttgcaatcattgcgtccggttatgtgcttgtgaagggattagaggacccaacaaggagcagatataaacttttattgagctgttcgttgattattacttctgtgataccaccggaattgccaatggagctctccatagcagtcaatacatctttaattgcattggctcggcatggtattttctgcacagagccattcagaataccatttgctgggaaggttgacatatgctgctttgataagacagggactctgacatcagatgatatggaatttcaaggtattgttacatcggaaggtgatgacttaatatctgatgcaaataagctgcctctccgaactcaagaagtgctttccagttgccatgcactggtatttgttgacaacaagctggttggcgatcccctagaaaaggctgctataaagggcatagactggatctacacatctgatgagaaggccatgtccaaaaagcctggtggtcaacctgttcaaattgtgcacagataccattttgcttctcacttgaagagaatgtctgttatcgtccgtattcagcagaaattttacgctttcattaagggtgcaccagagaccatccaagagaaattagttgatttacctgctgcatatgtggagacatataagaaatacacacggcaaggttctcgggtcttggctcttgcatataaattgcttcctgagatgcctgtaagtttctgttgatattaatcatgtttgcctatagcctttcttatctagtattctgttattcttttgtcaaaaaaaaaaaaaaaaaaaaaaaaag

SEQ ID NO: 420 - DNA, 4406 bp, Saccharomyces cerevisiae
  CDS (170)..(4237)
tttgccagaaaacccaaatctgtttattgccactaagttgaagaaacatataatcaacaattgttggcaattctaaggggaatagtgcaacaagaagccagtaacgccaaatagaggttagcgccaagcaataatttactggtaggttctttcattccctgattttaccatgaatgacgacagagaaacccccccaaagaggaaacctggggaggacgacacgcttttcgatattgacttcttagacgacacgacttctcattctggatcccgttcaaaggtcaccaactcacatgcgaacggatattatataccaccaagtcatgtacttcccgaagagactatcgacttagacgctgatgatgataacattgaaaatgatgtccatgaaaatctatttatgagcaataaccatgacgaccaaacgtcttggaatgccaatagattcgactcagatgcatatcaaccacaatccctacgagcagtcaagcctcccggtttatttgctaggtttggtaatggtctcaaaaatgcctttacgttcaaacggaagaaagggcccgaaagtttcgaaatgaatcattacaatgcggtgactaataacgaattagacgataattatctagactcgaggaataagttcaacattaaaattcttttcaaccggtacattttaagaaagaacgttggcgacgcagagggcaatggtgaaccaagagtcatccacatcaacgattctctcgctaattcctccttcggttatagtgacaaccatatatctaccaccaagtataattttgcgacctttctgcctaaatttttgttccaagaattttccaaatacgctaatctgttttttttatgtacatctgccattcaacaggtgcctcacgtctcgccaactaatagatacaccacaattggtactttattagtggttttgattgtttctgccatgaaggaatgtatcgaagatatcaagagagctaattctgataaagaattaaataattcgacagcagaaatattttcagaagcacatgatgactttgttgagaaacgatggattgatattcgtgtaggtgacataattagagtaaaatcagaggaacctattcctgctgataccataattttgtcatcttcggaaccggagggtctttgctacattgaaactgccaacttggatggtgaaacaaatttgaaaatcaaacagtcgagagtagaaactgccaaatttatagacgttaaaactttgaagaacatgaacggaaaagttgtttccgaacagccgaactctagcttgtatacttatgaaggtacaatgactttaaatgatcgtcaaataccgttatctcctgaccaaatgattttaagaggtgcaactttaagaaatactgcatggatatttggtttagttatcttcactggtcatgaaactaagttattgcgtaatgctactgcaaccccaattaaaagaaccgcggttgagaaaattatcaacagacagattattcgattgttcacagttttaatcgtgctaattttaatttcttcaattggtaatgttattatgtctactgcagatgccaaacatttatcgtacctttacctggagggtaccaacaaggctggcttattcttcaaagactttttaacattttggattctattttcgaatctagttcctatttctctatttgtcaccgttgaattaatcaaatattatcaggcttttatgataggttcagatctagatttgtactacgaaaaaactgataccccaactgtggttcgtacatcctctttggttgaagaacttggtcaaatagaatatatattcagtgacaagacaggaactttaacaagaaatattatggaatttaaatcctgctctattgcaggccattgctatattgataaaatacctgaagataaaacggccactgttgaagatgggattgaagttggttatagaaaatttgacgatttgaagaaaaagttaaatgatccctctgatgaggattcacctattatcaatgacttcttaacattactggctacctgtcatactgtcattccagaatttcaaagcgatggatctattaaatatcaagcagcctctccagatgaaggtgccctcgttcaaggtggtgcagatttagggtataagtttatcatccgtaaaggaaactctgtaactgttttattggaggaaactggcgaggaaaaagagtatcaactacttaacatttgtgaatttaattccaccaggaagagaatgagcgctatatttagatttccggatggttcgataaagttattctgtaaaggtgctgatactgtcattctggaaagattggatgatgaagctaatcaatatgtagaagctacaatgagacatttagaagattatgcatctgagggtttgcggacgttgtgtttggcgatgagagatatctctgaaggagaatatgaagaatggaatagcatttataatgaggctgccacaacattagataacagagccgagaagctagacgaagccgcaaatctaatcgagaaaaatctaatattaattggtgcaactgctattgaagataagttacaggacggtgttccagaaactatccacacattacaagaagcgggtattaaaatttgggttttaactggtgacagacaggaaactgctattaacattggtatgagttgccgtttattgagtgaagacatgaatttgttgatcatcaacgaggaaaccagagatgatactgagagaaatttgttagagaagattaacgctctaaacgagcatcaattgtcaacacatgatatgaaatccttagcgctcgtcattgatgggaagtcattaggctttgccttggaaccagaattagaagattatttgctaactgtggcgaagctttgtaaagcggttatatgttgccgtgtatctccactacagaaagccttggttgttaaaatggtaaaaagaaagtcgtcttcactactgctagccattgcgagtggtgccaacgatgttagtatgatacaggcagctcatgttggtgtcggtattagtggtatggaaggtatgcaagcggctcgttcagctgatatagctcttggccaatttaaatttttaaaaaaactattacttgtccatggctcctggtcttatcaaagaatttctgtcgcaattttgtactctttttacaagaatacagcattatacatgacgcagttttggtacgtttttgccaatgccttttcaggtcaatccattatggaatcatggacaatgagtttctacaacttattcttcactgtttggcccccttttgtcattggtgtatttgatcaatttgttagtagtagattacttgagcggtacccacaattgtacaaattaggacagaagggtcaatttttctctgtttacatcttctggggatggattattaatggctttttccattctgcaatagtatttattggcaccatattgatttacagatatgggtttgccttaaatatgcacggcgaactagctgatcattggtcttggggtgtaactgtctacactacaagtgtcattattgttttgggaaaggctgctttggtaactaatcaatggacgaaattcaccttaattgccattcctggttccctcttattttggttaatattcttcccaatttatgcttctatatttcctcatgctaacatctcaagagagtattatggtgtggttaaacacacgtatggatccggtgtattttggttaactttgatcgttttaccaatttttgcactggtaagagattttctatggaagtactataaaagaatgtatgaaccagaaacgtatcatgttattcaagaaatgcagaaatacaatatcagcgactctaggccgcacgttcagcaatttcaaaatgccatcaggaaggtgaggcaagtgcaaagaatgaaaaaacaaagaggatttgccttttcacaggctgaagagggtgggcaagaaaaaattgtcagaatgtatgatactactcaaaagagaggtaagtacggtgaattacaagatgcttcggcgaacccctttaatgacaataatggactgggaagtaacgactttgaaagtgcagaaccgttcattgaaaatccatttgctgatggtaatcaaaattcaaatagattcagttcttcgagagatgatatttcatttgatatatgaggcacagaaacaaagagcagaagacaaaaaatacaaaaataaaaataagataaaaagaaaagtcattattaccattactgaaatatgtacatttaccataaaatatatccgttatatagaagttataatataagcctacactttgttatcggttttcattcctctgggg

SEQ ID NO: 421 - DNA, 4601 bp, Schizosaccharomyces pombe
  CDS (56)..(3832)
tatctttgctttttctgcgcatatcatttgcattgttaatatcttgtaaatatcaatggcccgagatgtagataataagcaaaatgctaaaaggatatcacgagatgaagacgaggatgaatttgccggagaatcgatggttggtagaacgttagacaatccttttctgggtgaagatgaattcgaagatatttttggctctgaaagccaatatatatcttcttcaggccaaaattctaccaatccattccttgctgatacaagaatagagaatagtcctttaggaagtgaaagtaaggccaaccaacttaataagcaaggtacaaacgtaaatcacattgagatacctttgcgcgattttaatgaccctacacaacctgaatctttcctaccacctcctaagaatacatttacttcgcgtataaaaaaaataaagaacttatttaaaaaagagaagaaacaggttaagccagaagatcttggtcctcgacagatcattttaaatgattattcagcaaaccatttcttacacaacgctgtgtcaacttgtaaatacagcgctttcacatttttaccaaaattcctaaaggaacaattctcaaaatatgcaaatctatttttccttttcacggctgttgtgcagcaaattcctggaatcacaccagttaatcgttatacaacgattggccccatgttaattgtactttcagtttctggtattaaagaaatcatggaggatataaagcgcaaaaaacaagatcaagaattgaatgaatcgccttgctacgttttacaggggactggttttgttgagaaacaatggaaggatgtagttgttggtgacattgttaaaatcgtttctgaaacttttttccctgctgacttagtacttttatcatcatctgagccagagggactatgctatattgagactgcaaatttggatggcgaaactaatttaaaaattaagcaagctctcccagaaacagcaggtcttctaaaaccagtagagcttggtcagctatcaggagaagttaaatcggagcaaccgaataataatttatatacttttgatgccactttgaagcttcttcccagtgatcgagaacttccattatctcccgatcagttattgcttcgtggtgctcagcttcgtaatacgccttgggtgtatggcattgttgtatttactggtcatgaatctaaacttatgaagaacactacagaaacacccattaaacgaacttccgtcgagaagcaagtgaactcacagattctgtttttattatgcatctttgtgtttctttgttttgcctcttcacttggagctctcattcatcgttcggtttatggatcagctttatcttatgttaaatatacttccaacagggccggcatgtttttcaaagggttgctgactttctggattctctactcaaatcttgtgccaatttctttgttcgttacttttgagttagtccgatatatacaggcacagctaatcagcagtgaccttgatatgtacaatgaggaaactgatactccagctgcatgccgcacatcttctctagttgaagaattgggtcaggttggatatatttttagcgacaaaacaggtacattgacgagaaatcaaatggaatttcgtcaatgcactatagccggtgttgcatatgctgatgttattcctgaagatcgtcagtttacctcagaagaccttgattctgatatgtacatatacgattttgatacgcttaaagaaaatctcaaacatagtgaaaatgcaagccttatacatcagttcttactagttctttctatttgccatacggttatcccagagtatgatgaatccactaattcaattaaatatcaagcttcttcaccggatgaaggtgccttagtgaaaggtgctgcatccattggttataagtttctagcgaggaaaccgcatttagtgactgtaagtatttttggaaaagatgaaagttatgaactattacatatttgcgaatttaattctactcgcaaaaggatgtcaatagtttttcgttgtcctgatggaaaaattcgtttatacgttaaaggtgctgacacagtcattatggaaaggttagcatccgataacccgtacttacaaactacgattcatcatcttgaagattatgctaccgtgggtttacgtacgctttgtattgctatgcgggaagtcccggaagacgaatatcaaaggtggtcaacagtgtttgaaactgcagcctctagtctggttgaccgtgctcagaagcttatggatgctgctgaagaaattgaaaaggatttaatcttgctgggagctaccgctatagaagatagactgcaagatggagttcctgatactatctcaactttacaaacagctggaataaaaatctgggttctgaccggtgatcgacaagagaccgcaattaatattggcatgagttgcaagttgattgatgaagacatgggtttagttatagtgaacgaagaaacgaaagaggctactgctgaaagcgtaatggctaagttatcttctatatatcgaaacgaagctaccactggaaatgttgaatcaatggctttggttatagatggggtttcacttacttatgcattagattttagcctagaacgccgattctttgaactggcttctttatgccgtgccgtgatatgttgtcgtgtctcacctttacagaaggctttgatcgttaagatggttaaaagaaatacaggtgaagtgctattagctattggagatggcgctaatgatgtgccgatgattcaagctgcccatgttggggttggaatcagcggtatggaagggttacaagcagttcgaagctctgatttttcaatttcccaattttgctatttaaaaaaattgttacttgttcacggatcttggtgttatcagcgtctcagcaaacttattttgtactcgttttacaaaaacattgctctctacatgactcagttttggtacgctttttgcaatgcattttccggccaggtaatttttgagtcttggtctatttcactgtataatgtgctttttactgttcttccaccggtggtaataggtatatttgatcagtttgtaagcgctggtcaactttttcagtatccgcaactttatcaattaggtcaaagaagtgaattttttaacttaaaaaggttttggtcttggataacaaatgggttttatcattcacttcttctatttctttgttccattgctgtgttttactatgatggtcctaataaggatggtctcgcgtcaggtcattgggtgtggggtactacactttacgctgcaatactagctactgttttaggtaaggctgccttaattagtaatcattggactcaatacactgtaattgctaccctcggatctttcttgctatggatagtgtttatgcccatttatgctgttgcagcacccgctatcggattttcaaaggagtactacggaataattccacatctttacgggaatctaaaattttgggcttccctacttgttttgccaacaatagcactgatgcgtgactttgtgtggaaatattcatccagaatgtattatcctgaggagtatcattacgttcaagaaattcagaaatataatgtcacagactatagacctcgtattgtcgggtttcataaagctatcaggaaaataagacagatgcagagaatgcgtaaacagagagggtatgctttttctcaaggtgaagaggaccagtcaaggattttagatgcatatgatactacacatactcgtggagcatacggtgaaatgcgttagatacgtatttttctctattattttatattacattcgcttttggtttctagatctcagatttcgatgagttttacgatgttaagttgttttagtttatcactcgtttagaattattatgttattcatcctattaatcgattaacaagacgttttttctgtattactgtaagaatttcttaaagcataaagacgcattggtaccaccaaatccaaagctgtttgacaaagcaacattaatgcggctctctttagccacattcggcacataatcgcactgaaactgctgaggaatatcagagtattcgaaatttaacgtagggggtaagacgccctatacagttttgttagcaatagaaagtttgagtagaataaaataccttttggacagtcaagaccgtatagacagattcgattgcacctgctgctcctaaaagatggccaatagagcctttgctactagatacaggaaatgcctcaggattccggttcacatcacaaagtaacctagtaatcgctatgctttctgctacatctccaagcttggttgaagttgcatgagcattgatataatccaattgacttgcagaaagaccagcttgttttaaggaacgcttcatagcatagtaagcagcatccccatttggatttggagctgtaatatgatatgaatcagatgccaaaccataaccgactatttcagcatatatatgagcatttcgatttttggcatgctccaattcctcaaggactaaggcagcggagccttctc

SEQ ID NO: 422 - DNA, 6501 bp, Oryza sativa
  CDS (47)..(1538), (1619)..(1925), (3116)..(3824), (3920)..(4043), (4143)..(4362), (4590)..(5048), (5937)..(6153)
ccggtggtggcccactagccctgctcgctccggcttccccgactccatggcttccgggcgcccgctgctcgacgcctcgccgcggccgacgcagcagccgccggcgtcatcgctgctcccgccgccgcagccggagccgcccctccgagccgaccgcctcgcgttctccctcgaggtgcccgaccccttccgccgggagcccgacccgtcgtcggccgcgtcgcagcggggggaggaggaggggggcggcgaggaggagtcccgcgcggttgttgtcggggagccctcgtcttcggaggcggcggcggggttcgccgggaacggcgtacggacggcgaagtactcggtgctgacgttcctgccgcggaacctgttcgagcagttccggcggctgtcgtacgtctacttcctcgccatcaccgtgctcaaccagctcccccaggtcgccgtcttcggccgcggcgcctccgtgctcccgctcgccttcgtcctcttcgtcaccgccgtcaaggacgcctacgaggacctccgccgccaccgctccgaccgccaggagaacaaccgcctcgccagggtcctcctggcgccgcccgccgcgggggagttcgcgcccaagaaatggaagcacatccgcgtcggggacgtcgtccgcgtcgcctccagcgagacgctccctgccgacatggtgctcctcgccaccagcgacccctccggcgtcgcgcacgtccagaccgtcaatcttgacggggagaccaacctcaagacgaggtatgctaagcaggagacgcaactgaggttctcgcaggacggtggaatcggcggtgtccttcattgtgagcggccaaacaggaacatctatggatttcaggcgaatttggagattgatggcaagcgtgtctcgctagggccatcgaacattgtgctccgtggatgtgagctcaagaataccacctgggcgataggggttgttgtgtatgctggaaaggagaccaaggtcatgcttaatagctccggggcgccgtcgaaacggagccggttggagacacagttgaaccgggagactgtcatactgtccattatgctcattgggatgtgcacgaccgcaagtgtgctcgcggggatttggatactgaatcaccgtggggatttggaattcacccagttctttagggagaaggattacacgacagggaagaactacaattactatggcatggggatgcagatattcattacattcctcatggcggtgattgtatatcaggtcatcattccgatctctttgtatatatcaatggagttggtacggcttgggcaggcatatttcatgggtgctgacagagatttgtatgatgagtcatcaaggtcaaagttccaatgcagggccctgaatataaacgaggatctaggacagattaaatatgtattttctgataagacagggacgctgacagagaacaagatggagttccagtgtgcatcaattcggggggttgattactgttctggcaaagattcatgcggatactcagttgtaggtacgatgtctttaatgtatatttctggttttcatgttgaactttcctagtatggctgcttattttctggttttggacagtcgatgatctcctatggacacccaagatggcagtcaagattgatcatcggcttttgaagttactgaggggtggtggcacagatgaggaaacaaagcttgtcctcgaattcttccttgctcttgctgcatgtaataccattgtgccacttgtcctagatactcgtgattctaagcaaaagttgattgattatcagggtgagtcccctgatgagcaggcactagtgtatgctgcggcatcttatggcattgtgcttgttgagcgaacatctggttatgtggtgattgatgtccttggtgacagacagaggtaaggtagtctttcatcatttgctttatggacatgctaattttcaactctgcatgagtgtgttttcaataataattagtggcattatgcaatttagctaataccaattttggtgtatcaacatcattatgtgactaggagtggatgtctgctacagtgctagtgtgctacctgatccatgatgtttacatctctggaaaattatacctacaaaactttattcaactgcaatgtcatatagtcatcaacagttggtagcataacttattcaataacgattttcacaagtgttttatgcactttgctttatggtgtttagtgacgtcattcttttgtcttatcttattggtttgctggtgtgaatgctaactttgagttgtatcttgctagttatcttcctattcctattcttagcatacagttaatatttattcaaaataaaaataataatttggaatattttgggatgcaacgtgccaactccaaatgatttgtggcattaccccacatgagcgaaatttcagtacttagtttatcaggcttacctcttggagatatgttacaactctccaagtgcatgtcttgacttttccttgtgtttatagacatgcttgcatatcctattatagtaagctagtttgtggagccaatactgtaatatattggttgaatatatttgatgaatggagctctttttattggttaatcaccaactgtagagagttaaatgtgtttgctgtaagtccatgtcaaacacctgggctataggcaaaaccaagttaattatcactttgaacccagttattgtgatgagcacatatctgcactagggccataaatttgtaaggagctgcattgaacaggctggcatttataaacaaagcaaatttaggatgtgcatatggatttgcagctgaatttctggataatttggataaaaccatatcatttttcaccaaaccaaatgtttatctaacatttttaataacactattccaaaaggcattcttagttacctcatatgtacgaagtacgctagctttgtttataaatgcccgctttgttactacattgactactctgctccattctttcagttcgttgttctttatgtgtaaattttattttcaatatcttgtttacaagaatggcttatagttccaatttatcttctggtatgggatgtgcagatttgatatattaggacttcatgagtttgatagtgatcgtaagaggatgtctgtcatagttggctgccccgataagactgttaagctatatgtgaaaggtgcggacagttcattgtttggaattaccaaaaattcattagatctggacattgttcgtgctacagaggcacacctccacaaatattcatcgtttggtctaagaactctcgttattggcatgcgtgaattgagtcaacctgagtttgaggagtggcaattggcatatgaaaatgctagcacgtcagtacttggaaggggaaatttactccgatcagttgcggccaatatagagaacaatatccgcatattgggggctactgggatagaagataagcttcaagatggggttccagaaacaatagaatctcttcgacaagcagacataaaggtttggattttaacaggagataagcaggagacagcaatttctattggctactcttgtaaactgctgaccaatgacatgacacaaattgtgataaacaacaactcaaaggagtcttgtaagaggagtctcgaggaagcacatgcaacgattaagaagctcagaattgcttcaactggcacacagagtccagaattagcatcagaatctgctggtgtaactcttgcgttaattgtagatggtaacagcctggtttacatacttgagacagagttgcaagaagaggtactcatctaaatatgattcttttttttcatttcctttcatccttggtataaaatcatagttgatgcatggactttcttcttttgtttgtgtagcttttcaaagtggcaagagaatgtagtgttgtattgtgttgtcgggtggccccgttacaaaaggcagggatagttgcacttatcaaaaaccgaacagatgacatgaccttagcaattggtgatggtattattccctcctggttctgctattatggcatataatattctgtgagaaccaatttatgtacatgtgatatatgctaattaatcttttgttgttcaggtgcaaatgatgtttcaatgattcaaatggctgatgttggtgttggcatcagtggtcaagaaggacggcaggctgtaatggcatcagattttgcgatgggccaattcagattcttggtccctcttctattagttcatggccattggaattatcaaagaatgtcatatatgatcctctacaacttttacaagaatgcgacatttgtcttggttcttttctggtaagagcccttttgcattgaagttttcacactttgaaaaaaaaaactgtttttatgtagaaaattatctaaacgttactgtggaaacccccatgttagtaagacctagtgaaaagaagtggactctatttatgttcagttgaattaccaaagttgttgctttcttaatttttgcaatattcagagacattgtctccaaaatataacacttaattttgtgatctcaggtatgtactttatacagcattcactctgacaactgctatcacagaatggagtagccttttgtatactgtgctatatacatcccttccaacaattgttgttggtattcttgacaaggatcttagtaaggaaacactactagcttatccaaagctatatggatctggccaaagggatgagaagtataatgtaaatttgtttgtcctcaatatgctcgaagcgctatggcaaagtctggttgttttctacatgccatattttgcatatagacaaagtacgatagatatgtctagtctgggagatctatgggcacttgcccctgtcattgttgtaaatatgctactagccatggacatctttcggtggaattggatcgtacatgcttttgtgtggggaacaatagcagcaacaaccatttgcctctttgtgatcgactccatttggtttcttcctggatatgggtaagtacttcatttccagctttcttttatttataggcgaaccctcttttttttaaaatgttttggtgctaaaaatgtagtaaccaacctgatgtttggaactggcaatggctttttaaattctttcctgcaaggcattttgtaaatttcataactgtaaatttctgaaatatgtgttaatatcagttatcctaggaagtaaaatgacttttgagcttatgcaactgttatgggaggagctcctgagtactcttttcgtactcgtaaaggaagtcgtttaggataatgtttaagtcaaaccttgggaatataaatcatgaataactctcaagtcgttgagtttgaaaatgtaaaaattatataaatagatttgtcttgaaaaatactttcataaaagtatacatatatcacttttcaataaatatttttatagaaacaagaagtcaaagttgtgttacgacttcctttatgagtacggagggagtatgtggtctctattttctcatttgtagtattttgtgttgccttgttgctgttcacgttaatccttgtagagttcttttattcctaggaggatattgagaagtagagatatattcaagtggtaactatgatttattgagagggataagtgttcagattaagatatatagaaaattaacatagatgctgctacctctcaatatctcctatgtaaaagggataaaagttgtcctgatacatagttagattaaatgcctctttctttgcaagcatgtttgtgctacatccatcatgtaatgcgagcaccatgatcatgttttcttgaatggatctcctaaagtgaaataggagttctttttgcaatttcttgattgattgcatactgactcaatataactatttcagggccatctttcatataatggggacaggtttgttttggttactgctgcttatcattgttgttgcagcaatggtaccacattttgtaatcaaggcctttacagagtattttacccccagtgatattcaagttgcccgagagatagaaaaattcgagaatgtaaatcaggtgaaccgttcagaagttccaatgacacgtctgcatgacccaaggagatagctatagaaaattctcctttatagaaatttctttttttttctgttgtttttcgcctctttggtgtgtatacgagtaaattcatttagcactaaggtgataggtttagcctccaagatgtatgtatgtaggcatgtgttcatctaacatttactgaaaaggaaatataaattgtttgatgtatgcaagtttctcatccttgtgtcgaccagcacaactgtaaggtgaagagtgttatatacctatattacctcttactctatcactacgatgatcctgtcctattgcataagctgatttatctttgtatttttagtttcttagcttcagtttattcatgctatctgtcac

SEQ ID NO: 423 - DNA, 1101 bp, Saccharomyces cerevisiae
  CDS (110)..(1042)
ttatttagatcgtgattctctctactcaaacatttccttgaacttgtataacggggaaataaatctgaaaagcaatacatttgcgcactgttaaaactggaaaggaagaatgacaaccagcatactcgatacttatcctcaaatatgctcccccaatgctttgccaggtactcccggcaatttgactaaggagcaagaggaagcgcttttgcaatttaggtcaatcttgttagaaaagaattacaaagaaaggctggatgattctacgctattgcgatttctacgggcaaggaaatttgatatcaatgctagcgttgagatgtttgtagaaactgaacgatggagggaagaatacggtgccaacactattatcgaggattatgaaaacaacaaggaagccgaagacaaagaaagaatcaaattggccaaaatgtaccctcagtattaccatcacgttgataaggatgggagaccattgtacttcgaagaactaggaggaattaacttaaagaaaatgtacaagatcactaccgaaaaacagatgctaagaaacttagtcaaggagtacgaattatttgccacgtaccgggtcccagcgtgttcgagaagagctggctaccttattgaaacttcgtgcactgtgctggacttgaagggtatctcactttctaatgcttatcatgtgctttcctatattaaagatgttgcagatatcagtcaaaattattatcctgaaagaatgggtaagttttatattatacacagtccatttggtttctcgacgatgttcaagatggttaaacccttcttggatccagtaaccgtgtcaaaaatctttattcttggctcttcttataaaaaggaattattaaaacaaattccaatcgagaacttgcctgttaaatatggtggtacatctgtcttgcacaaccctaatgataagttctactattccgatattggtccctggagagaccctagatacatcggaccagaaggtgaaattcccaacatttttggtaaatttactgttaccagctaactatgatacaggccttcgtcgtagctttccgtgaatatagcatgcatactctataatat

SEQ ID NO: 424 - DNA, 1882 bp, Zea mays
  CDS (57)..(1037)
ctcgtcagtcctcagtcctcactttcgggccgagctccggatatccagcggcggcaatggcagccgaagccagcgccgtccagcagctcgctggcctcctggaccaagtggacgcgccgctgaagaagacatttgagaatgtgcatcagggctacccaacagagacattattgcgtttccttaaagctagagagtggcatgtgaataaggctcacaggatgcttgaagattctttgaattggaggatgcaaaatgaaatcgatagtatattggagaaacctattatcccagtagatttgtatagatcaattcgtgatacacagcttattgggttatcaggatactccaaagagggcattcctgtatttgcagttggtgttgggctgagtacatatgacaaagcttcggttaactactatgtgcaatctcacattcagatcaatgagtaccgagatcgttttattttgcctacagtgacaaagaagtatgggagacctattaccacctgtataaaggttctcgatatgactggtctgaaattgtcagcactacaccaaatgaagattgtgactgcaatatctacagttgatgatttgaattaccctgaaaagactgagacctattatatagtaaacgctccatacatattttctgcatgttggaaggtcgtgaagcctctgttgcaagagagaacaaggaagaaagttcatgtgttgcgtggctgcgggagagacgagcttctacagatcatggactactcctccctcccccatttctgcagacaggagggctcgggctcatccaaacattcgtcaggcgacgccgataactgcttctctctcgaccacccgttccaccaggagctctacagcttcatccaggagcaggcgctgaaccaggagctcatcaagcagggctccttgcacgtgaaaatccccgagcaggaccctgaggacgcaaagatcgtggaggtcatcgaggccgagttccacaagcttggcgtgcagaacgggtccgccaatggcatcgaccaagcatagcacctttgtctaataaggccagcctgattcaaccgagacgttgcttgccacttctgatgcaactaatcctactgtttattttttttggtggggtgggcccacccccgttgctgtttcctggggggaggggggtgattggtattggtggtatacatagcaaagtcatttgcagatccatccatgatgcaggactgagatagacgatatcacctgtgtaaacttgcagatttgcaatgtgtcctcatctcatatgtatgctgagttgagatgaaatgaataaatcatcctacaagtttttttaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaacaaacaaaaaaaaaaaaaaaaaaaaaggggggccccttttaaaggaaccaattttacttcccccgcgttgcgaatttataaatttttttttgggcccaaaaaattaaatttatgggccgtttttttataaccgggtggggggataaacccgggggtcccccatttaaaacttttgaaaaaaacccctttttacaggttgggggataaaaaaagagcccgacattaaccttttcaaattttgggcaccaaaagggaaaggacccccccttaccccgaattaaacgcggggtttggggttttctcccaaggtgcccttaacttttaacccctaaagccctttcttggtttctttccttttttttccaagttggcggtttttccccagaaattaaagaggccctttgggtctgttaatttttaagccccacccccaaaa

SEQ ID NO: 425 - DNA, 1066 bp, Zea mays
  CDS (89)..(841)
gttccgatcctccacaccagcacccgccgccgccgcctcttcccttgcgcacctgctgctgtgcggatcggtgaggcggaggagtaggatggcgagcgcggccggaggcggagcggcgggggaaggggagtggcttaaggtatcccagctcaggcccatggtggaagcgcaggaccccaacgccaaggcagtggacaacctgacgctgcgtcggttcctgcgcgcgcgcgaccacgacgtggacaaggcctccgccatgttcctcaagttcctcaagtggcggagggaggcggcgcccggcggctccgtgccggaggagcaggtgaggagggagctgtcgcaggacaagctgtgcatgggcggcgtcgacagggccggccgccccatcctcgtcgccttcgcggccaggcacttctccgccggccgtgacatggcagagttcaagagttttgttgtctacttcttcgacaagatctgtgccagaatccccagagggcaggagaaattcctctgcatcgttgatctcaagggctgggggtactcaaactgtgacgtccgggcatacattgccgctatagagatcttgcagaactactacccggagcggctcggcaaggcgctgatgatccacgtgccctacatcttcatgaaggcgtggaagatgatctaccccttcatcgacaccaacaccagggacaagttcgtgttcgtggaggacaagagcctgcaggagacgctgcggcgggagatcgacgaggggcagctcccggagttcctcggcggcaagatggacgtgatcccactcaaggactatggcgtgcagcagcagcctcaggccgtgtaatagccatgccatgcgtagcatacacgagttgtggctaggagcatagcatggcaataactgtgtagctgctgtgaaagtgaaaatgaaacgttgcgctgtttagccgggtcaattgaccagcccaactgcagatctctgggctaccactatgaacagcaagaactgtttcccttatccttttcagccaaactaatcaaaccagaaaatgtttcttgtaaaaaa

SEQ ID NO: 426 - DNA, 1407 bp, Zea mays
  CDS (309)..(1196)
cgagattcgagagaaatggcgatggcgacgccagctgccaaacaatcacttctcaccgtccaaccgtgcacaatgaattgaagcgccacgcggttccaataatctattgccacgggcaggtgcgtcgcgtcgattcctggtcttcgagaggagcggaggaggagggcggcgagtgcggaggagaggcgagttcagctgtagcgtttcgcttcttgcccgtggcggcggcggtgccacctcgaacgctgctccctgttctggggcttactgcggatcctgatctgagcatcattcagagaggaagaaatatgtttaggagaaagcatggctctgatttcaactcagatgatgctgagcaaagagaagcaaagattagtgaactgaaagctgctcttgggactttgtctgcccgtggcgagaagtactgcagtgaagcatgcttgagaagatatctggaagcccgtaactggaatgttgctaagtcgagaaaaatgttggaagaaagtctcaagtggagggcagcttacaagccagaggatattcgttggcctgatgtttctgttgaagcggaaacaggtaaaatgtacagggcaagtttccgagacagggagggcagaactgttgttgtcatgaaacctacaaaacaaaatacttcatcccatgaagggcagatacggttcctagtatatactttggagaatgcaatcttcagcctgcctgaaggccaagaaaaaatggtatggctgattgatttcacaggatggacagtgtcccatgcttcgccgataaagacttgtagagaaactgcaaatatactgcaaaatcattttcctgaaaggctggccattggatttctatttaatccccccaaagtatttgaagctttttataaggtcatcaagattttcctcgatccaaaatcagtcgagaaggtgaacttcgtgtacgagaaggatgaggagagcatgaaggtcatgtacaaatacatcgatccggaagtccttcctgtagagtttggggggaagagcaatgtggtgtacaaccacgaggagtactccgagttaatgagacaagatgacatcaaaacagcaagcttttgggcggttgatgcgaaaactaaccatgctaaccctgccatcaatgggaccttggttcctgaggttgcgccacagtcgtcgctggctgctaaagctagttgaagagtatctgcattctctgagaaaattgagaagccgaggactaatggaaccttgagagaaacatatgaaataagaaacatggtatactcgttcatcctcaagagttgtttaagtactggaagtttattcagcacacaataagctactagagaatgtcaccatgtgtgatttgatgcccaaaagagatggtttacaaggtagaaaaaaa

SEQ ID NO: 427 - DNA, 1147 bp, Glycine max
  CDS (209)..(976)
attcggctcgagggggaagaaacatttaatttgggttgataatagtttatgttaagatatcactactgctatatatatgttgccatagccaagttagccttataaagggaaactcacttgccttatttttggttttgagattgagctaaaggccaactcaaccatcgaatttgttggtgattgaaagagaaggaagaagaagcaggaaatggaagcagtgagagctggtcgagaaggagcaataggtctaggtcaaggtgatggcgtagccaaggacagcactgagactgaactcaccaaaatccgtctcctcagggcaattgttgaaacccgtgatccctcttccaaggaagaggatgattttatgattagaagattcctgcgtgctcgtgatttagatgtagagaaggcttcggcaatgctcctcaagtacttgaaatggagaaattcatttgttccaaatggctctgtatctgtgtcagatgttcctaacgaacttgcacaagataaggtgttcatgcaaggacacgacaagataggtcgacctatacttatggtcttcggtggaagacattttcagaacaaggatggtcttgatgaattcaagcgatttgttgtttatgttcttgataaagtatgtgcaagtatgccacctgggcaagaaaagtttgtcggtatagcagaacttaagggatggggatactcaaacagtgacgtgcgtggatatcttagtgctctatccattttgcaggattactacccagagagattggggaagttgtttattgtgaacgcaccatacatctttatgaaagtgtggcaaattgtttacccattcattgacaacaaaaccaagaaaaagatagtatttgtggagaaaaataaggtgaaatcaacactgctagaagagatggaggaaagtcaggtcccagagatattcggtggctcactgccattagtcccaattcaagatagctaattaattaagtaaccgctgacagaataaggagaggcgggcctaaaaataaatattgttatttcttatttatgtgtttctatgccgttttctttttacccaattactttacactgttgtatcagctatcaatattcagtagtaaatgagtacgaaaaaaaaaaaaaaagg

SEQ ID NO: 428 - DNA, 2238 bp, Zea mays
  CDS (49)..(1938)
cttatctcctcctccaccccgagatatttccacgtctcctccgccaccatggagtccggcctcgttgcaagccaccgcctccgcgtcccgcccccctccgcctccgccgggcaccaccacctcatccgccaccgccacgcccacgccccggtggccgctgcgcccctccgcctcagtctcccgcgccacctcccccggtccaccccgctccgcctgcccgccgcgctcccgctccgccactgcctcccgcccctccgcgccgcctccgccgccgccgccgcagtcccagcgcccggggacgacgcgtcgcccaagttcctgggcgtggagacgaagacaatcaagaagatcgtgcccctggggctcatgttcttctgcatcctcttcaactacaccatcctgcgggataccaaggacgtgctcgtcgtcaccgccaagggcagcagcgccgagatcatcccgttcctcaagacctgggtcaacctgcccatggcagtcggcttcatgctcctctacaccaagctcgccgatgtcctctccaaggaggcgctcttctacgccgtcatcttcccgttcatcgccttcttcggcgccttcgcctacgtgctctaccccatgcgcgacgccatccaccccactgcgctcgctgatcgcctcctcgcctcgctcgggcccagcttcctcggacccgttgccatcctccgcgtctggagcttctgcctcttctacgtcatggccgagctctggggcagtgtcgtcatatccgtccttttctgggggtttgcaaatcagattactacagttgaagaggccaaagagttctacccgctgtttggccttggtgccaatgtggccctcatcttctctgggcgcacggtgaaatatttctcaaacatgaggaagaatttgggtcctggagtggatggttgggcaatttcgttgaaggccatgatgagcatagtggttgtactgggtcttgtcatcaccggtatctattggggagtgaacaagtttgttattgataactcatctgtgcccgtggttgagcggaaaaagaaggacaagccaaagctcagcatgggtgagagcatgaaggttctgttgtcatctcggtatgtgagggatcttgctacattggttgttgcttatggaataagcattaaccttgtcgaggtgacatggaaatcaaaactgaaagcacagttcccaagcccgaatgaatattcttcattcatgggcgatttctcaactgccaccggcatagctacatttacaatgatgttgttaggaagagtgatcctcagaaagtttgggtggggagttgcagctacaatcacgcctgcagtgttactcctcacaggagttgggttcttctcactgattttgtttggtgagccattgactcctcttatgaccaagtttgggatgacacctttgcttgcggcagtctatgttggagcaatgcagaacattttcagtaagagtgcaaaatacagtctgtttgatccttgcaaagagatggcatacattcctttggatgaggatatgaaggtgaaaggtaaagcggctattgatgttgtgtgcaaccccttggggaaatctggaggtgctctgatccagcagttcatgatcctgtcattcggatctctcgcgaactcgacaccctaccttggcggaatactcctggtgatcgtccttgcatggctgggtgctgtaaggtccctcgacctgcagttctcttccctggcgaagcaagagctcggcagagagaagctgctgaaaacgcaggccgtcgaaacggtcgccgaagtagtcggcactggaaacggttctctccaagaaactctagctagtgagccgtctgcaaatggcgcggccaccaaacagtcgcaagaacctgagagcacagcccctgagaaatcaggccagcagtctcaataagttctccccccaagaaatttagctagcacgagccttttggaggaaccggaagtttcttatctggagctactgaagaaggcaggaatcatgccagaaataagaagggcctgttcttcttgtgttgttgtagcgtttttgtttttaaacttcgccgtatctgtagctgtttgtttcattccataggtatgaactgtttatgttcgttattaaaattttgggaggtctgcttcatcgtaatcttcattagcagctggtccttgttgtggaaaaaaatattttgcatggttttgataaaaa

SEQ ID NO: 429 - DNA, 1400 bp, Xylella fastidiosa
  CDS (54)..(1376)
acgaacggtgcagccaacgcgccccagctcgccgctggcgccaaggagcagtaatgccgggcgccgcaccgacttcaccgtcccgacagcccctgttgcagcgcttggcgggcgtgcgcccggaggaagcgccggccgtcctgtggtcgatgctctacgtcgtcgcgctgttcctggcgtactacgtgctgcgcccgatccgcgacgagctgggcgtggctggtggcgtgcagaacctgccgtggctgttcaccggcacgctgctggcgatgctggtggccagccccttgttcgcgctggcggtgcgcagcctgccgcgccggcagttcatcgccttagcctaccgcttctttgcagcgaacctggtgctgttcgcgctgctgctgcacttcgccgatccgcagtggcaggtgtgggtgggccgggccttcttcatctgggtctcggtcttcaacctgttcgtcgtgtcggtgttctggtccttcatggtggatctcttcgacagtgagcagggcaagcgactgttcggactgttcgctgccggcgccacggcgggcggcctgctgggctcggccatcacgtccggcctgatcgagcacctggaccgctcctggctgatggcgatcgccatcgtgttcctggaactggcagtgctcgcctcgcgccggctgtcgcgcatcgcgccggcgttccagcacgccgcgcgccgcgacaacccggatcagccgctgggaggcggcatcttcgcgggcatggtccacacgctgcgctcgccctacctgggcgggctggcgatcttcatcctgctgtactcggtcacctcgaccttcctgtacttccagcaggccagcatcgcgcaggcctcgttccccgaccgggcggcccgcacggcgttcttcgccaacatcgacctcatcgtcaacgcggtgacgctggtgttccagctcttcgtcacgggccggatgatggcgaccgtgggcatcgtggcgaccctgtgcgtgctgcccctggtgagcctgctgggcttcgcggccctggccgccagccccagcgtcgccgtcatcgtggccgcgcaggtggcccggcgcgtggctaacttcgcactggcccggcctgcccgcgaaatcctgttcacctccagcgcccgagaagaccgctacaaggccaagaacttcatcgacaccgtggtgtaccggggcggcgaccagatcgccagttggggctatgcgggcctgatgggcctgggcctgaccctcgcgcagattcccatgatcgcggtgccgctgtcggccgtctggctgggcctgagcgtctggctggggcgcacccaccaggcgcaggagcggcaggacgccgccaccgcgccatccatccactgaggacacgaccatgaagccttc

SEQ ID NO: 430 - DNA, 1350 bp, Saccharomyces cerevisiae
  CDS (66)..(1022)
gttcttttttgtgtgctcttttatacttcagaatcatacattaacatacatataagcaaatagccatgtcttccaacgcccaagtcaaaaccccattacctccagccccagctccaaagaaggaatctaactttttgattgatttcttaatgggtggtgtcagtgccgctgtcgccaaaactgctgcatctcccatcgaaagagttaaacttttgatccaaaaccaagatgaaatgttaaaacaaggtactttggacagaaaatacgcaggtatcttagactgtttcaagagaaccgctacacaggaaggtgttatctcattctggagaggtaacactgctaacgttatccgttatttccccactcaagctttgaatttcgccttcaaggacaagatcaaggccatgtttggtttcaagaaggaagaaggttacgccaaatggtttgccggtaacttggcatctggtggtgctgctggtgccttgtcattactatttgtttactctttggattatgcaagaactagattggctgctgactccaagtcctctaaaaagggtggtgctcgtcaattcaacggtttgatcgatgtctacaagaagaccttaaaatctgatggtgttgctggtctttacagaggtttcttaccttctgtcgttggtattgttgtctacagaggtctatacttcggtatgtacgattctttgaagcctctattgttgactggttctttggaaggttcattcttggcttcattcttgttgggttgggttgttactactggtgcttctacatgttcttacccattggataccgttagaagaagaatgatgatgacctccggtcaagctgttaagtacgacggtgcctttgactgtttgaggaagattgttgctgctgaaggtgttggttctctattcaagggttgtggtgctaacatcttaagaggtgtcgcaggtgctggtgttatctcaatgtacgaccaactgcaaatgatcttgtttggtaagaagttcaaataagtctaatctggcttgattcttaatctaaattctttctcacattttcctttttttcttctttggatttttggtgtttaatgagtgacacgatttgttttgataatattattatcctcctatttttttagaaattcttttcaacaagaatcaaagattcataaaaaaagaaaacgatgaaattttttgaacaacttttacgtataaagaagaaaaaaaaaaaattctaaatatccagtaaatagttttatattagtagtattctttcccactttttaaatgtcatcacatgatgtttcttataaaatgcaatttttttattacttaatca

SEQ ID NO: 431 - DNA, 4001 bp, Oryza sativa
  CDS (109)..(915), (2211)..(2480), (2563)..(2706), (2792)..(3145), (3591)..(3950)
tattactcccaaagttccccccgacctactcctcctcctcctcctttccctccctccgcctccccccacctcgcgtctcgcggagcccggagagcagcggcgccgcccatggagtcgctcgcgctcctccacgccaagcccggcggcctccctccccgcgcggggctccgcctcccgctcccgcgcgcgcgatccgcgcgcgtctccctcccctcctccccggcggcccccgtatcgctccagtccccgctcctcctcgcttcgagaagcggccctacctcgcgggacgccgtcgtggggttgggattggggtgcgggctcttgagacggaggagcggcgctagtggtggtggtggtggtggggtctcttgcggcgcgcagcctgccgcggcggcggcggcgggggcggtgccggcggcgcagccggaggggaagaagttcctcggcgtggaggtgaagacgctgaagaagatcgtgccgctcgggttgatgttcttctgcatcttgttcaactacacgatcctgcgggacaccaaggacgtgctggtggtgaccgccaaggggagcagcgcggagatcatcccgttcctcaagacgtgggtcaacctgcccatggccatcggcttcatgctcctctacaccaagctctccaatgtgctctccagggaggcgctcttctacaccgtcatcttccccttcatcgccttcttcggcgcctttgccttcgtgctctaccctctcaggaatgtgatccaccccaccgcgctcgccgacaagctccttgcggcgctcggcccgagctttcttggccccgtcgccattctgaggatttggagcttttgcttgttctatgtcatggccgaactgtggggcagcgtcgtcatctcggtcctcttctggggcttcgctaaccaggtgagtcatgggtttggatttttgtggtcaatctaggcatgtgcaaatgtcaatttattgtctattttcagtcaaaaattgatggccatctcattagctaatgtttaacctgatgtttggctgtggagagcaaaacatgaaggagcagagtttgttgttgggtttctgtcactccgtcagaaattaggatgtgctcttgggataatgggtagttacagaaacgttggtttgattagtatttagtagtattgctcagtgtattgtcaaacctattggctaagtctaggtgcttgttgctttctggcatgaatgccttcaacttcatgattgctactttgctagcttttgttaatctgaattatatttagttggttaagttgcatttttgttgtgatatgcgttcttttacaaccacttgcctggatatggttcacactttttaactgcttttgcaataagtaatgttgattgatgtgggcctgtttgttttgagggccagagttgcagatgaaaccctagccaattttggtactaccaaaccaaacaagctgcagcctttaacataacatgtggccatattatggctacttttcttcccacaaaggaatgcctgaatgcttatattggatagttttatacatacatttcatttgtgtgaaacagtagggaggatccttgctggaagttcaagagggggaagaaatacttagggcaagatttaaaataagagaaaacaaagacagaaacaagcttttcaggagatagggatactctacacaaccatgagtagctagctgataataattcaagacaatctaggtgatagaatggcattatttcacaagtacaaatgtttgaacttctctcttatatctatctgagagaagacggtggaatagattgtgtcaactctctgactgaataattctgcataggggatatagagttttttttttctgggccatttgccagagtggctttgtgggctgttggtcatgcctgaatgagtaatgttggtgcatccgaataacacgtgtgtcctcagctatttgatttcagaattacatctgaatggtaggtgatcaatgtcctcagttatgcagagttcacagtggttgttttttgttgttcacgaagcttgaccagaggtgtataactgtcaattggttgcaagctggatggggttttctagtgttgtctgacgtttggttgtatatacctgtttaatattttctgaacttcccatcaaatggtgacccttcaggctacaactgatttcatccatccttctgcagattactacagttgaggaagcaaaagaattctaccctctatttggtcttggggctaatattgcgctcatcttttctgggcgtactgtgaagtatttctcaaatctgcgcaagacattgggtccaggtattgacggatgggaggtgtctttgaaaggaatgatgagcttagtggtgcttcttggacttgtcatcacttccatctattggggggtgaacaagtttgttttgaatgatccttctcttccgaagtctgaccgtaagaagaaaaaggtcagccgaatagttaaatgtgcttcttttttttttttactactactactacaaataatgcactaacgttttttttcaacaggataaacctaagcttggaatgaaagagagtcttaaagttctcctctcctcaagatatgtaagggaccttgctactttagtggttgcatatggcatcagtatcaaccttgtggaggtcacatggaaatcgaagctcaaggcacaggtaactttctcagctttgtttgtttcatcttcagattaatttgtcaaacagtttttctaattaagtatttctttcttcatcatggcagttccctagtccaaatgagtattcatctttcatgggtgatttctcaaccgctactggcattgctactttcacaatgatgctgttaggccggatcatactccgaaaattcggctggggagtggctgcaatgatcacccccacagttttgttgctgactggcgtcggtttcttctccctgattctatttgggcagcctctcactcctatgcttgccacaatgggcatgacccctcttcttgcagcagtttatgtgggtgcacttcagaacatattcagcaagagtgcaaagtatagtttatttgatccatgcaaagaaatggcctacattcctttggatgaagatatgaaggtttgcttctataccagattgcatatttattcatgtgattcgacgatgaacatttaaaaatatttttgcgcattattctgctttgtatactctcgtgattcatttaagcagtttgttgcttcatatatgcatatcccatgtgcatcatttagaaattatctagcaattcttgatgaactagtatctgttaagtaatttaaagcttctgtcttgatcctgtagttgtaagataacattgcctgtgtttacctgcttccattcattgcatcatatttgctttagttacaccaataagtgcaatccattggcatgagcaattgagcagtttgaactgaatgtcagttctctatccataaagtttgatgttgtgggctttgtacaaagcactagggcgagtttgcaccaccaattatgctgcagaagccaactctgcttcctctgtttgcaggtgaagggaaaggcagccattgatgttgtctgcaacccattggggaagtctggtggagctcttattcaacagttcatgatccttacatttggctctttagctaactccaccccctaccttggtggcatactgttggtgattgttctagcatggctaggcgcggcaagttcactagacaagcaattctctagcttggctaaggaagatctcaaaagggatatgtctgcaaaagagaaggtagatccttccctgctcaaggctcctgaggctgatgtattggtggagcacacaaacggcactatagagagcgaagctactgcaactgagagttcaccatcaaactcatctccaagtaattagattcatctttctttgacaaagtcaatcgataggtaggagaatgattgcagt

SEQ ID NO: 432 - DNA, 2438 bp, Zea mays
  CDS (184)..(2214)
ggcctcctccctgagacaatccccacgccaccgcgcaccggagacgaacctgaggagagaaaaaatctgcgcccgtcagtgtgctcgcctacttctacgctccgctcgttcccccaaatagttcctcggcttcgctcccttcccctccctgctccggctccggttcgcacacagtaagaaaagatggcgctgccatccatgagtcttgtggcaaagggtgtgcttcccttctcagcacgtacctcgagtggtgtcacacaaaggccggtgtcagtgactgcttccttggagcacaaaaccagcgatgccagaaggaagttcctaaaacttgcgcttgggaaccttggagttggactgcccaccttgttgggcgctaagaaagctctcgctgatgagcaaggcgtctcgtcctcgaggatgtcttattcgaggttccttgagtatcttgacaaggatagagtgaagaaggttgatttgtttgagaatgggacaattgctattgtggaggccatttctcctgagcttggtaaccgcgtgcaaagagtccgtgtgcagcttcctggtctaagccaggagcttcttcaaaagttgagggagaagaacatcgattttgctgctcacagcaaccaggaggactctggttctcttctgttcaaccttattggaaatttggcattcccgcttatccttatcggtggtctgtttttactttcaagaagggcacagggtggcctcggtggacccaatggtcctggctttccccttggttttggtcaatctagggccaagtttcagatggaacccaacactggtgttacatttgatgatgttgctggtgtcgatgaagcgaagcaagacttcatggaagtggttgagttcttgaagaaacccgaaaggttcactgctgttggtgctcgcattcctaagggtgttctgcttgtcggtcctcctgggacgggtaaaactttgcttgccaaggcaattgcaggagaggctggcgtgccatttttctcaatttcaggttctgaatttgtggagatgtttgttggtgttggagcttccagagttcgtgaccttttcaagaaggccaaggagaatgctccttgcatagtgtttgttgatgaaattgatgctgttggaaggcaaagaggtacaggtattggtggtggaaatgatgaaagggagcagactctcaatcaactactaactgagatggatggtttcgagggcaacactggaattattgttattgctgccactaaccgggctgacatattggattccgctttacttagacctgggcgttttgatagacaggtgtctgtcgacgttcctgatgtacgtggaaggacagagattctaaaagtgcatggtagcaacaagaaatttgattctgatgtttctcttgatgtcatagcaatgagaacacctgggttcagcggagcagacttggcaaaccttctgaatgaagcagccattctggctggaagacggggaaggacagcaatttcttcaaaagagattgatgattctattgacagaattgtagctggtatggaagggaccgtgatgacagacgggaagagcaaaagtcttgttgcttaccatgaagttgggcatgcaatttgcggaactttgacgcctggccatgatcctgtccaaaaggttaccttagttccaaggggtcaagctcgtggtcttacatggtttatcccgatggatgacccaacactcatctccaggcagcaactttttgccagaattgttggcggccttggtggtagagctgctgaggaggtcatatttggagagcctgaggtgaccactggagctgctggtgacttgcagcaaattactggcttagccaagcagatggtggtgacattcggtatgtctgaaattggtccatggtctctgatggagggtggagcgcagagtggggacgtcatcatgagaatgatggcaaggaactccatgtcagagaagctcgcggaggacattgattcggccgtgaagcagttgtcggatgaggcctacgagatcgctttgaggcacattagaaacaacagggaggccattgacaaaatcgttgaggtgctcattgagaaggagacagtgaccggagacgagttccgggcgatcctttctgagtttgccgagatccctgttgagaaccgggttcccccagccacaccggcggctgcgctcccagcctaaaccctagccttgtaggggaggattttcttgttgtatggtgttcatattttggattcttggtgtactctaactctactaaatctgccggattttcggtactcgacatgtaagatgtaacttactcatggtgaattaatagtaaaatgtaattagattaaaataataggcctggcgcaacattttcagtttggaaaaaaaaaaaaaaaaaaaaaaaaaaaaaa

SEQ ID NO: 433 - DNA, 2712 bp, Zea mays
  CDS (104)..(2533)
acgcgggccgcatctcgcattctcgccggtgctgctgcaattaacgccgcctccggccaaccacccgaaacctacctccgccgccgtcgtcgccaccgtcaacatggcgagccaaggggagccctcggcctctgcttccgatccgaaggagaagaaggactactcgacggcgatactagagaggaaaaagtcaccgaaccgccttgtcgtcgacgaggccaccaacgacgataactccgtcgtcgcactgcaccctgacaccatggagaggctgcagctcttccgcggcgatactgtgctcctcaagggtaagaagaggaaagacactgtttgcattgtccttgcggatgaaacctgtgaggagccaaaggttcggatgaacaaggttgtccgccagaacctgagggtgaggcttggtgatgtggtttctgtccaccagtgccaggatgtgaaatatgggaagcgtgtgcacattcttccaattgatgatacagttgaaggcattacagggaacctgtttgatgccttcttgaaaccatacttcctagaagcatacaggcccgtgaggaaaggagacctcttccttgtcaggggtggaatgagaagcgtggaattcaaagtgatagagactgacccttctgaatattgtatcgttgccccagatactgaaatattttgtgatggggagcctattaagagagaggatgaggagcgtcttgatgaagttggttatgatgatgttggtggagttagaaagcaaatggcccaaatcagagagcttgttgagcttccactacgccatcctcagcttttcaaatctattggtgtgaagccaccaaagggcatattgctgtatgggccacctggttctggaaagactcttattgctcgtgctgttgctaatgagactggagcctttttctttctgatcaatggcccagagattatgtcgaagttagcaggagagagtgagagcaatctcagaaaggcatttgaagaagcagagaagaatgctccatctatcattttcattgatgaaattgattccattgcacccaagagagaaaagaccaatggagaagtagaacgtcgtattgtttcacagctactgactcttatggatggactcaaatctcgttcccatgttattgttatgggtgctacaaaccggccaaacagcatcgatcctgctcttagaagatttggaaggtttgaccgggaaattgacattggagttcctgatgaagttggccggcttgaggttctccgtattcacactaagaacatgaagctagctgaagatgttaatttggaactcatttcaaaggatacccatggatacgttggtgctgatcttgctgctctttgtactgaggctgctcttcagtgcattcgtgagaagatggacatcatagatcttgaggatgagacaatagatgcagagatattgaactcgatggctgttacaaatgaccatttcaagactgcgcttggaacaagcaacccatctgctctccgtgaaactgttgttgaagtcccaaatgtctcttgggaggatattggtgggctggagaatgtcaagagggagctccaggagactgttcaatatcctgtggaacatccagagaagttcgagaagtttggcatgtctccatccaaaggagttctgttttatggtcctcctggttgtggtaaaaccttgttggcgaaggcaattgccaacgagtgccaggctaacttcatcagtgtcaagggtcctgaattgcttaccatgtggtttggtgagagtgaagccaacgtccgcgaaatttttgataaggctcgccaatctgctccttgtgtcctcttctttgatgagcttgactcaattgcgacgcagagaggaagtagtgtgggtgatgctggaggcgcggctgatagagtgcttaatcagctactgaccgagatggatggcatgaacgccaagaaaactgtgtttattattggtgctacaaacaggcctgacatcattgatcctgctcttctgaggccagggcgtcttgaccagctgatctacattccactgcctgatgagcagtctaggctccagatcttcaaggcctgcctaaggaagtcccctgtggcaaaggatgtggacctgaatgctcttgctaagtacacacaagggttcagtggagcagatatcacagaaatttgccagcgtgcgtgcaaatatgcaatcagagagaacattgagaaggacattgagagggaaaggcggatgaaggacaaccctgaggcgatggaggaagatgaagtggacgagattgccgagatcaaagcagctcacttcgaggagtctatgaagtatgctcggcgcagtgtcagtgatgctgatatccgcaagtaccaggcgttcgcccagacgttgcagcagtcccgtgggttcggcagcgagttccgcttctcagagcagtcggcgacagctggtgctgctgcagccgatccgtttgcttcggctggtgctgcggctgacgatgacgatctatacagctaggtgtcctgttgggttggttctgggttgtgcaatatcagtctcatcagtcatctgtttaaaactctgattatacttagacacgggatgtcatgcaatgatatttgttttccgtacatttggacgttgagataatgcctgtttattttaaaaaaaaaaaaaaaaaaaaaaaaaaaaaa

SEQ ID NO: 434 - DNA, 813 bp, Arabidopsis thaliana
  CDS (1)..(810)
atggaacttaacagatctgaagcagacgaagcaaaggccgagaccactcccaccggtggagccaccagctcagccacagcctctggctcttcctccggacgtcgtccacgtggtcgtcctgcaggttccaaaaacaaacccaaacctccgacgattataactagagatagtcctaacgtccttagatcacacgttcttgaagtcacctccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgttgatggctgcttcttttgcaaacgcagtttatgataggttaccgattgaagaggaagaaaccccaccgccgagaaccaccggggtgcagcagcagcagccggaggcgtctcagtcgtcggaggttacggggagtggggcccaggcgtgtgagtcaaacctccaaggtggaaatggtggaggaggtgttgctttctacaatcttggaatgaatatgaacaattttcaattctccgggggagatatttacggtatgagcggcggtagcggaggaggtggtggcggtgcgactagacccgcgttttag

SEQ ID NO: 435 - DNA, 750 bp, Arabidopsis thaliana
  CDS (1)..(747)
atggcttatgggaagaggccttttggaggtgatgaatctgaagaaagggaagaagatgagaacttgttcccggtcttctcggcccgatctcaacacgacatgcgtgttatggtctcggccttgactcaagtaatcggaaaccaacaaagcaaatctcatgataacatcagctctattgatgataactatccttctgtgtataatccacaagaccctaatcaacaagttgcgcctactcatcaagaccaaggggacttgaggaggagacattatagaggtgtaaggcaaaggccatggggaaagtgggcagctgaaatccgagacccaaaaaaggcggcacgtgtgtggctcgggacatttgaaaccgctgaatctgcggccttagcttatgatgaagcagccctaaagttcaaaggaagcaaagcaaaactcaatttcccggagagggttcagcttggaagtaactctacatattactcctccaaccaaattccacaaatggaaccacaaagtataccgaactataatcaatactatcatgatgcgagtagtggtgatatgctaagttttaatttgggcggtgggtatgggagtggtaccggatattcaatgtctcatgataatagtactacgactgctgctacaacttcttcgtcttctggtggctcttctaggcaacaagaagagcaagattatgccagattctggcgctttggggattcttcttcctctcctcattcgggatattag

SEQ ID NO: 436 - DNA, 477 bp, Arabidopsis thaliana
  CDS (1)..(474)
atggaggtctctaactcttgttcttcattttcttcatcctctgtcgacagtactaaaccttctccttctgaatcttctgttaatctctcccttagtctcacatttccttctacttctccacaaagagaagcaagacaagattggccaccgataaagtctagattaagagatacactaaagggtcgtcgtcttcttcgtcgtggtgatgacacttctctctttgttaaggtttatatggaaggtgttcccattggaagaaaactcgacctttgcgtattctcaggctacgagagtctattagaaaatctctctcacatgttcgatacttcaatcatctgcggtaatcgagatcgaaaacatcatgttttgacatatgaagacaaggatggagattggatgatggtcggagatattccatgggatatgtttcttgaaaccgtgagaagactaaagatcacgagaccggagaggtattag

SEQ ID NO: 437 - DNA, 1164 bp, Arabidopsis thaliana
  CDS (1)..(1161)
atggcgtcgtctccgttgactgcaaatgttcagggtaccaacgcttctttgaggaatagagatgaagaaactgcagacaagcagatacaattcaatgaccaaagttttgggggaaatgactatgcacccaaggtacggaagccatacacgataacaaaagagagagagagatggacagatgaagagcacaagaagtttgttgaagccttgaaattatacgggcgagcttggagacgaatagaagaacatgtgggctcaaagaccgcagttcagattcgaagccatgctcagaagtttttctctaaggttgctcgagaagcaactggaggtgatgggagctcagtagagccgattgtaatacctcctcctcgtcccaagagaaagccagcgcatccgtaccctcgtaagtttgggaacgaggcagatcaaacgagtagatcggtttctccctcagaacgtgatactcaatctccaacctctgtgttgtccactgttggatcagaagcattgtgttcccttgattcgagttcacccaatcgaagcttgtccccagtttcttctgcatcaccaccagctgctcttacaaccactgcaaatgcacctgaagagcttgagactctgaagctggagttgtttcctagtgagagactcttaaacagggagagctcgatcaaggaaccaacgaagcaaagtcttaaactctttgggaagacagttttggtatctgattcaggcatgtcctcttctctaacaacttcaacatattgtaaatccccaattcagccattaccacggaaactctcatcatccaagacactacccataataagaaactcacaagaagaactcttgagctgctggatacaagtccctcttaagcaagaagatgtggaaaatagatgtttggattcaggaaaggctgtccaaaacgaaggatcatcgactggatcaaacactggttcggtggatgatacgggacacacggaaaagaccacagaacccgaaacaatgctatgtcaatgggagtttaaaccaagtgagaggtctgcattttctgagctcagaagaacaaactccgagtcaaattcaagaggatttggtccatacaagaagagaaagatggtaacagaagaagaagagcatgagattcatctccacttatag

SEQ ID NO: 438 - DNA, 1197 bp, Arabidopsis thaliana
  CDS (1)..(1194)
atggataaggagaaatctccagcacctccttgtggaggtcttcctcctccatctccatcaggtcgatgctctgcattctcagaagctggtcccattggtcatggttcagatgctaatcgaatgagtcatgatattagccgtatgcttgataacccacctaagaagattggacatcggcgagctcattctgaaatacttactctccctgatgatttgagctttgatagtgatcttggtgtggttggtaatgctgctgatggagcttctttctctgatgagactgaagaagatttgctctctatgtatcttgatatggataagtttaattcttctgctacatcttctgcccaagttggtgagccatcaggaactgcttggaaaaatgagacaatgatgcagacaggcacaggctcaacttccaatcctcagaatacggttaatagtcttggcgaaaggccaagaatcaggcatcaacatagccaatctatggatggttcaatgaatatcaatgagatgcttatgtcgggaaatgaagatgattctgctattgatgctaagaagtctatgtctgctactaaacttgctgagcttgctctcattgatcctaaacgtgctaagaggatatgggcaaacaggcagtccgcagcacgatcgaaagaaaggaagacgagatacatatttgagcttgagagaaaagtacagactttgcaaacagaggctacaactctctcagcccagttgaccctcttacagagagacacaaatggcttgactgttgaaaacaatgagctgaagctgcggttacaaacaatggagcagcaggttcacttgcaggatgaactaaacgaagcactaaaggaggaaatccagcatctgaaggtgttgactggccaagttgctccatcagcgttgaactatgggtcgtttggatcaaaccagcagcaattctattccaacaatcagtcaatgcaaacaatcttagctgcaaaacagttccagcaacttcagattcattcacagaagcagcaacaacaacaacaacaacaacaacagcaacaccaacagcagcagcagcaacagcaacagtatcagtttcaacagcaacagatgcaacagcttatgcagcagcggcttcaacagcaagaacaacaaaatggagtaagactcaagccttcacaagcccagaaagagaactag

SEQ ID NO: 439 - DNA, 639 bp, Arabidopsis thaliana
  CDS (1)..(636)
atggtctccgctctcagccgtgtcatagagaatccgacagacccgccggtcaaacaagagcttgataaatcggatcaacatcaaccagaccaagatcaaccaagaagaagacactatagaggcgtaaggcagagaccatggggtaaatgggcggcagaaatccgcgatccaaagaaagcagcccgtgtctggctcgggactttcgagacggcagaggaagctgctttagcctatgaccgagctgccctcaaattcaaaggcaccaaggctaaactgaacttccctgaacgggtccaaggccctactaccaccacaaccatttctcatgcaccaagaggagttagtgaatccatgaactcacctcctcctcgacctggtccaccttcaactactactacttcgtggccaatgacttataaccaggacatacttcaatacgctcagttgcttacgagtaacaatgaggttgatttatcatactacacgtcgactctcttcagtcaacctttttcaacgccttcttcatcttcttcttcctcccaacagacgcagcaacagcagctacaacaacaacaacagcagcgtgaagaagaagagaagaattatggttacaattattataactacccaagagaataa

SEQ ID NO: 440 - DNA, 1585 bp, Glycine max
  CDS (275)..(1345)
attcggctcgagtctgtctctttgctccatttcagtgctctgtcttctcccccaccaccgcactctctcagatattatcatttcatatcacacattcacatcctatcatcatcgacaacacgctatccccattgcttcttctcttctccctctctcgtttcctacttgacggcgccgtttcgttctccagaagatgcttctgagtacttcgcgctgcaactagacatgatgagttcaagtttcaagacatgggctgtgggatttgcacttggaaatgaaggagaggcaacgttggagagctgaagaggatgctttattacgttcttatgtcaaacagtatggtcctagggaatggaatcttgtgtctcagcgcatgaacacatatcttaacagggatgctaagtcgtgcttggagaggtggaagaactacctcaagcctggcatcaaaaaaggctctcttactgaagaagagcagcgccttgtcatccaccttcaagcaaaatatggaaacaaatggaagaaaatcgctgctgaagtcccagggcgcactgctaagcggttaggcaagtggtgggaagtcttcaaagagaagcagcagagagagaaaaaggagatcaatagaattgccgacccaattaacaatagtaagtacgagcacatactcgagagttttgcagagaaactagttaaggaacgcccttcaccatcatttgtcatggctgcttccgatggggcatttctgctcactgatacaccagcacctgcatcttccttgcgtccttcttggctttccaattctagtagtgctgcagccatcggcccaagttccctttctgtgaaactaagtctttcttcctcaacggtggccacacctccattttcatggttgccacccgagagaggaccagacaatgctccttttgttttggggaatgtatcagcgcttcatggagctattccaactctaagtgatagcatgcatatgtctcagatggtggagcactgtaaagagttgggagaggggcatcgtgctttggccacgcacaagaaggaggcagcttggaggttaagtcgggtggagttacagttggagtcagagaaggccaaccgaagaagggagaagattgaagaatttgaagcaaagattaaagctcttcaggaagaggagaaagctgctttaggtagaattgaagcagaatacagagaacagttagctgcattgaggagagatgctgaaaacaaggagcaaaagttggcagaacaatgggatgcaaagcatttacggtttactaggttactagagcaattaggatgcagagcagggctccttgagccaaatgcaagatgaagatatattttggcaaaatggatattggtgctcttctgactaaaattatatgcagtttgtgatcttggtatatttttattttagacgtgtatgaatttcctatctattcatacaacttgagtaacttccgttaacagttgaattacctgcatatggtatcacatccgagtttataaacttagttatattcctgaaaaaaaaaaaaaaaaaaaaaaaaaaaaaaaaaaaaaaaaaaag

SEQ ID NO: 441 - DNA, 1494 bp, Glycine max
  CDS (178)..(1260)
ctcggtttccactttctctctgtttaagaactcaccacttcttcaacttggtgccgttgtttcatggaccagaactacgcctcatagctcctttctcatttcacacacacaaagaaccttgagacatcatgaagattccaagttccaagcaactggttgtgggatttgcacttggaaatgaaggataggcaacgttggagagctgaagaggatgctttactacgcgcatatgtcaaacagtatggtcctagggaatggaatctggtgtctcagcgcatgaacacacctcttaacagggatgccaagtcatgcttagaaaggtggaagaactacctcaagcccggcattaagaaaggatctcttacagaggaagagcagcgtctagtcatcaaccttcaagcaacacacggcaacaagtggaagaaaattgcagcacaagtccctggtcgcacagcaaagaggttagggaagtggtgggaagtgttcaaagagaagcagcaaagggaaacaaaggggaataactgcaccattgacccaattaacgatagcaagtacgagcatatccttgagagttttgcagagaagctagtgaaagaaaggccttcaacatcaacatcaacatcatttgttatggctacttccaacagttcttttctgcatgctgatgcaccggctcctgcaccagccttgcttccgtcttggctttccaattccaatggcactgcacctgtgaggccaccctccccttctgtgactcttagtctttctccctcgacggtggcagcgcctcctccatggatgcagccccccgtcagaggacaggacaatgctagtcctcttgttttggggaatgtggcgcctcacggggctgttctagcatttggtgagaacatggtgatgtctgagctagtggagtgctgcaaggagttggatgaagtgcatcatgctttggccgggcataagaaggaggcagcatggcggttaagcagggtggagctgcagttggagtctgagaaggccgggcgaaggagggagaagatggaggaaatcgaagcgaaaatcaaagctctgagggaggagcaaacggctgcattggatagaattgaagcagaatatagggagcagttggcagggctgagaagagatgctgaaagcaaggagcaaaagttggctgaacaatgggctgcaaaacacttgcgacttactaagtttctagaacaggtagggtgcagatcaaggctcactgaaccaaatggaagatagagtgacatcaatcattcacaaattgggaaaatctagtttgcttttacttattattatgtcttgaatttatatgatatgaactttatagtcatagtagttttgttcctgtcatttttctaaaatatgttgttacatatggttattgatatcatccctatcttttcatacaacttgaggacttgcattagcggttgagttatgtttaaatataacatcctttatgaaaaaaaa

SEQ ID NO: 442 - DNA, 1547 bp, Zea mays
  CDS (92)..(1144)
gagagaatctaaagtgaccggacgctgtccttccttgctgatcggcgacacggtccatccctccctcgctcgctagggttccttttcgtccatggatcagagcttcgggaatctcggggccggagctgggagcagcagcgggggctccaactccaaggcggcggcagccgccgtgtcctcctcgtctttcctgcagctgccgctgtcgacggcgtcccccgcgtactacggcgcgccgctcgcgctcctgcaccacgccgccgcggccccgtcgtcgtcgcagcagcaccagcagcagcagcaccaccaccactacgccaggcacggcgccgagatgtcggcagcggaggccgaggccatcaaggccaagatcgtggcgcacccgcagtactcggcgctcctcgccgcctacctcgactgccagaaagtgggcgcgccgccggacgtgctggagaggctgacggccatggcggcaaagctggacgcgcgcccgccgggccgccacgagccgcgcgacccggagctggaccagttcatggaggcgtactgtaacatgctcgtcaagtaccgggaggagctcacccggccgatcgacgaggccatggagttcctcaagcgggtggaggcgcagctcgactgcatctccggcggcggcggctcctcctcagcgcgcctctcgctcgccgatggtaaatcagaaggtgttggctcttctgaagatgacatggacccgaatggtcgcgagaacgatccgccggagattgacccacgagcggaggacaaggagctcaagtaccagctgctgaagaagtacagtggctacctgagcagcctcaggcaggagttttccaagaagaagaagaaagggaagctcccaaaggaggccaggcagaaactcctccactggtgggagctgcactacaagtggccgtacccttcagagacggagaagattgcgctcgcagaatcaacgggcctagaccagaagcagatcaacaactggttcatcaaccagaggaaacggcactggaagccatcggaggacatgcctttcgtgatgatggaaggcttccacccgcagaacgccgctgctctgtacatggacgggccgttcatggccgacggcatgtatcgcctcggttcatgaactacacacttccatggacgactgtgggggcctatccaatcgtcggaccgtgggagtatatttcagtgttgcggtgcaaggacattgttgtggaatttttgttgctgattgccaaggggtgggtcggtcgatgtagcgtctatgcatggcttgtagttctcctgtaatgttgttgttaatttccgcttggcggcttgtaatctaggtgtatctctggaacttgaatcctgggtgattaatccggcaagcagctgcctgtttgtatgattgtatggttcgggttggtggaacatgatgcatgctaaggcgtggcctgtctggatcaaaaaaaaagaagatgtcttttgtaccagtggaatgattggaacttcagattgctgaacaaaaaaaaaaaaaaaaa

SEQ ID NO: 443 - DNA, 1214 bp, Glycine max
  CDS (103)..(1026)
attcggctcgaggtggcagcataaccagaaaaaggttccagaaattctggtaaggaacgaagcaaagcaaacgcagcgtttcgtttcgtgtcgctgctggttatggatggaatgtacggagtgccggcggagtacgccgacaaggctctcatgacgccggagaatctgattttcccgccggactaccaccacgacttcctcgccgccggccggattccgctgttcggatccgacgagttcttctcctcctccgccggaattcaccggcagcaggaagatgacgtggcagccaccactgtcatgaaggccaaaatcgcctctcaccctcactaccctcgcctcctccaagcttacatcgagtgtcagaaggttggggcgcctccggaaatcgcgcgcttgttggaggaaatccggcgagaaaatgacccgtgcaagagcgacgccgtttcttcttccacgtgctttggagccgatcccgagcttgacgaattcatggaagcctactgcgacatgttggtgaagtataaatccgacttggctcgcccttttgatgaagcaaccactttcctcaacaagatcgaaatgcagctcagccatctctgcactggtgcttccgtttccaacgtttctgatgatgggggtgtgtcttcggacgaagatttgagtaccggagatggtgatgctcaagatggccaattaaagggtgaagatcgtgagctcaaggataggcttttacgaaagtttgggagtcacatcggtactttgaaactcgagttttcaaagaagaaaaagaagggtaagcttccaaaggaagcaagacaagcattgcttcaatggtggaatgttcactacaaatggccttaccctacggaagctgataagattgaactggctaagtcaacagggctggaccagaagcaaattaacaattggtttattaaccaaagaaaacgtcattggaaaccatcagagaatatgcagttttctatgatggaaaattttaacggacggatccttgctgatgaatgaatgaggtgcatgtacatgatattttcaaatgtatatcccgattaattattgcttgtattttcttttttgtaaattctaaattaaaagcagattactgacagtaaaatgcttattactttcccatgaaggaaaagggaaatgatcataatagtattcttgataaataactactgacattgtgaatt

SEQ ID NO: 444 - DNA, 1334 bp, Glycine max
  CDS (144)..(1076)
gaattcccgggtcgacccacgcgtccgtacggctgcgagagacgacagaaggggagaattagatatacatattttatttatttgcttaggatattgtcctaaaacttacttgcttggaccccagtagttgagttgaggaagtgatggaagcagtttacaggttgaaacctcttttggatgtggttagagttgggaacgctaccacttctgagatgcgtcttgactcaacggctaattgttacctgcagctagaagctcctcaacctcaagagaataataatgtaaccgactcatcatcagatatgtcggatcggataatcaagatccagatcgccaatcaccctctttatccagatttactctctgcatatattgaatgccaaaaggttggagcaccgccagaactggcatgccttcttgaagaaataggccgagaaagccaccgcatgaatgctcgccgtgagataggggagggccctgaacttgaccacttcatggaaacattctgccaagttcttcatagatacaaggaggagttgtccaggcccttcaacgaagcgactttgtttttgggtgacatggaatcacaactcagcaacctttgtaatgaaacactaacaaagtcatcggataacaacaaccgctccgacgaggtagctagtggggcatcagaagaggaattaagttgtggggagatggaagcatttgaagataatgtatcttcagtaacttgtccaagtgatcaaaggcttaaagagatgctccttcgcaaatacagtggccattttagcggtttgagaaaggaatttctgaaacgaagaaaaaagggtaagctaccaaaggatgcaaggatggcactcatgggctggtggaacacccatcatagatggccttatcctacggaggaggagaaagtgaagttatcagaaattactggtctggatcaaaagcagatcaataattggttcatcaatcagagaaaacggcattggaaacctaccgaggacatgcgatttgccgtcatggacggattaagaggcggcggtggcggcggcataggagggcctatgttgttttagctctggaagtgctcctcaacgatctgaacttgtacccttcgtaattgcaggagcaatgtatgtgcattgcattcctgttacacgtgatatatatactaaattttagagactgaactgttgtttagctaatatacttgtcaaagttgtagttatagtagtgtaatgcgccattgttatgcagtattcctgaatctttgattatattataacaatgtcgtgctgaaaaaaaaaaaaaaaaaaaaaaaaagcggccgc

SEQ ID NO: 445 - DNA, 1723 bp, Glycine max
  CDS (301)..(1560)
gaagcttcggtttctctctctctctctttctctttctcttagggttttcactttcaccaatttctccttctcttccgatctacgcccaaaggtatcacctcgcgtgcattcgttcctaatcctttcaaactctccgttctcccatctttaacttgtttaagctgctacgtttaattgaattcgccgtttccaaattgtcttttcatttctttcttttgttctgcaattagacattgctagggttctggagtactggattagctcattaaggattgagtactccatctatcttctgtcttcatggataaagacaaatctctaggtttgccacctccgtctggacgttattctggttactcgtccaccggaagtgttttcaacgtgaaatctgaaccgtccccgtcgtcgtcaaccacgttgtatccgccattggctccgggaactaccagttccgagtctagccattttggacatggattgtccacggattctagtggttttagtcatgatattagcagaatgcctgataatcccccgagaaatagaggtcataggcgtgctcattcggagattctcactttaccggatgatattagtttcgacagtgaccttggtgttgttggaggtggtgatggtccttccttctccgatgatgccgaggaggacttgctgtccatgtaccttgatatggataagttcaattcatcgtcggcaacgtccacgtttcaaatggttgagccgtctaatgctgtgggagcatcggcttcaacaccggcgtcaggggcacccacctcttctaccgagaatgttgttattgggactaatgaaaggcccagagttagacaccagcatagtcaatccatggacggctcaaccaccatcaagcctgagatgctggtttcaggttcagaagacatgtctgcggctgattccaaaaaagcaatgtcagctgccaagcttgctgaacttgccttgattgaccccaaacgtgcaaaaaggatatgggcaaataggcagtctgctgcaaggtcaaaagagagaaagatgcgatacattgctgagcttgaaaggaaggtgcaaacattgcaaacggaagcaacatctttgtctgcacaattaactctcttgcagagagatacaaatggcttaaattctgagaacaatgaactgaagctgcggttgcaaaccatggagcaacaagttcacttgcaagatgcattaaacgatgcattaaaagaggaaattcagcatttgaaaatattgactgggcaagctatgccacctaatggaggacctatgatgaactttgcttcttttggaggggggcagcaattctatcccaataatcatgccatgcacacccttttagctgcacaacagtttcaacagcttcaaattcaccctcaaaagcagcagcagcatcagtttcagcagcttcagcaacagcagcgggaacagcaccaacaatcaattgacttgaaaatgagagaagctacacctactccatgccccaaagacaatgcctcatcagatgtaaatccttctggggccaaggactgttgagagttgagactgctcattgtcttctctatttgctttatagattttcctttgtcttgtgtcctagtgtgtttagcctttgttatattttttcattcttaaacagtacaaatggtcctagttagagattgagtataatacatttgcatctttgttattatgt

SEQ ID NO: 446 - DNA, 1523 bp, Glycine max
  CDS (28)..(888)
attcggctcgaggtttcttctgcagctatggcgattcaagatcaaaatggatttttcagatcacagggtggtcctccagaaggaggtggtgtatctttgagttctgggcattctgtcacacatattcaacttaatgaccagttttcttgtgggaatgactatgctctgaaggtaaggaagccgtatactatcactaaacagagagagcgatggacagatgaagaacataagaagttccttgaagctttaaagctgtatggacgggcttggcgacgtattgaagaacatgttggcacaaagactgctgttcagattcgaagtcatgctcagaagtttttttctaaggttcttcacgatcctactgggaacaatacaaacacagtggagtcaattgaaattcctcctccaagaccgaaacgaaagccgatgcatccttaccctcgtaaactagttgagaccccaaataaggaaatttcgatcccagaacaacctatgaagtctaattctctgaagtcgtcagactttgatcaagaaaaccaatctccaaaatcagtattatcaggagttggttcagacagccttggctcctctgattcagacacaccaaatggaagtttgtcgcccatgtcatccattagtggcttccatacaagcagttttacacgtgccaaacccaaaacaacaacatctgaggaagaagctgggatggacactgattcaactcatgatgagaaacctcttatgaaattcaagcttcctccaaatggatgtgtttccatcaaagaagacaacacagcagaagaatcttccggtcggactttcaaactctttggaatgactctatttgtaacagacacctgcaaaccatctccaacaatcgaggaatgctaaagatacctctaaacattcgcgcgcaacgcctttcctcctccatggaggatggcaaattggaacttgttggacactctagagcaagtgaaacatcagcaatatccaagctaaaggtgagagtggaacctgaagcatgtgggaaagggtttgtgccatataaaagatgcatatctgttgtgacagctgatgatagagaagagcaatgtatccatctttccttgtagcttataccccactggatttttccttcaaaaagtgttccctttgtcatgatgagctgtaatggttgttttggttgctgctggatgtgagttggtatgatataggaaggaaaaaggggtggctgaaaattttgatatttccgttgaattgcactgcactgcacattctccagctgttcaaatccgtaaacttgccttttctatttttttgacttccaagtttcaacacattctccgcgggtccaagccgtgtctgtgcgcggcacttaggagctgtgtccgtgcttcctagtttaactgtgaataactgtgaattatatctagtgccttttttttaaaaaaaaaaaaaactttttatgctccctaagagtatgcaaagtgtaagtcacgtactaaaaaaaaaaaaaaagg

SEQ ID NO: 447 - DNA, 884 bp, Oryza sativa
  CDS (107)..(652)
aaatccagccaagaagatcgagaccggatacagctagcaatccatccaagaagatcgagagagcggatacagctagcctagctacgcgaaggatcagatcatcggcatggagctggagcttgggctggcgccaccgaattccggtcatctcgtcgtcgacgagctcagcagcagcagcagcagcggcggcggcagcggcagcgcgccggtgtctgcctcgtcggccgggaagaggggattcagggaggcgttccaggagacgctgctgctcttcgacgacggcagctgctgcaacaccagcgacgacgattgcaggaggaggaagaagacggtggtggggtggccaccggtgagctcggcgcggcgggcgtgcggcggcgccaactacgtgaaggtgaagaaggaaggcgacgccatcgggaggaaggttgatttggccctccattcctcctacgacgagctcgctgccacgctcgcccgcatgttccccaccaacgaccaccaaggcgagaagaaaatggccaatgatgatcatggcgatgccgctggacctgtggtcacctacgaggatggtgatggggattggatgctggttggggacgtgccatgggatgattttgcacgatctgtgaaacgcctgaagatactgggttaactgaactgaaggagatgcatgcgtgagttgatggagcacagctcggttttggttgcctggcatctgcgtgtgggtgtgcactgatgtatgtacatgttttcgttttcagtcaggatgttaggacgagagaaagagctttctgtcaaagactatatactgctagcttatatatactgtagttgggcacatctcatgtgtgcccagggctaggttttgagaaaaaaaaaaa

SEQ ID NO: 448 - DNA, 1281 bp, Arabidopsis thaliana
  CDS (8)..(901)
gtgaaacatggggaaggaagttatggtgagcgattacggtgacgacgacggagaagacgccggcggcggcgatgaatataggattccggaatgggaaattggtttacccaacggagatgatttgactccgttatctcaatatctagtcccgtcgattctcgcgttagctttcagcatgatcccagaacgaagccgtacaattcacgacgtcaatcgcgcgtcgcaaatcacgctctcttcgttgagaagcagtaccaatgcttcgtctgtgatggaggaggtcgtggatcgagttgaatcgagtgttccaggatcagatccgaagaaacagaagaaatcggatggtggtgaagcagcggcggtggaggattccacggcggaggaaggagactccgggcctgaagacgcgtctgggaagacatcgaaacgaccgcgtttagtgtggacaccgcagctacacaagagatttgtggacgttgtggctcatctagggattaaaaacgcagtgccgaagacgattatgcagctgatgaacgtggaaggacttactcgtgagaacgttgcgtctcatttgcagaaatataggctttaccttaaacggattcaaggattgacgacggaagaagatccttattcgtcgtcggatcagctcttctcttcaacgccggttcctccacagagctttcaagacggcggaggaagtaacggaaagttgggggttccggttccggttccgtcgatggtgcctattccaggctatgggaatcaaatgggtatgcaaggatattatcaacagtatagtaaccatggcaatgaatcaaaccaatatatgatgcagcagaataagtttggaacaatggtgacatatccttctgttggtggtggtgacgtgaatgacaagtaaatggatcttaaaggtctataatttgctctacagagagatactggttcttggcttatggtttattttcccacttcatgaggttgttgtgacttttaattctccatgttttccacacaagtctttattgcctttgtatagaaaatgatttcgagaaaatcactgggaagcttggtattgttggaggatgaagccttctatgaatgatttagtttcctactgtctccattctttatgaggtaataaagccttcttttgctcatcgcttgtagtcttcttaaattcaagacagcgtcacatgtttgttcggttatgttaattgtttctttctttggataatgaagatagcatcaggtctcatgtctcctcactttgataaa

SEQ ID NO: 449 - DNA, 1002 bp, Zea mays
  CDS (83)..(856)
tctccgacccgatccgacccgacacacaaatatctccacccctgttccggcgacgactacgatttgggaggaaggtaagcgaatgggtgaggaggcggtcgacgactacgagctccacatggtgtgctacggcggcggcggcggcggcagcgaggacgagcgcgtgatggagtgggagtcaggtctcccgggcgcggacgagctgaccccgctgtcgcagccgctggtgccggcgggtctggcagcggcgttccgcatcccgccggaggccgggcggacgctgctggacgtgcaccgcgcgtcggctgccacggtgtcccggctgcgtcgcgcgccgccgccgtcgtcgtcgggcagcggagggagctcctccttcgcgcccttccatccggcggcgaggggggacgaaggggcggactcgtcggcggcgggcggcggggcggcggcgacgacgaacggcaacaataacatgagcagcagcagcaagcggccccggctggtgtggacgccgcagctgcacaagcggttcgtggacgtggtggcgcacctggggatgaagaacgcggtgcccaagaccatcatgcagctgatgaacgtggaagggctgacgcgggagaacgtggccagccacctgcagaagtaccgcctctacgtcaagcggatgcagggcctctccgacgagggcccgtcgccgtccgaccacatcttcgcatccacgccggtgccgcaaagcctggtgcatgaggtgcccatgtacggcaccatggccagcggcggacaggcgtaccacaaccacaacggaatgggaggaggagggtaccagtaccagtaccatcactaccaccacgcccacaaatgactcttctgttggattggatccctcaataatcccatcgatccttttggttttggatctcttgctaattcagttcttcgtgtgagcggtaaatggatctcttttaagaaataaagaaagaaagataagtttcttttcccaaaaaa

SEQ ID NO: 450 - DNA, 1306 bp, Arabidopsis thaliana
  CDS (116)..(1120)
aaacccaccaaataactcagagcttttttgcattttttcccattctctattttgttttgtacttttggtctcactttaaaagatcataagttgaaagatttctgcagagaacaatatgttggaaggtcttgtctctcaagaaagcttgtccttaaactctatggacatgtctgtacttgaaaggcttaaatgggtacaacagcaacaacagcaactgcaacaagttgtgtcccatagcagtaataattcacctgaacttcttcagatacttcagttccatggaagcaacaatgatgagttgttggagagtagtttcagccaatttcaaatgcttggatctggttttggaccaaactataacatgggttttggtcctccacatgaatccatttcaagaacaagtagctgccatatggaacctgtggatacaatggaggttttgttgaagaccggtgaagaaaccagagccgttgccttgaagaacaagagaaaaccagaggttaagacaagggaagagcaaaagacagagaagaagatcaaagtagaggctgagacagagtcaagcatgaaaggaaaatcaaacatgggaaacactgaagcatcttcagacacttcaaaggagacatcgaaaggagcttcagagaatcagaaattagattatatccacgtgagagctcgtcgaggccaagccactgacagacacagcttagcagaaagggcgagaagagaaaagatcagcaagaaaatgaaatatctgcaagatattgtgcctggatgcaataaggtcacaggaaaagctggtatgcttgatgagatcatcaattatgttcaatgtctccaaagacaagtcgagttcctgtcgatgaaacttgctgtcttgaacccggaactagagcttgccgtggaagatgtatccgtaaaacaggcttactttacaaatgtagttgcttcaaagcaatcaataatggttgatgtgccattgtttccgttagaccagcaaggatctctagatttgtctgcgataaacccgaaccaaacgacatctatcgaagctccatctggaagctgggaaactcaatcacagagtctctacaacacatctagcctcggttttcattactaagcaagattcattgaaacaacatggttgacatcaatcaatcatcaaaatcagaagcaaattctattacatttgctcatcaaagtagtaatttcgaaatttggttaatgcattatcctttgatccttgttttctgatatttaaaccagaagaactggagatagcaatccaatgatcttgtcacca

SEQ ID NO: 451 - DNA, 705 bp, Zea mays
  CDS (102)..(515)
ctccaaacgcagcagagcccctagcgccgccggtctcttcagcctcgcagcacaccgccgccagcccgagtgaccgctgcagcctagggtttccggcggcgatggcgggtaagggagggaagggtctgctggcggccaagacgacggcggccaagagcaccgacaaggacaaggacaggaagaaggcccccgtgtcgcgctcctcccgcgccggcctccagttcccggtgggtcgcatccaccgccagctcaagtcgcgtgcctccgcgcacggccgcgtcggcgccaccgccgccgtctattccgccgccatcctcgagtacctcaccgccgaggtcctcgagctggccggcaacgccagcaaggacctcaaggtcaagcgcatcaccccgcgccacctgcagctcgccatccgcggggacgaggagctcgacaccctcatcaagggcaccatcgccggtggcggcgtcatcccgcacatccacaagtcgctcatcaacaagaccgccaaggagtgaatccaggccgtgctgctgcttctgcctgactacagtcccatctcgttctgtacttgtgctatcttagtttaagtgcatgttggcacagttctagtaaactcatcttgttcacctatgttaatttaagctctcttccgcgagctttttggattgctggtatcgtgattaacgggttcgtaaaattagt

SEQ ID NO: 452 - DNA, 673 bp, Zea mays
  CDS (56)..(457)
aatcaatccttcaagcgcaagctgcctcctcctcgtcgtccggtcgtgagaagggatggcgggccgtggcaaggctatcggcgctggcgccgcgaagaaggcaacgtcgaggagctccaaggccggactccagttccccgtcggcaggattgctaggttcctcaaggcgggcaagtacgctgagcgcgtcggcgccggcgcccccgtgtacctcgccgccgtcctcgagtacctcgcggctgaggttctcgaacttgccgggaacgccgcgagggacaacaagaagacccgcattgtgccgcgccacatccagcttgctgtgcgcaacgacgaggagctgaccaaactgttgggtggtgccaccatcgcgagcggaggtgttatgcctaacatccatcagcatctgctccccaagaaggctgcctcctccaaggccagtgtcgacgacgacgacaactgagactgcttcctgcagaaatgatccgaccaccgccttgttttgtaggaataggatgatgttgtcttcgatcggggaggagtcgggtatgctgggaaggagaattagattagtatctgtttttttgaatgggatgtgaacgtggctgtgaatctcaggattgtatgctcgttgagaaagaaatggaaggacttcgtgatgcacgatgttgatgcc

SEQ ID NO: 453 - DNA, 706 bp, Zea mays
  CDS (71)..(541)
ctcatcttttctcgtttagaacctctaaaatttcccccactcgccagtcgcagcagcacctgtagcagccatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgttctggagtacctcgccgccgaggttctggagttggcagggaacgcggcgaaagacaacaagaagacgcgcatcatcccgcgccacgtgctcctggcgatccgcaacgacgaggagctcgggaagctgctggccggcgtcaccatcgcgcacggtggcgtcctccccaacatccactccgtgctcctgcccaagaaggcggcggagaaggcggccagcggcggcagcaaggagcccaagtcccccaagaagggcgccaagtcccccaagaaggcttagaaagtagggtcttcatttgcgctgtgtgctgtagcatgttcgtgtctagatctgtggatgggatgtgtcatgctctagtatcgtccttgtgtcttattgtatgttcgtcttcatcgagaagatcttcagcagtcagagctcgttgtgtactaatgttccccc

SEQ ID NO: 454 - DNA, 854 bp, Zea mays
  CDS (33)..(512)
ccacgcgtccgagcacgggggcttgatcgaagatggatgccggagcaaaggtggtgaagaaggccgcggcggggcgtcgcggcgggggcggccccaagaagaagccggtctctcgctccgtgaaggccggcctccagttccccgtaggccgtatcggccgctacctcaagcagggtcgctactcccagcgtgtcggcaccggcgcccccgtctacctcgctgccgtcctcgagtacctcgccgccgggctcctcgagttggcggggaacgcagcgcgggacaacaagaagaaccggatcatcccgcggcacgtactgctggcgatccgcaacgacgaggagctcgggaagctactggccggcgtcaccatcgcacacggcggggttctgcccaacatcaaccctgtgctgctccccaagaaaaccgctgtcgctgctgccaaggaaggcaaagagaagaagtcacccaagaaggccgccgccgccaagtcgcccaaaaaggtggccgcctcgtaggtccctggcaatgctgatgcactgtctctctctgtcctctctgaactgaaacgctcctagctgtcgttgtcggtcatggtcgttgttgtttgatgcgcttttattgtggttgttcgtgtgtaattgcttgcctttcgcccatttggcatgcactgtgtagggtcacactggtctaggttttcaatctgggaaacaccggtttagattcaaggagcgtgaactgtgaaggcaggtgagagggtgggatctgtgaatcattaggtgctgtttgtaataagattgcaaagatgtgtaaaatttgttttgtgcttccattcaaaaaaaaaaaaaagggcggcg

SEQ ID NO: 455 - DNA, 954 bp, Arabidopsis thaliana
  CDS (1)..(951)
atggcggtggagctcatgactcggaattacatctccggcgtcggagctgatagcttcgccgttcaagaagcagctgcttcaggactcaaaagtatcgaaaatttcatcggtttaatgtctcgtgatagctttaactctgatcagccatcttcttcttccgcctccgcctccgcctccgccgccgcagatcttgaatcagctcgtaacacaacggcggacgcggctgtttcaaagtttaaaagagtcatatctctcttagatcgaactcgaaccggacacgcccggtttagacgtgctccggttcatgttatttctccggttcttttacaagaagaaccaaaaacgacgccgtttcagtctcctcttcctcctccgccgcaaatgatccgaaaaggttcgttttcttcatcgatgaaaacgattgatttctcatctctctcctctgtaacaacggaatcagacaaccagaagaagattcatcatcatcaacgtccctctgaaacggcgccgtttgcgtctcaaactcaaagcctctccacgacggtctcgtctttctcaaaatcaacaaagagaaaatgtaactctgagaatcttctcaccggaaaatgcgcttccgcttcttcctccggtcgttgtcattgctcgaagaaaagaaagataaaacagaggagaataattagggttccggcgataagtgcaaaaatgtccgatgtaccaccggacgattattcatggaggaaatacggacaaaaaccaattaaaggatctccacatccaagaggatattataagtgtagtagcgtaagaggttgtccagcacgtaaacatgttgagagagcagctgatgattcgtccatgttgattgttacttatgaaggagatcataatcattctctctccgccgctgatctcgccggagccgccgttgctgatcttattttggaatcgtcttag

SEQ ID NO: 456 - DNA, 513 bp, Arabidopsis thaliana
  CDS (1)..(510)
atggcgactcaagattctcaagggattaaactctttggcaaaactattgcatttaacactcgaacaataaaaaatgaagaagagacacacccgccggagcaagaagccacaatagccgttagatcatcatcatcatcggatctgacggccgagaagcgtccggataagatcatagcatgtccaagatgcaagagcatggagacaaagttctgttacttcaacaactacaacgttaatcagcctcgacacttttgtaaaggctgccaccgttactggaccgccggtggtgcactccggaacgttcccgtcggcgccggtcgtcggaagtccaaaccacctggtcgtgtcgtggttggtatgcttggagatggaaatggtgttcgccaagtcgagcttataaatggcttgctcgttgaggagtggcagcatgccgcagccgcagctcacggtagtttccggcatgattttcccatgaagcggctccggtgttactccgacggtcaatcgtgctag

SEQ ID NO: 457 - DNA, 813 bp, Arabidopsis thaliana; identical to SEQ ID NO: 434
  CDS (1)..(810)

SEQ ID NO: 458 - DNA, 1059 bp, Arabidopsis thaliana
  CDS (1)..(1056)
atggtgcggacaccgtgttgcaaagctgaactagggttaaagaaaggagcttggactcccgaggaagatcagaagcttctctcttaccttaaccgccacggtgaaggtggatggcgaactctccccgaaaaagctggactcaagagatgcggcaaaagctgcagactgagatgggccaattatcttagacctgacatcaaaagaggagagttcactgaagacgaagaacgttcaatcatctctcttcacgcccttcacggcaacaaatggtctgctatagctcgtggactaccaggaagaaccgataacgagatcaagaactactggaacactcatatcaaaaaacgtttgatcaagaaaggtattgatccagttacacacaagggcataacctccggtaccgacaaatcagaaaacctcccggagaaacaaaatgttaatctgacaactagtgaccatgatcttgataatgacaaggcgaagaagaacaacaagaattttggattatcatcggctagtttcttgaacaaagtagctaataggttcggaaagagaatcaatcagagtgttctgtctgagattatcggaagtggaggcccacttgcttctactagtcacactactaatactacaactacaagtgtttccgttgactctgaatcagttaagtcaacgagttcttccttcgcaccaacctcgaatcttctctgccatgggaccgttgcaacaacaccagtttcatcgaactttgacgttgatggtaacgttaatctgacgtgttcttcgtccacgttctctgattcctccgttaacaatcctctaatgtactgcgataatttcgttggtaataacaacgttgatgatgaggatactatcgggttctccacatttctgaatgatgaagatttcatgatgttggaggagtcttgtgttgaaaacactgcgttcatgaaagaacttacgaggtttcttcacgaggatgaaaacgacgtcgttgatgtgacgccggtctatgaacgtcaagacttgtttgacgaaattgataactattttggatag

SEQ ID NO: 459 - DNA, 663 bp, Arabidopsis thaliana
  CDS (1)..(660)
atggctagaatgacaagagatggaaaagaacatgaatacaagaaaggtttatggacagtggaagaagacaagatcctcatggattatgtccgaactcatggccagggccactggaaccgcatcgccaagaaaactgggctcaagagatgtgggaaaagctgtaggttgagatggatgaactacttaagccctaatgttaacagaggcaattttactgaccaagaagaagatctcatcatcagactccacaagctcctcggcaacagatggtcgttgatagcgaaaagagttccgggaagaacagacaaccaagtaaagaattactggaacacacatctcagcaagaaacttggtctcggagatcattcaactgccgtcaaagccgcatgcggtgtagagtctccaccgtctatggcccttataaccacaacgtcctcctctcatcaagagatctccggtggaaaaaattcaactctaaggttcgacactttagttgacgaatccaaactcaaaccaaaatccaaactagtccacgcaacaccaactgacgtagaagttgcagctacggttccaaatctgttcgataccttttgggttcttgaagacggcttcgagcttagttcactcactatgatggattttactaatgggtattgcctttag

SEQ ID NO: 460 - DNA, 945 bp, Arabidopsis thaliana
  CDS (1)..(942)
atggcggatctcttcggtggtggccacggcggcgagcttatggaagcacttcaacctttttacaaaagtgcttccacgtctgcttcaaatcctgcgtttgcgtcctcaaacgatgcgtttgcgtctgccccaaacgacctattttcttcttcttcttactataatcctcatgcatctttattcccttcacattccacaacctcttacccggatatttattctggatccatgacctatccatcttcattcgggtcggatcttcaacaacccgaaaactaccaatctcagttccattaccaaaacactatcacttacactcaccaagacaacaacacttgcatgcttaacttcattgagccgagccaaccgggttttatgacccaaccgggtccgagttcgggttcggtttcaaaaccggctaagctctatagaggagtgaggcaaagacattggggaaaatgggtcgcggagatccgtttacccaggaaccgaacccgactttggctcggaacattcgacacggctgaagaagccgcgttggcttatgatcgcgccgcgtttaagcttcgtggtgactcggctcggcttaacttcccagctctccgataccaaaccggctcgtctccgtctgataccggcgaatatggtcctattcaagctgccgtagacgctaaactagaagccatattagctgagccgaagaatcagccgggcaaaacggagaggacgtcgaggaaacgagctaaagccgcggcttcttcagctgagcagccgtcagcgccacaacaacattccgggtcgggtgaaagtgatgggtcgggttcaccgacttcggatgttatggtgcaggagatgtgccaagagccagagatgccatggaatgaaaatttcatgctcggcaagtgtccttcttatgagatagattgggcttcaattttatcgtag

SEQ ID NO: 461 - DNA, 597 bp, Arabidopsis thaliana
  CDS (1)..(594)
atggaaaatggtatgtataaaaagaaaggagtgtgcgactcttgtgtctcgtccaaaagcagatccaaccacagccccaaaagaagcatgatggagcctcagcctcaccatctcctcatggattggaacaaagctaatgatcttctcacacaagaacacgcagcttttctcaatgatcctcaccatctcatgttagatccacctcccgaaaccctaattcacttggacgaagacgaagagtacgatgaagacatggatgcgatgaaggagatgcagtacatgatcgccgtcatgcagcccgtagacatcgaccctgccacggtccctaagccgaaccgccgtagcgtaaggataagcgacgatcctcagacggtggttgctcgtcggcgtcgggaaaggatcagcgagaagatccgaattctcaagaggatcgtgcctggtggtgcgaagatggacacagcttccatgctcgacgaagccatacgttacaccaagttcttgaaacggcaggtgaggattcttcagcctcactctcagattggagctcctatggctaacccctcttacctttgttattaccacaactcccaaccctag

SEQ ID NO: 462 - DNA, 396 bp, Arabidopsis thaliana
  CDS (1)..(393)
atggatcaaggaggtcgaggtgtcggtgccgagcatggaaagtaccggggagttcggagacgaccttggggaaaatatgcagcagagatacgagattcgaggaagcacggtgaacgtgtgtggcttggaacgttcgatacggcagaggaagcggctagagcctatgaccaagctgcttactccatgagaggccaagcagcaatccttaacttccctcatgagtataacatggggagtggtgtctcttcttccaccgccatggctggatcttcctccgcctccgcctccgcttcttcttcttctaggcaagtttttgaatttgagtacttggatgatagtgttttggaggagctccttgaggaaggagagaaacctaacaagggcaagaagaaatag

SEQ ID NO: 463 - DNA, 546 bp, Arabidopsis thaliana
  CDS (1)..(543)
atggcacgaccacaacaacgctttcgaggcgttagacagaggcattggggctcttgggtctccgaaattcgtcaccctctcttgaaaacaagaatctggctagggacgtttgagacagcggaggatgcagcaagggcctacgacgaggcggctaggctaatgtgtggcccgagagctcgtactaatttcccatacaaccctaatgccattcctacttcctcttccaagcttctatcagcaactcttaccgctaaactccacaaatgctacatggcttctcttcaaatgaccaagcaaacgcaaacacaaacgcaaacgcagaccgcaagatcacaatccgcggacagtgacggtgtgacggctaacgaaagtcatttgaacagaggagtaacggagacgacagagatcaagtgggaagatggaaatgcgaatatgcaacagaattttaggccattggaggaagatcatatcgagcaaatgattgaggagctgcttcactacggttccattgagctttgctctgttttaccaactcagacgctgtag

SEQ ID NO: 464 - DNA, 861 bp, Arabidopsis thaliana
  CDS (1)..(858)
atggctttgtcatcagctaagcatcagagaaaccatagactctctgctacaaacaagaaccagactctcaccaaagtttcttccatttcatcctcatcaccatcgtcttcttcttcatcgtcatcaacctcatcatcatctcctttaccttctcaagactctcaagcccagaagagatctcttgtcaccatggaagaagtttggaatgacatcaaccttgcttccatccaccacctaaaccgacacagccctcatccacaacacaaccacgagccaaggttcaggggccaaaaccaccacaaccaaaaccctaactcaatcttccaagattttctcaaaggatctttgaaccaggaaccagcacccacaagccagaccacgggttctgcgcctaatggcgattccaccacggtcactgttctttacagctctccttttccacctcctgcaactgttctgagcttgaattccggcgctggcttcgagtttctcgataaccaagatcctcttgttacctcaaactctaatcttcatacccaccatcacctctcaaacgctcatgccttcaacacctctttcgaggctctggttccatccagttcttttggtaagaaaagaggccaagattccaatgaaggttcagggaatagaagacataagcgtatgatcaagaacagagaatctgcagctcgttcccgcgctaggaaacaggcttatacaaacgagttagaacttgaagttgctcacttgcaggcagaaaatgcaagactcaagagacaacaagatcagttaaaaatggctgcagcaattcagcaacccaaaaagaacacacttcaacggtcttccacagctccattttag

SEQ ID NO: 465 - DNA, 864 bp, Arabidopsis thaliana
  CDS (1)..(861)
atggctatgcaggaacgttgtgagagtttatgttctgatgaacttatatcttcctcagatgccttttacctcaagacaagaaagccttataccatcactaaacaaagagagaaatggacagaagcagagcatgagaagtttgtagaagcattgaaactctatggcagagcttggagacgaatcgaagaacatgttggaacaaaaactgcagttcagattcgaagccatgcgcagaagttctttactaaggttgctcgcgattttggtgttagctctgagtccattgagatcccgcctccaaggccaaagagaaagccgatgcatccttaccctagaaagcttgtgattcctgatgcaaaagagatggtatacgctgaactaaccggatccaagctgattcaggatgaagataaccgatctccaacatcggttttatcagctcatggctcagatggattaggttccattggttcaaattcacctaactcttcttcagctgagttatcatctcacacagaggaatcattgtctctagaagcagagaccaaacagagccttaagctctttggaaaaacttttgtagttggtgattacaactcttcaatgagttgtgatgattctgaagatggcaagaagaagctatactcagaaacacagtctcttcaatgttcttcttctacttcagaaaacgctgaaacagaagtggtagtgtcggagttcaaaagaagtgagagatcagctttctctcagttaaaatcgtcggtgactgagatgaacaacatgagagggttcatgccatacaaaaagagagtaaaggtggaagaaaacattgacaatgtaaaattatcatatcctttgtggtag

SEQ ID NO: 466 - DNA, 1071 bp, Oryza sativa
  CDS (1)..(1008)
atggccgggatggaccctggcgggggcggcgccggcgccggcagctcacggtacttccaccatctgctccgaccgcagcagccgtcgccgctgtcaccgctgtcgccgacatcccatgtcaagatggagcactccaagatgtcacccgacaagagccccgtgggcgagggagatcacgcgggagggagtggaagcggcggcgtcggcggtgaccaccagccgtcgtcgtcggccatggtgcccgtcgagggtggcagcggcagcgccggcggtagtggctcgggtgggccgacgcggcgcccgcgcgggcgcccgcccgggtccaagaacaagccgaagccgcccatcatcgtgacgcgcgacagcccgaacgcgctgcactcgcacgtgctcgaggtcgccggcggcgccgacgtcgtcgactgcgtggccgagtacgcccgccgccgagggcgcggcgtgtgcgtgctgagcggcggcggcgccgtcgtcaacgtggcgctgcggcagccgggcgcgtcgccgccgggcagcatggtggccacgctgcggggccggttcgagatcctatctctcacgggcacggtcctgccgcctcccgcgccacccggcgcgagcggcctcaccgtgttcctctccggcggccagggccaggtgatcggcggcagcgtggtgggcccgctggtcgccgcggggcccgtcgtcctgatggcggcctcattcgcgaacgccgtgtacgagcggctgccgctggagggcgaggaagaggaggtcgccgcgcccgccgccggaggcgaagcacaagatcaagtggcacaatcagctggacccccagggcagcaaccggcggcgtcacagtcctccggcgtgacaggaggcgacggcaccggcggcgccggtggcatgtcgctctacaacctcgccgggaatgtgggaggctatcagctccccggagacaacttcggaggttggagcggcgccggcgccggcggagtcaggccaccgttctgacccatgtcttagcatccagttcaaaaattctccaaattaagaattgcgcagtgcagaagc

SEQ ID NO: 467 - DNA, 1707 bp, Arabidopsis thaliana
  CDS (98)..(1441)
ccacgcgtccgcactctcccaaatctctcttctttaacaacaaaaaaaaaatcacagagacatagagagaagaagacggaacagaggctccaaaaaaatgatgatggagactagagatccagctattaagcttttcggtatgaaaatcccttttccgtcggtttttgaatcggcagttacggtggaggatgacgaagaagatgactggagcggcggagatgacaaatcaccagagaaggtaactccagagttatcagataagaacaacaacaactgtaacgacaacagttttaacaattcgaaacccgaaaccttggacaaagaggaagcgacatcaactgatcagatagagagtagtgacacgcctgaggataatcagcagacgacacctgatggtaaaaccctaaagaaaccgactaagattctaccgtgtccgagatgcaaaagcatggagaccaagttctgttattacaacaactacaacataaaccagcctcgtcatttctgcaaggcttgtcagagatattggactgctggagggactatgaggaatgttcctgtgggggcaggacgtcgtaagaacaaaagctcatcttctcattaccgtcacatcactatttccgaggctcttgaggctgcgaggcttgacccgggcttacaggcaaacacaagggtcttgagttttggtctcgaagctcagcagcagcacgttgctgctcccatgacacctgttatgaagctacaagaagatcaaaaggtctcaaacggtgctaggaacaggtttcacgggttagcggatcaacggcttgtagctcgggtagagaatggagatgattgctcaagcggatcctctgtgaccacctctaacaatcactcagtggatgaatcaagagcacaaagcggcagtgttgttgaagcacaaatgaacaacaacaacaacaataacatgaatggttatgcttgcatcccaggtgttccatggccttacacgtggaatccagcgatgcctccaccaggtttttacccgcctccagggtatccaatgccgttttacccttactggaccatcccaatgctaccaccgcatcaatcctcatcgcctataagccaaaagtgttcaaatacaaactctccgactctcggaaagcatccgagagatgaaggatcatcgaaaaaggacaatgagacagagcgaaaacagaaggccgggtgcgttctggtcccgaaaacgttgagaatagatgatcctaacgaagcagcaaagagctcgatatggacaacattgggaatcaagaacgaggcgatgtgcaaagccggtggtatgttcaaagggtttgatcataagacaaagatgtataacaacgacaaagctgagaactcccctgttctttctgctaaccctgctgctctatcaagatcacacaatttccatgaacagatttagagttacatatgtatatgtatatatgtatgattgattgtatgtatagatgatactggagaatgatgagtttttgagaatcaaactcttttcttctttctagtgattgcctttattcctttacatgttttggttctctgtacactatttgatttaccttttttactttctttcttcatttgtcaggaaatgttggaagataacattaatggtaaaaagttggtgtggaccgttgttgcgttggcatttcaaaaaaaaaaaaaaaa

SEQ ID NO: 468 - DNA, 1371 bp, Arabidopsis thaliana
  CDS (175)..(1293)
atttattaagcatcaatgagagaacttcagagctgggtttgagttctgtccaataatacataaccacgttatcatttttgtcctttactatctcattacactcttctgttattcgcccaattcttacagtcattactctctatagggctcgagcggccgcccgggcaggtttctatgcagatggttcacacttcccgctccattgcccagattgggttcggtgttaagtcgcaattagtactcactatagggctcgagcggccgcccgggcaggtaaaagatcaaacaatgtctaaagaagctgagatgtcgatcgcggtgtcggctttgttccctggttttagattctctcctactgatgttgaacttatctcgtactatcttcgtcgtaaaatcgatggtgatgagaactctgttgctgtgattgctgaggtcgagatttacaagttcgagccgtgggacttgccagaggaatcgaaactgaaatcggagaacgagtggttttacttctgcgcgagggggaggaagtacccgcacgggtcacaaagccggcgagccacacagctaggatattggaaagcgaccggtaaagagcggagtgttaaatccgggaaccaagttgttggaaccaagagaacgcttgtatttcatatcggtcgggctcctcgtggcgagagaacggagtggattatgcatgaatactgcatccatggagccccacaggatgcattagtggtgtgccggttaagaaaaaatgctgattttcgggctagttcgacccaaaaaattgaggatggtgttgtgcaagacgatggctacgttggccaaagaggtggtttggacaaggaggacaaatcctactatgaatctgagcatcagataccaaatggtgacatcgcagaatcatcaaatgttgttgaggatcaggccgataccgatgatgattgttacgccgagattctgaacgatgatataataaagctcgacgaagaagcgttgaaagctagccaagcgtttcgaccaactaatccaactcatcaagaaacaatatcaagcgagtcatcgagtaagaggtcaaaatgtggtataaaaaaagaatcaacggaaacaatgaattgttacgctttgttcaggatcaagaacgttgccggaaccgactccagctggagattcccgaacccgttcaaaatcaagaaagatgatagccagagattgatgaagaatgttctggccactactgttttcttggctatcttattttctttcttttggactgtattaatagctaggaactaaagctagttacgacatacatattatttatacataaataaatatagtattttgtctatggcaaaaaaaaaaaaaaaa

SEQ ID NO: 469 - DNA, 1387 bp, Arabidopsis thaliana
  CDS (207)..(1319)
aagcaaagcacaaccacacttgaacctcataagcggagccacccctccctgcccccaaggaataactcttccgacagcaaccctgttcgtttataaccatcaaccaccttaaaccctgggtagctagctttttttttcattattgtgtcggcaatcggttgaggaaaaaaaaaacacagaggagggtgcaaaaagcagggtggtggatgatggaaggggtttcgagggaggctcagatgtcgattgctgcttcgtccatgtttcctggattcagattctgccctaccgatgaggagttgatttcttattacctgaggaagaagttggagggtcatgaggagagtgttcaagtcatttctgaggttgagctttgtaaatacgagccttgggatttaccagccaaatcattcattcagtcagacaacgaatggttcttcttctctccccgcggaagaaagtacccaaatggttcacaaagtaaaagagcaactgaatgtggatactggaaggcaactggcaaagagcgtaatgtaaagtcaggttccaacattataggaacgaagcggactttggtgttccacttagggcgtgcacctaaaggggaaaggactgaatggattatgcacgagtactgcattaatgacaaatctcaggaatctttggtcatttgtcgcctcaagaggaacacagagttccgtttgagcgatgcttcgaatagagcttcatcaagtcaaaggcatccggtgaattcacatgaaagtggttgtgctatctcaggaggtggtattgatcaaagggatgcttgtgagcaagacaaagaggttggatgtagctccaagagggacagtagcagttatggttctccttcaatggagcaaattgattctgtgtccgaatcgaatcagcgaccagttaacgaagctactttcactgaatcttcaggtcaaccaaaggaggggtatgaagaggattgttatgcagagatactaaaggatgatatcatcaaattagatgaatcatcagtcttggtagagagtcacacaagaccacaggatcctacacagatgcaacctgcaccacaaggcacagcacaacggagaataagattaagggttgggaattcaaagcattctcgtgcagtagttcgtttcccaagcacaatgcactcatcaaagaataccttctttgccagaacaaccaacagtttggtggtattagctttcttcgttttcactttgatggttctatattttttgtccttagtgagaggacaaaaacaagacaagtattgtggggaattttcgggtgtaaatcatgattagtgctacacaaagcgtaggcaatttgttaaactgcttctttcctattaatatgttgcattagcctt

SEQ ID NO: 470 - DNA, 1261 bp, Triticum aestivum
  CDS (43)..(1041)
ccactctccactccacttttgtacgaagaacactagtgaaatatggctgcccagaacaacaaggaggtggatgccctggtggagaagatcaccggcctccacgccgccatcgccaagctgccgtcgctcagcccatccccagccgtcgacgcgctcttcaccgagctggtcacggcctgcgttcccccgagcccagtggacgtgaccaagctcggcccggaggcgcaggagatgcgggagggcctcatccgcctctgctccgaggccgaggggaagctggaggcgcactactccgacatgctcgccgccttcgacaaccctctggatcacctcggcatgttcccctactacagcaactacatcaacctcagcaaactggagtatgagctcctggcgcgctacgtgcccggaggcattgccccggcccgtgtcgcgttcattggctccggcccgcttcccttcagctcctttgtcctcgccgcgcgccatctgcccgacaccatgtttgacaactacgacctgtgtggcacagccaacgaccgtgcgagcaagctgttccgcgcggacacggatgtgggcgcgcgcatgtcgttccacacggccgacgtagcggacctcgccggcgagctcgccaagtacgacgtggtcttcctggccgcacttgttggcatggccgccgaggacaaggcgaaggtgatcgcacacctcggcgcacatatggcggacggtgcggctctcgtcgtgcgcagcgctcacggggcacgcgggttcctgtacccgatcgtcgacccccaggacatcaccctaggcgggttcgaggtgctggccgtgtgccacccagacgacgacgtggtgaactccgtcatcatcgcacagaagtccaaggacgtgcatgtgagtggacttcacagtgggcgtgctgtgggtggacagtctgctcgcggcacggtgccggtggtcagcccgccgtgcaggttcggtgagatggtggcggaggtgacgcagaagagagaggagttcgccaacgccgaagtggccttctgatcgatcgttgccaaggaacaataatgtgcatgtggtaattttcgaacctagctgcttgatcgcctgcaaccacacgtggtaattgtcctactgctaatgcatttcaagccatgtgctgtttgtacccaataatgtaagtctggtgtttacacgcgatacgccttgtatacaccttgtatgtgcaagtgttgggaatgatacttttgctataaaaaaa

SEQ ID NO: 471 - DNA, 1502 bp, Zea mays
  CDS (55)..(1146)
aagcaaaagcaaccgtcgagcttgcaacgccttacgcctccacactcaacagtcatggtcgtcatgggcaaggagcagcaacaacacgaggaggaggaggtgcaagggaaggtcgtccaagaagaagtgcaagtcgttcaagagacggtggtgccggtgccgtcggaggaggacaaggaggccgaggcggcgctggtgcacaagatctccagcctggccgccgccatcgcgaagctgccatccctgagcccgtcgccggaggtgaacgcgctcttcaccgagctcgtgacggcgtgcatcccgcgcagcagcgtggacgtggagcggctgggcccggagctgcaggagatgcgcggcgggctgatccgcctctgcgccgacgcggaggcgctgctggaggcgcactactccgacctgctggcctccttcgacaacccgctggagcacctgtcgctcttcccgtacatcaacaactacatcctgctgagccagctggagcacggcctgctggcgcggcacgtgccgggcccagcgccggcgcgcgtggccttcgtcggctccggcccgctcccgttgagctccctggtgctcgcggcgcgccaccttccgggcgcctccttcgacaactacgacatctgcggggaggccaacgaccgggcgcggcgcctggtgcgcggcgacggcgcgctccaggcgcgcatggcgttccgcacctcggacgtggcggacgtgacccgggagctggcgtcgtacgacgccgtgttcctggcggcgctggtgggcatggcggccgaggagaaggcccgcgtggtggcgcacctcgggaggcacatggcccccggcgccgcgctggtggtgcggagcgcgcacggcgcgcgcgggttcctgtaccccgtggtggaccccgaggagatccggcgcggcggattcgacgtgctcgccgtgcaccacccggagggggaggtgatcaactccgtgatcatcgcgcgcaagcccgttgccgtcgacgcgcacgccaccggcggggtggggcacgcgcacgtgcacgcgcacggcgccgtgctcagccggccctgcctctgctgcgagatggaggcccgggcgcaccagaagatggaggaggtggccgtcgagcagctgccgtcctaggcaggcgcacaccggcgtcctcgctttcttgtccgtccggccgcccatttgattttcggagttgcatctatctcatctaatatccatccatccatccatccatctatagcagtattatgtatgcatccacatggtaataatctggctgaccgcatccgcatatggtcgtctcatcgtccatctataccttgaaagctactaattaattactgagttattattactactgtttttactactactacgtacaactacctcatctagctggtgtattaattgattttgtttgttactgctgtactactgttgttgtggagatgaaccatgcatggagtggttagtcactctttagt

SEQ ID NO: 472 - DNA, 2495 bp, Zea mays
  CDS (277)..(2292)
cggacctggctacgaagcgcaggcagtacagacagcaccgcctggtttgagcggctgccgccgctgcatatactccctccctgccttccagtgccaggggtgaccggcgtgcgtgccattccacgctctcgcggctcgtgtgccagcggtgaccagcgctcgtgctcgtccagtccaccaggcgctgctgttccggcaagccagccagcagcagccgccgccgccgccgtctcggagctcgagctcctagtcccccggggccgaggcgccggcgccatggaccagctccggcccgagccggccgcgggcgcgcacgagatcgagaagacggcggcgccggacgtggagtcggagcccgcggcggcggtgccggagccggagcgcgtgccgccgtggcgcgagcaggtcaccgcgcgcgggatggtggcggcgctgctcatcggcttcgtctacacggtgatcatcatgaagctgagcctcaccacggggctcacccccaccatgaacgtctccgccgcgctgctcgccttcctggcgctccgcggatggacgcgcgccctcggccgcctaggcattgcatgccgccccttcacccgccaggagaacaccgtcgtgcagacctgcgtcgtcgcctgctacaccatagggttcggcggtgggttcgggtcgttcctgctgggcctggacaagaagacgtacgagctctccggggtgagcacgccgggcaacgtgccggggagctacagggagcctgccatcggctggatgaccggattcctcctcgccgtcagcttcgtggggctcctcaccttgcttccactcagaaaggtgctcgtcatcgactacaaactcacttatccaagtggaacagccaccgcggttctcataaacggattccacacacctcaaggagataagaatgcaaaaattcaggtccgtggattcctcaagtacttcgggatcagcttcctgtggagcttcttccagtggttctacaccgccggcgaccactgcggattcgcccagttccctactttcgggctccaggcttttaaccagacgttttccttcgacttcagcctgacgtacgttggtgctgggatgatctgctcgcacctcgtcaacctctcgttgctgttcggtgccgtcgtttcctggggcgtcatgtggccactcatcggcaagcagaagggcaactggtatccggcagatgcatctcagaatagcatgacaggcatctacgggtacaaggccttcctttgcattgcccttctcgtgggagacggtctctacaacttcgtcaaagtcatagctatcactgtcaagaacatacgcgagagatcacgtcgcaagaacctgaacagagtggcggacgcggacacgatggcgctggacgacatgcagcgcgacgaggtgttcaacagggacaacatcccgacgtggctgtcctacgcggggtacgcggcgctgagcctgatcgcggtgatcgccatcccgatcatgttccgggaggtgaggtggtactacgtggtggtggcgtacgcgctggcgccggcgctggggttctgcaacgcgtacgggaccgggctgacggacatgaacatggggtacaactacgggaaggtcgcgctgttcgtgctggcggcgtgggcggggaaggacagcggcgtggtggccgggctggtggggtgcgggctggtgaagcagctggtgctcgtgtcggccgacctgatgcacgacttcaagacggggcacctgacgctgacgtcgccgcggtcgatgctggtggggcaggccgtgggcacgctgatggggtgcgtcctggcgccgctcaccttcatgctcttctacagggcgttcgacgtgggcgagccggacgggtactggaaggccccctacgcgctcatctaccgcaacatggccatcctcggcgtggagggcttctcggcgctgcccaggcactgcctgcagctgtgcgcggggttcttcgcgttcgcggtgctggcgaacctggcgcgggacctgctgccgcgccggctcgcgcggctcgtgccgctgcccatggccatggccgtgccgttcctcgtgggcgccagcttcgccgtcgacatgtgcgtggggagcctcgtggtgttcgcgtggcacaagctcgacggcaagaaggccgcgctgctggtgccggccgtcgcctcggggctcatctgcggcgacgggatctggacgttcccgtcgtctctgctcgcgctggccaaggtcaagccgcccatctgcatgaagttcacgccagggagctagagggcgcgctgacgatgcgtacagaacagagggcatcgttcgtcgtttgtggggtggaatccgtgtagtagaattacataccaaccaggcctgttctaatgtccatatgagcttaatgtacggtgtatatatatgtaaaaatggaaatctgaaggatgacaggatgaattgcctgttgtctagtagcacgcaaaaaaaaa

SEQ ID NO: 473 - DNA, 2908 bp, Zea mays
  CDS (331)..(2565)
gctgcggcgtgctccttcgctggaaagtggggcagtatcttttcgcatctcctcgactccgcctctctcggatctcgccgaaggacgagcaaaggcccctgatcgcccgcttctactacaactatattctgtcgccagcgcacaagcggcgggggcacggggtagattcggagcggctcttggcttgcagtccagacgcccttcacccctgatctggaccggagggagcggctccttccgtcagttgttcttgctttgcctgggcctcttccgcctgcttcgtgttcttcacaggagccggtgacctcggacgatatcttggaggacaagatgtcgggggctgttcttgtcgccatagtcgcctccatcggcaatctattgcaggggtgggacaatgccaccatcgcagctgctgttctgtatataaagaaggaatttcaattgcaaaatgagcccactgtggagggactaattgtgtcaatgtcacttatcggcgccaccatcgttactacattctccgggccattatcagactcgattggccgacgccctatgcttattctctcttcaattctgtacttcttcagcggcctcatcatgctatggtctcctaatgtctatgtcctgctgttggcacgcttcgtagatggatttggtattggcttggctgtcacgcttgtgcctttgtacatttcagaaatagccccttcggagattagaggtttgctgaatacactaccacaattcagtggatcaggaggaatgttcttgtcatactgcatggtgtttgggatgtccctgtcgccatcacccgattggagaattatgcttggtgtgctcgcgataccttcattgttcttctttggtttgacaatattttatcttcctgaatctccaagatggctcgttagcaaaggtcggatggcagaggcaaaaaaggtgttgcaaaagttacgggggaaagacgatgtctcaggtgaattgtcccttcttctcgaagggttggaggttggaggagacacttccattgaagagtacatcattggacctgccaccgaggcagccgatgatcttgttactgacggtgataaggaacaaatcacactttatgggcctgaagaaggccagtcatggattgctcgaccttccaagggacccagcatgcttggaagtgtgctttctcttgcatctcgtcatgggagcatggtgaaccagagtgtaccccttatggatccgattgtgacactttttggtagtgtccatgagaatatgcctcaagctggaggaagtatgaggagcacattgtttccaaactttggaagtatgttcagtgtcacagatcagcatgccaaaaatgagcagtgggatgaagagaatcttcatagggatgacgaggagtacgcatctgatggtgcaggaggtgactatgaggacaatctccatagcccattgctgtccaggcaggcaacaggtgcggaagggaaggacattgtgcaccatggtcaccgtggaagtgctttgagcatgagaaggcaaagcctcttaggggagggtggagatggtgtgagcagcactgatatcggtgggggatggcagcttgcttggaaatggtcagagaaggaaggtgagaatggtagaaaggaaggtggtttcaaaagagtctacttgcaccaagagggagttcctggctcaagaaggggctcaattgtttcacttcccggtggtggcgatgttcttgagggtagtgagtttgtacatgctgctgctttagtaagtcagtcagcacttttctcaaagggtcttgctgaaccacgcatgtcagatgctgccatggttcacccatctgaggtagctgccaaaggttcacgttggaaagatttgtttgaacctggagtgaggcgtgccctgttagtcggtgttggaattcagatccttcaacagtttgctggaataaacggtgttctgtactataccccacaaattcttgagcaagctggtgtggcagttattctttccaaatttggtctcagctcggcatcagcatccatcttgatcagttctctcactaccttactaatgcttccttgcattggctttgccatgctgcttatggatctttccggaagaaggtttttgctgctaggcacaattccaatcttgatagcatctctagttatcctggttgtgtccaatctaattgatttgggtacactagcccatgctttgctctccaccgtcagtgttatcgtctacttctgctgcttcgttatgggatttggtcccatccccaacattttatgtgcagagatctttccaaccagggttcgtggcctctgtattgccatttgtgcctttacattctggatcggagatatcatcgtcacctacagccttcctgtgatgctgaatgctattggactggcgggtgttttcagcatatatgcagtcgtatgcttgatttcctttgtgttcgtcttccttaaggtccctgagacaaaggggatgccccttgaggttattaccgaattctttgcagttggtgcgaagcaagcggctgcaaaagcctaatttctttggtacctttgtgtgcaactattgcactgtaagttagaaacttgaaggggtttcaccaagaagctcggagaattactttggatttgtgtaaatgttaagggaacgaacatctgctcatgctcctcaaacggtaaaaaagagtccctcaatggcaaataggagtcgttaagttgtcaatgtcatttaccatatgttttacctatttgtactgtattataagtcaagctattcaacgctggttgttgctagaaatctttagaacaaagatgataatgatctgatctgatgttataatattcaaatctcaaataaagaaaatatcgtttctcaaaaa

SEQ ID NO: 474 - DNA, 1840 bp, Zea mays
  CDS (75)..(1643)
gcaagaagctgtccctccctccctcccctgtgcttctgctagctaggtgcctgcggaggagagatagggatacgatggccggcggtggcatcgtgaacacgggcggtggcaaggactaccccggcaagctcaccctcttcgtgttgctcacctgcatcgtcgccgccaccggcggtctcatcttcggatatgacatcggtatctcaggcggcgtgacgtccatgaacccgttcctggagaagttcttcccggaggtgtaccggaagaagcaggaggccaagacgaaccagtactgcaagtacgacaaccagctgctgcagaccttcacctcctccctctacctggccgcgctggtcgcctccttcttcgccgccaccgtcacccgcgccgtcggccgcaagtggtccatgctcgtcggcggcctcaccttcctcgtcggagccgccctcaacggcgccgcccagaacatcgccatgctcatcatcggacgcatccttctcggcgtcggcgtcggcttcgcaaatcagtccgtgcctgtgtacctgtcggagatggcgccggcgcgtctccggggcatgctcaacatcggcttccagctgatgatcaccatcggcatcctggcggcggagctcatcaactacggcaccaacaagatcaaggccgggtacgggtggcgcgtgagcctggcgctggcggcggtgccggcggccatcatcaccctgggctccctcttcctcccggacacccccaactcgctgctggagcggggccacccggaggaggcacgccgcatgctccgccgcatccgcggcacggacgacatcggcgaggagtacgcggacctggtggcggccagcgaggaggcccgccaggtgcgccacccgtggcggaacatcctgcgccgccggtaccgcgcgcagctcaccatggccgtcgcgatccccttcttccagcagctcacggggatcaacgtcatcatgttctacgcgcccgtgctgttcgacacgctgggattcaagaacgacgcctccctcatgtcctccgtcatcacgggcctcgtcaacgtcttcgccaccgtcgtgtccatcgtcaccgtcgaccgcgtcggccgccgcaagctgttcctccagggcggcgcgcagatgatcgtgtgccagctcatcgtgggcacgctcatcgccgccaagttcgggaccagcggcacgggggacatcgccaagggctacgccgcggtcgtcgtggtcttcatctgcgcctacgtcgccggcttcgcctggtcgtgggggcccctgggctggctcgtgccgtccgagatcttcccgctggagatccgcccggcggggcagagcatcaacgtctccgtcaacatgttcttcaccttctgcatcgcgcaggccttcctcaccatgctctgccacttcaagttcggcctcttctacttcttcgccggctgggtcgtcatcatgaccgtcttcatcgccttcttcctgcccgagaccaagaacgtgcccatcgaggagatggtgcttgtctggaagtcacactggttctggaaaaggttcatcgccgacgaggacgtgcacgtcggcattggcaacaaccacccggccaaaaacggcagcgacaccaagggggccgacgcgtgaacgtgatctcaacatctatattccatctacagtcacaactgaaatgtacatttaggcttccattgttccatcaactagtagctacatgtcctcctagtaaagtaccagtgtttgtttgtgtaatgtttgttacgcccattaaattcttcttggattggatgaaaaaaaaaaaaaaaaaaaaaaaaaaaaaaaaa

SEQ ID NO: 475 - DNA, 1923 bp, Glycine max
  CDS (132)..(1685)
gtttccctgtctctgttctcttcaccattctctttcttctttgtttcaagtttcaacaacccagattcactctctctctcgtaattttctctcttattgaggctagaaaaagagagcaaaaaaactaaaaaatgcctgcggtcggaggtataaacaccggagggggcaaggagtaccctggaagcctcactctatttgtgacggtaacatgtatagttgcagccatgggtggtttaatcttcggttacgatatcggaatttcaggtggagtgacgtccatggatccgtttctgctcaagttttttccgtcagtgttccggaagaaaaactccgacaaaacggtgaaccagtactgccaatacgacagccagacactgacgatgttcacgtcgtccttgtacctcgccgctttgctgtcgtcgttggttgccgccaccgtcacgcgtaaattcggccggaaactctccatgcttttcggaggcttgcttttcctcgtcggtgccctcatcaacggtttcgcccaacacgtttggatgttaatcgtgggtcggatcttgctcgggttcggtatcggcttcgccaatcagtctgtgccactctacctatctgaaatggctccatacaaatatagaggagcattgaacattggctttcagttgtccatcactgttggtatccttgtggccaatgtgttgaactatttctttgctaaaatcaaaggtggttggggatggaggttgagtttgggaggtgctatggtccctgcccttataatcacagtaggatcactagtccttccagacactcccaattccatgattgaaaggggtgatcgcgagaaggccaaggctcagcttcagagaattcgcggcatcgacaatgttgatgaagagttcaatgaccttgtggcagcaagtgaatcctctagccaagtggagcacccttggaggaacttgttgcaaagaaagtacagaccccacctcaccatggcagtgttgattccattcttccagcaactcactggaatcaatgtcatcatgttttacgcgccggtcctgttcagctccatcgggtttaaggatgatgctgctctaatgtcagctgtgatcaccggcgttgttaatgttgtcgcaacttgtgtctcaatttatggtgttgacaagtggggtaggagagcccttttccttgaaggtggagtccaaatgctcatttgccaggctgtagttgcagctgcaattggagcaaagtttggaactgatgggaacccaggtgatttgccaaagtggtatgcaattgttgtggttctcttcatttgcatttatgtatcagcatttgcctggtcatggggtcccctaggttggttggtgcctagtgagatctttcccttggagattcgttcagctgctcagagtatcaatgtgtcggtgaacatgcttttcactttcttgattgcacaagtcttcttgacaatgctttgccacatgaagttcggcttgttcctcttctttgccttcttcgtgttgatcatgacattcttcgtctacttcttcttgcccgaaacaaagggcattccaattgaagaaatggggcaggtttggcaggcacaccccttctggtccagattcgtggagcatgatgattatggcaatggtgttgagatgggaaagggagctattaaagaagtgtagttagtcctcgtcttggtttatttttctcaatgactagcgttttagcttttgttggtaaatcatactattggtttcaatgtattgaattgttcctaaaaattaaaaagggttatttttcttatgtatcccctgcttcttcatatgaagcaagtttacaggatacttttctatattaatccaattgcacaaattgttatgcctttgaaaaaaaaaaaaaaaaaaaaaaaaaaaaaaa

SEQ ID NO: 476 - DNA, 1883 bp, Zea mays
  CDS (141)..(1670)
gcgcgcgctagcctagctgctcctgcctggttcgccgtagcccgtagcccgtagcacaacaacaacaaaaaaaatctccgcggcgcggggggaggtggtctgttcaccttggggagcagcggcgggccgtcggccgagaaatgcccggtggcgccttcctcctcaacggcagcggcggcggcatggcggactacggcggcggcctcaccgtccccgtcgtcgtgacctgcctcatggcggcctccggcggcctcatcttcggctacgacattggcatctcaggaggtgtgtcggagatggaggatttcctgaacaagttcttccccgggttgctcaagaggacggcgcgcgccaacaaggacgtgtactgcatttacaacaaccaggcgctgacggccttcacgtcgtcgctgtacgcgttcggcatggtggggacgctgctggcgagccgcgtgacccggcggctggggcggcaggccgtcatgctgatcggcggcggcctgttcttggccggcgccctcgtcaacgccgccgcggccaacatcgccatgctcatcgtcgggaggatgctgctcggcctggggctcggcttctccggccaggccacgccggtgtacctcgccgaggtgtcgcccccgcgctggcgcggcggcttcatctcggccttccccctcttcatcagcgtcgggtacctggtggccaacctcatcaactacggcacctcgcggatcccgggctggggctggcgcctctcgctcggcctcgcctccgtcccggccgccgtcatggtggtcggcgccgcgttcatcccggacacccccagcagcctcgtcctgcgcgggaagcacgacgacgcccgcgccgcgctccagcgggtgcgcggcaagggcgtggacatcggccccgagttcgcggacatcctcgccgcggcggagaacgaccgccggaacgaggagggcgcgttccgccggatcctgcgccgggagtaccggccctacctggtgatggccgtggcgttcccggtgttcctcaacctcacaggggtggccgtcaccgccttcttctcgccgatactgttccggaccgtcggcttcgagagcgacgccgcgctcatgggcgccgtcatcctgggcctcatgaacatcggcggcatcctcgcgtcgggcttcgccatggaccgctacggccggaagctgctcttcatgatcggtggcgcgctcatgttcacgtgccaggtggcgatggcgagcataatcggatcacacctcggcaacgggagcaagatgcccaaggggtacgcggtgacggtgctggtggtggcgctgatcttctcggcgagcttcagctggtcgtggggcgcgctgtactggaccatccccggcgagatataccccgtggaggtgcggtcggcggggcagggcgcggccgtggcgctcaacctggggctcaacttcttgcaggcgcagttcttcctggccatgctgtgctgcttcaagtacggcaccttcctcttctacgcgtcgtggctggttgtcatgaccgccttcgccgtggcgttcgtgccggagaccaagggcgtgccgctcgagtccatggctcacgtcttcgcgcgccactggtactggggcaggttcgtcaaggaccaccagaagttgggcgaagagtccacctagctaagctaataattcggaatcagcgaacgacgtaccctactaccagtagcagattattgataagggagtcaaacacatattgcgtgtgtgtgtcttttaaagtgttcgtttagaatggcttgagaagctcatccgtgtagtaaatttggagacttcgaaatataataaatatgttcgtagttggcaagctaaaaaaaaaaaaaaaaaaaa

SEQ ID NO: 477 - DNA, 2127 bp, Glycine max
  CDS (160)..(1899)
attcggctcgagatttcaccaatttctattttcataactttctctgcagtctcttcacctttatgttaatgatattatgtgtttagagagaaagagaacaagcatagttgagcttgattgtgttcttcaacattagaacaagaaaagaaagacaacaacatggaaggaggaggagtagaagttgatgcctctgctttcagagaatgcttgtctctgtcatggaaaaatccttacgttcttcgccttgctttttctgctggaattggtggccttctctttggctatgacactggagtcatatctggggctattttatatatcagagatgatttcaaagcagtggataggaagacttggcttcaggaagccatagtgagtatggctcttgctggagcaatcgtaggagctgcagttggtgggtggattaacgatcgatttggaaggagaaaagctattcttcttgcagacacactcttctttattggctctgctgtcatggctgccgctaccaatccatctattctcattgttggtcgagttttcgttggccttggtgttggaatggcctcaatggcatctcccttatacatctctgaagcttctccaactagagttcgaggtgctttagttagtctcaatggctttctcataactggaggacaattcctctcctacctcatcaacttggccttcacaaaagcaccaggaacatggagatggatgttaggagcagcagtagtaccagccctgatacaaatcgtattaatgatgatgctgccagaatcaccgcgttggctgttccgaaagggaagagaagaagagggtaaagaaattctaaggaagatttatccaccccaggaagttgaagcagaaattaatactttgagggaatcagttgaaatagaaatcaaggaagcagaggccacagataacatcagcatagtcaaaatgctgaaaactaaaactgtgagaagaggtttgtatgcaggaatgggccttcaaattttccaacagtttgtggggatcaacactgtgatgtactacagtcctaccatagttcagttagctggttttgcatccaaccgaacagcacttcttctgtcactagtcacatctggtctcaatgcatttggttctattttgagtatatacttcatagacagaacagggaggaaaaagcttgtgttgttcagtttgtgtggtgttgtgttctcccttgttgttctaaccgttgtgttccatcagagtacaactcactccccaatggttagtgcactcgaaacctctcacttcaataacacttgcccggattaccattcagctgcgaaccctggtggatgggattgcatgaagtgcctgaaggcttctccaaattgtggcttctgtgcttctggagccaataagctcttacctggggcatgtttgatctccaatgacaccacaaaagatcagtgccatgaagaagatagactatggtacaccgtggggtgtcctagtaaatttggatggcttgcaatagtagggcttgcactctacatcatattcttctcacctgggatgggaactgtgccatgggttgtcaactctgagatttatcccctaagatatcgaggaatatgtggaggaatggcatccacatccaattgggtctcaaatcttattgttgctcagtccttcctatcattgacacaagctattgggacctcatggacatttatgatatttatattcatcaccatagctgccattatctttgttattattttcgtgcccgaaaccaaaggacttccaatggaagaagtggagaagatgttggaaggaagagatctcaacttcaagttttggcagagaagttctcactgtggagaagaagtaccaccacaaaagactcaatcaaattaagtctattgtgttgcatcatttgtaatattggagtattaactaaagaagtataggtaataaaatcgtagaatgtagctattagattctaagtatatacaataaaatcgtagaatgtagctattagattctaagtatatacaatatcttgtttgtgtgaatttttttcttatcaacaaatattattttgttaattttgttacaaattaaaaaaaaaaaaaaaaaagg

SEQ ID NO: 478 - DNA, 1931 bp, Zea mays
  CDS (74)..(1690)
cgcatttcgaaatccccaaacggaagcatcgccactcttccgaacctgaacaatcaccaccgttattaagaagatgatgcgctgcgctgcaacgggcggcgggtgcgtcgcttcgtggagcggcgatcggagattgccggcggtcaacccctgcagcgtgcggatgccgacgggcaacgatgggtggtgcgccggcctgaggtcgcgggcggcggatctcgccggcctcgagatggccaacctgcgcggcggcgtcggggggctcttccgcgcgagcccgcgctacgggcgcttgcaagccacggcggcagttgaccctgaagatattccattggagaaggttcaagttaaatcctcaggacatgttctgccatatgttggcgttgcttgtttgggggctattctgtttggttaccatcttggtgtggtcaatggcgcacttgaatatctcgcgaaggatcttgggattgctgaaaatgctgtcttgcaggggtgggtggttagcacatccttggctggtgcaacactaggttcttttactgggggttctttggcagataaatttgggcggacaagaacattcatcctggatgcagtcccacttgctctaggtgcattcttgagtgcaacagctcaagatatccgcacaatgattattggccgattgcttgctggaattggtatcggggtctcatctgctcttgtacccctttacatatctgagatctcaccaactgaaattcgtggaacacttggtaccgttaatcaactttttatttgcattggaattcttgcagctttgttagctggattgcctctggcaggaaatcctgcctggtggaggacaatgtttggaattgctgtagttccatccattctgctggctgtaggaatggccttttcgcctgaaagccctcgttggctattccagcaaggaaaggttactcaagcagaattagctgtaaaaagactgtatggaaaagaaatggttaccgaaattatgtttgatctgagagctagtggccaaagttcttcggagtccgaagccggctggtttgatcttttcagcaagcgttactggaaagttgtgagtgtgggggcagcactgtttttgttccagcagcttgctggtataaacgctgttgtatattactctacatcggtgttccgtagtgcaggcattgcatctgatgttgctgctagtgctcttgttggagcagccaatgtttttggtactatggttgcatcttctctaatggacaaacaaggaaggaaaagccttctgataacaagcttttctggaatgggtgcttcaatgctactcctagcattgtccttcacctggaaagctctggcaccttattctggtactcttgctgttgttggcactgttctgtacgtgctgtcatttgctctaggagcgggccctgttccagcgctacttcttcctgaaatatttgcctcgagaataagggccaaggctgtcgcattatctctaggcatgcactgggtatctaactttttcattggcctgtacttcctgagtgtcgtgagcaagtttgggatcagcaacgtgtatctgggatttgcatcagtatgtgcccttgcagttctgtacatagctgggaatgtggtcgagaccaaggggagatcacttgaagagattgaaagggagctaagtgtagcagaatgatgtacttttgctagtcatgctgtggcgccgttttggttatcgagaatgcaaccaagcgctcaaccgagcatccttggacctggagactctttctagtttcatgtagttttagaaataagcgaacggcaagagtaccaatcttaggtgacttggtgtgggttgtgtctgaaataagtgaattggattgtagaatttcagaaataagtgaattggattgtagaatttaaaaaaaaaaaaa

SEQ ID NO: 479 - DNA, 2051 bp, Zea mays
  CDS (146)..(1744)
catcgacatcctctcacctccctcgcactccattggatttgggggagctcggggggcgcgggccactgatgatccccggaacgagcaccgatccgtggcgaggaaactccaccgggtagccggcccgggagcgcggggcacggcgatggcgggcgccggggcagcggccaatggcggcaggaacaagtacgcggttctcgatcggagcgaggagcgacagacggacgctaggacggagcggcggaggaggccgttggcgcccgagagcgagagggggagaagggagcggttcgtgtacgcctgcgcggtcttcgcctccctcaacgccgtcctgctcggctacgatgttggcgtaatgagtggcgcgatcatctacatgcagaaagacctccacataaccgagtttcagcaagaaatcctagtaggctgtctgagcgtggtctcactcttgggaagcctatcaggggggcgaacatctgacgcaattggcagaaaatggacaatgggcctcggtgcaattgtgttccagataggcgcgaccatcatgacgtttgctccatcattcactgtgcttatgatagggaggctccttgctggggttggcattggctttggtgccatggtatctggagtgtacattgctgagatctcccccgcaggtgcccgagggacgctcacatcccttcctgagatctgcatcaattttgggatccttcttggctacgtttccaattatgccttctcaggcctttctgagcacatcaattggaggattatgcttggtgtcggtatcctcccatcagtcttcattggctttgcgcttttcgtgatcccggagtcccctaggtggttgatgatggagaagagagtttcagaagcaagggcagtgctgctgcagattagcgagtctgaagctgaagctgaagaacggctggctgagatcgaggaagccgcaggtctgatgaaatcaatgaaatctgaggacaaagaagtgtggagggaacttttgaacccgtctcccgccgtccgtcggatgctgtacgctggttgcggtattcagttgttccaacagatcacaggaattgatgctactgtctattacagcccaacaattttcaaagatgctggcatcaagtctgatcaggagcttctcgctgcaactgttgctgtgggtttcactaagacagtgttcatcttggttgcaattttcctaattgatagagttggacggaagccacttctttatgtgagcaccattggcatgaccatctgcttatttctcttgggggttgcacttacactgcaaaaccatgcggtggggcttatgtctccacgtgttggtatcgacctagcaattttcgcagtttgtggcaacgtggcattcttttcaattggcatgggaccaatatgttgggtcttgtcctcagaggtatttcctttaagattacgagctcaagggtcagcgcttggtcaagtaggtggtagagtgagcagtggtttggtttccatgtcattcctttctatggcccgtgctatatcagtggcaggaatgttcttcgtctttgctgcaatatccactatctctgtactgtttgtgtacttttgtgtgccagaaacaaaagggaaaacactggagcagatcgaaatgatgtttgaaagtggggacgaatggggaggaggtgaaattgagcttgaggatacacagcatttaataccgagtatcaagaagtctgtgcctcttggttgatatttgtagcatcaataaaattcttattagctccatgtttcaatgacgagccaaccaaaccagctggattctgaactttggtttcgagtgatctggccacactgagccacgaccgatctgataaaagataagcttgatagacataggtgcaacgtagaagattaattgtgatgttagttcaaaatgtcaatgattttactgggaggcggtctgtaatgtatgatcttacatctcttgtaccttcttacatctctcgtacctcccagcggaagaatatactcgcagaaaagttttctaaaaaaaa

SEQ ID NO: 480 - DNA, 1768 bp, Glycine max
  CDS (63)..(1505)
ttgctttctaattattcgtgttgtcagtgtctctttgaggccattttgctagctatttaataatggcaattgagaagcatgaggatgttgagagtggatatttgcacgagcccttcattcaaccagaggatgctgctgctgcttgtaaagaaaatggatcagataagagtgtgaaaaatggatccattggaatggttttgcttagcacacttgttgctgtttgtggttctttcacatttggaacttgtgtgggctattcagcacccactcaagcggctatcagggcagatcttaatctctctcttgctgagttttccatgtttggttcattagtgaccattggtgcaatgcttggagctataaccagcggcaggattacagatttcattggccgcaaaggggcaatgaggatttcaacaggattttgcattacaggatggatagctgtcttcttctctaagggttcttactcccttgacttcggaagatttttcacaggttacggcattggagttatctcatacgtggttcctgtatatatagcagaaatagcacccaaaaatcttcgaggaggactagcaacaacaaatcagcttttgattgttactggagggtcagtctcattcttattaggaagtgttataaattggagagaacttgcattagcggggctagtgccttgcatttgcttgctggttggtttgtgctttatccctgagtcccccagatggctggctaaggttggccgtgaaaaagaatttcaactagctttaagtagacttcggggtaaagatgctgatatttctgatgaagctgctgaaattctggattatattgaaactcttcaaagtcttcctaagactaagctgttggatttgttccaaagcaaatatgtgcactctgtagttattggggtcggcttaatggcatgtcaacaatctgttggaattaatggcataggattctacacagctgagatttttgtagcagctggactttcttcaggaaaagctggtaccatagcatatgcttgtatacagattccatttacattattgggagccattttgatggacaagtctggaagaagacctcttgtaatggtttccgcagctgggacattcttaggttgctttgttgctgcctttgctttctttctcaaggaccaaagcttattgcctgagtgggtacctatattagcatttgctggcgttctgatctacatagcagcattttcaattgggctcggatcagttccatgggtgataatgtctgagatatttcccatacatttgaaggggactgctggaagcttggtggttttggtggcttggctaggagcttgggtagtttcatatactttcaactttcttatgagctggagttctcctggtacattgtttttgtatgctggatgttccctcttaactattctatttgtagcaaaattagtcccagaaaccaaaggaaaaactttggaagagatccaggcttgtattagttcatagagataaaagatcaaaaacgcactgcaggacccagtcaaaccattaccaccatttttcaaattcttttacatccatttaggaccgtcaaggcataaaataacataatgttgccatatcgatccatttttgttgttgtataataataataataataataataatgtatcattagcttatttgataagaaaaaaaaaaaaaaaaaaaaaaaaaaaaaaaaaaaaaaaaaaaaaaaaaaaaaaaaaaaaaaaaaaaaaaaaaaa

SEQ ID NO: 481 - DNA, 1680 bp, Glycine max
  CDS (63)..(1595)
ttgagagcgagaaaccacgtttctctcttgaggttaattattattattattgagtattgagcatggaggcgccatctctcaccaaacccaacgacccaacaaaaccttccaacacttccagcacccttagtctggagggggggccgggcgaagcgagcccactccgaaaaatgtttgcggtggcgtccatcgccgccggcatacagttcgggtgggctctgcagctgtctctcttaaccccctacgttcagctcttaggagtcccccacgcggcggcctccttcatctggctctgtgggcccatctcggggctggtggtgcagcccattgtgggctactacagcgaccactgcacctctcgcttcggccgaaggcgccccttcatcctcggaggcgccttagccgtcgccatcgccgtgttcctcatcggctacgcggccgacataggacactccgctggcgacgacataactaaaaaaacccgaccccgtgcagttggggtcttcgtcataggattctggatcctagacgtggccaacaacatgctccagggaccctgccgcgcctttttagctgacctcgctgccggcgaccagcaaaaaacgagaatcgccaacggtttcttctcgttcttcatggccgtcggcaacgtgcttgggtatgctgcagggtcctacagcggtctccacaagatcttccccttcacggagaccaaggcctgtgacgtcttctgcgcaaacttaaaaagctgtttctttttctcgatcctactgcttctctttttagcaactgttgctctgctctacgttaaggacaagcaagttgaagcaattcctctggatgatgccactcaaccctcttgtttctttcagcttttcggtgctctgaaagagctcaagagaccgatgtggatgctgatgctggtcacagctgtgaactgggtggggtggtttccttacttccttttcgacactgactggatgggtcgtgaggtctacggtggaactgctggggaggacgcgtacgcgaagggagtgcgcgtgggatcgttagggctgatggtaaacgccgtcgtgttgggcttcatgtcgttggcggtggagccgttggggaagatggttgggggagtgaagaggctttgggcgattgtgaactttattctcgcgattgggttcggaatgacggtggtgatcaccaaggtggcggagcaccagcgccggatgaaccccgccgccgtgggccacccctccgagggggtggtggttgggtccatggttttctttggggttcttggagttccccttgcgattactttcagtgtcccttttgctctagcatcaatatactgcagcgcttcaggagcaggacaaggtttatctttgggagttctcaatcttgcaattgtggtaccacagatggtggtgtctgcattaagtggtccttgggattccttgtttggtggtggcaacttgccggctttcatggtgggtgctgcggcagccgcgttgagcgccataatggcgattgtcttgctgccaactccaaagccagctgatgaggccaaggcttcaagcatgatggcagggggctttcactagttaatggagttttgcatgtttcagttttgtcccctgctttaatagaaaaaaaaaaaaaaaaaaaaaaaaaaaaaaaaaaaaa

SEQ ID NO: 482 - DNA, 1831 bp, Zea mays
  CDS (76)..(1599)
ccacgcgtccgaaggtctcctccctcggtctccctcgggctaggctagctagctaggttaccactctggtacaacatggctggtgatggcatggaggtatctgccagcgggggtggcggcggcaacaagcagccgcagatcagccttttggggctgttcctcgcctgcatggtcgccggcggcgtgcagtacggatgggcgctgcagctctcccttctcaccccctacgtccagacactggggattcctcatgctcttacatcagtcatgtggctctgtggacctattgctggcttacttgtacaaccctgcgtcggcctctatagtgacaaatgcacttctaagcttgggagacggaggccattcatctttacaggatgcatcatcatctgtatatctgtgatagtcatcggtttctcctcagacatcggttacgctctcggtgacacgacggaagactgcaatgtttacacggggaagcggctgcacgcggccttgttcttcgtgatgggattctggctgctggacttttccaacaacacggtgcagggccccgcacgcgcgctgatggcggacctcgcaggcagccacggacccagcacggcgaacgccatcttcgtgtcgtggatggcgatcgggaacatcctgggctactcgtcggggtccaccgacaagtggcacacctggttcccgttcctgcagacgagggcatgctgcgaggcgtgcgccaacctcaaggccgccttcctggtgtcggtggtgttcctgggcctgtccacggtggtgaccatgatcttcgcccgcgaggtgccgctggacccggcggcggcggcgaagcaggacgaggccggggagtcgtcgggcccgttcgccgttttcaagggcatgaagaacatgccccccggcatgccgcaggtgctcatcgtcacgggcctcacctggctctcctggttccccttcatcctcttcgacaccgactggatgggccgcgagatgtaccacggcaggcccgacggcagccccgaggaggtggccaggttccaggagggcgtccggcagggcgccttcggcctgctcctcaactccgtcgtcctcggagccagctccttcctcatcgagcccatgtgccgcaagctcaccgccaaggtcgtgtgggtcatgagcagcttcctcgtctgcgtcgccatggccttggtcaccgtcctcagctcctggtcgctcggcgacatcgggggcaacgtgcaggacgccgccgccgtggataagggcctcaagaccaccgcgctcgccatcttcgtcttcctcggcttcccattcgcggtcctatgcagcgttccgttcgccgtgacggcacagctggcggcggccaagggcggcgggcaggggctgtgcacgggggtcctcaacatctccatcgtggtgccacagatggtcatcgccattggctctgggccgtgggacgagctgttcggcaagggcaacatcccggcgttcggccttgccgccgtcttcgccttcaccgctgccgtcgcagggatcatcatgctgccaaagcagcccaagaccagcttccggtccgtctccatgggaggaggccattgatgatcacaactctaggatgcatggtccactgtggttcacgattcttttacctttgggagttggacggccaggtgtttgttctcaaggccgcttccgaggcctaaaccggtgggtttatttctaggccggatcatgacgaacaatctgtttcgctgggttgtaaaggaaaagttttacacgaacacacaacgtgtcggctatttaacttttggaaaaaaaaaaaaaaaag

SEQ ID NO: 483 - DNA, 1996 bp, Zea mays
  CDS (201)..(1763)
ccacgcgtccgcccacgcgtccgatacgtacgtgaagaaccaacaggagggccgggctctcgctcgccgcgcgcacccccctctctctatctctcccgccgccgttgatctatcaccgggccgccggtccgtgactgtcgccagcggctgctggttgttgcttggttgcgtcgccgcgggagccgtgtgacccgggcgcaatgccgggagccgtgatcgtgcaccaccacacgaggtacaagacgtaccccggcgaggtcaccggcatcgccatcttctcgtgcttcatcgcctccgtcgccggctgcatcttcggctatgacatcggcctcacatccgggctgacgtcgacggagccgttcctggtcaagttcttcccctccatctacgaggagatgaagaggcaggtggtcgtcaaccagtactgcaagttcgacagccaggtcctgacgctgttcagctcctccctcttcctcgccgcgacggtggccaccttcttcgccggcccgatgacccgcgccttcgggcgcaagtggaccctgttcgccgccgcgtccgcgtacgtggtcggcgcgtgcatcggcggcgtgtccgtgaacttcccgatgctgctcacgggccgcgtcctcgttggctccggcgtcggcatctccatccaggcggccccgctctacatctccgaggtggcgccggcgcagcagcgcgggatgctcaacatcctgttccagctcatgatcacggtgggcatcctgacggcgaacatgaccaactacctggcgtccaaggtctcgggcggctggggctggcgcatccccgtgacgttcggcgccatcccggccgccgtcatcgcgctgggcgcgctcgccatcccggacaccccggcgtcgctcgtcgagcgcggggacacggccacggcgcgcaagacgctgtcccagatccggggcgtcggcgacgtgcgcgaggagttcgacgacctggccgccgcgagcgaggacgccaaggccgtgcagtgcccctggcgggagctcttcttcggcggcaagtacaagccccagctcacgttcgcgctgctcatccccttcttccagcagctcaccggcatcaacgtcatcatgttctacgcgccggtgctcttcaagacagtcggcttcaagcagaacgccaccctcgtgtcctccgtcatcaccggcctcgtcaacgtcttctccaccttcgtcgccatcgccaccgccgacaagatcggacgccgcgcgctcttcctgcagggcggcacgcagatgatcatctcccagatccttgtggggacgttcatcgggctgcagttcggcatgagcgggacgggcgacatctcggagcagtacgccatgtgcatcgtgctgttcgtgtgcgtgtacgtggccggcttcgcgtggtcgtgggggcccatggggtggctggtccccagcgagatctacccgctggccgtgcggtcggcggcgatgagcgtcacggtggccgtcaacatgttcttcacggccttcatcgggcagatcttcctcacgctgctctgccacctccgcttcggcctcttctacttcttcggcgcctgggtgctgctcatgacactcttcatcgccatgctgctcccggagaccaagagcgtgcccgttgaggagatggcgcacgtctggaagaagcactggttctggcgcaagttcgtcatcgacaccggcaacgacgcccgcaacgccgagatgaggaagaggatagcgctagagatgagctgatcatcgtcgtccatgcatgcagtctccatcgcccatgcatcatatatatgcagtaggcaggcaggcagatgaaggaaattacgtacacaagcgccaactaaaactaaacccaagtcaattacttcatatatcactcaatagctgctagaacatatatgaatggttgttgtagactgatcgtaatcccagatagttatgatatacatctttcattttaaaaaaaaaaaaaa

SEQ ID NO: 484 - DNA, 2211 bp, Zea mays
  CDS (93)..(1634)
ccacgcgtccgcccacgcgtccgccgttcctcgtcgtctcgtgttgtttctcgcgttgccattgccccagctgtccgcccgcgcccgcggcaatggcaggcggcgtggtggtgaacgcggccgggggcaagacgtaccccggccgcatgacgccgttcgtgttcttcacctgcctggtggcgtcatcgggcggcctcatcttcgggtacgacatcggcatctccggcggtgtcacgtccatggcgtcgttcctcaaggagttcttcccttccgtgtacgccaaggcggcggcgaacaaggacacgaaccagtactgcaagttcgacagccagctgctgacgctgttcacgtcgtcgctgtacctggcggcgctggcgacgtcgttcgtggcggcgtccgtgacgcgggtgttcgggcgcaagtggtccatgttctgcggcggggtgaccttcctggccgggtcggcgctaaacggcgccgccaccgacgtgatgatgctcatcatgggccgcatcctgctgggcgtgggcgtcggcttcgccaaccagtcggtgccgctgtacctgtcggagatggcgccggcgaagctgcgcggcatgctcaacatcgggttccagctgatgaccaccatcggcatcctggcggcgaacctgatcaacttctggacggcgggcatcgagggcgggtggggctggcgcatcgggctggggctcgcgggcgtgccggcgctcatcatcaccctgggcgcgctggtgctccccgacacgcccaactcccttatcgcccgcgggttcaacgacgacgccaaggcggtgctggtgaagatccgcggcacggacgacgtgcaggacgagtacgacgacatggtggcggcgagcgaggaggcgaacgccatcgagcacccgtggcgcaacatcctggagcgcaggtaccggccgcagctgacggtggcagcgctgatccccttcttccagcagctgacgggcatcaacgtgatcatgttctacgcgccggtgctgttcctgaccatcggcttcggcgacgacgcgtcgctgatggcggccgtcatcacggggctggtcaacatgttcgccaccgtggtgtccatcgtgtgcgtggaccgcctgggccggcgcgcgctgttcctgcagggcggcacgcagatgttcgtctcccagatcgtggtgggcacgctgatcgcgctccagttcggcaccgccggcgtgggcgagatgtcccgctccaacgcctggctgctggtgctcttcatctgcctctacgtcgccgggttcgcctggtcgtgggggccgctgggctggctcgtcccctcggaggtgttcgcgctggaggtccggtcggcggggcagagcatcgccgtgtgcgtcaacatgctgctcaccttcatcatcggccaggccttcctcagcatgctgtgctcgctcaagttcgggctcttctacttcttcgccgggtggatgttcatcatgaccaccttcatcgccctcttcctgccggagaccaagggggtgcccatcgaggagatgaacctcgtctggagccgccactggttctggggcaagtacgtcaacgtcgacacacaacacggcggcgccagcccgagatccaacggcgtctgatctgagcaagctgcagcaacacctcggcacctgacctggccatgcatgcacacgtatactataatctaacaacgtagctgacctgggcaaattgccagcctgacaggggccagggtgctcgaatgtctcactctcaccgccgactaactttccatcaaaattgattcttgttcatactccatagcatgcacagattgattgaactgctacttgagattcttgtcattgttattagagagagagacagagacagaacgattggcatagcatgcagaattgtttggaagaagctagcaaagcagttccttgtttgtatcctctgtaccagaagatgagtttgatctaggattaatccctgcaaggcaaggtaaagtaaattcatgttgtactcaaaactaacttctcccatatctgtacgtcgtataaaacaaatccctgcaatgtgcaaagattgtcccgcgtagtgattttttcgtctccagcaagatctcaaacaagccccaaatctaagtgtaacatgtttgcattcgaattaaaaaattgaatcccttattgtgaaaaaaaaaaaaaaaag

SEQ ID NO: 485 - DNA, 1542 bp, Arabidopsis thaliana
  CDS (1)..(1539)
atgggagcctatgaaacagaaaaaccaactaaagatgcggcggctctagagacacagtcgccggaagatttcgatcaaccatctccgcttcgtaaaatcatctccgtcgcttccatcgccgccggtgtacagttcgggtgggccttacagctctctcttcttactccgtacgttcaactcctcggaatccctcacaaatggtcatctctcatttggctctgtggtccagtctccggcatgattgttcaaccaatcgtcggtttccacagtgaccgatgtaggtccaaatttggtcgacgtcgtcctttcatcgccaccggagccgcactcgtcgccgtcgctgttttcctcatcggttacgctgcggatttcggttataaaatgggagataaactcgaggagaaggttaaagttcgagctatagggatctttgctctcgggttctggatcctcgacgtagccaacaacaccttacaaggaccttgccgtgctttcttagccgacttagccgccggtgacgctaagagaacgcgagtcgcaaacgcgtttttctctttttttatggcggttggaaacgttttgggttatgcggctggttcgtacactaacctccacaagatgtttccgttcacaatgacaaaagcttgcgatatctattgcgccaatctcaagacttgtttcttcttatccatcactctcctcctcatcgtcaccgtcacgtctctttggtacgttaatgacaaacaatggtctccgccgccgcgaaatgccgacgacgacgagaagacctcaagcgttcctttgttcggtgaaatctttggagcattcaaagtcatgaaacgtcccatgtggatgcttctaatcgtcacggccttaaactggatcgcttggttcccatttcttttgttcgatactgattggatgggtcgtgaagtgttcggtggagattcagatggaaatgaacgatcgaagaaactatacagtcttggagtccaatctggtgcaatgggattgatgtttaactctatagttcttggtttcatgtcacttggtgttgaatggattggtcggaaattaggaggagctaaacggctttggggtattgtcaatttcatcctagccgctggtttggccatgacggttctcgttacgaaattcgccgaggatcaccggaaaaccgccggtgatttagccggaccgagcgctagtgttaaagctggagctttaagtctctttgctgttcttggtatcccattagctattactttcagtactccttttgctctagcatccatattctcaagctgctccggtgcaggccaaggactttcattaggagttttaaatttggcgattgtgataccacaaatgatagtctcactaggaggtggacctttcgacgccttgttcggcggtggaaacttaccggcgtttatcgttgcagcaattgcagcggcgattagtggagtattagcgttaaccgttttaccttcaccaccaccggacgcacccaaggcaacgaccatgggaggattccactag

SEQ ID NO: 486 - DNA, 1776 bp, Arabidopsis thaliana
  CDS (1)..(1773)
atgagtgactcggtgtcgatctcggtcccgtataagaatttgaggaaggaaattgaacttgagacggtcacgaagaatcaagacggatctggttcttcgtcgttctcttcttctcctttgaatcatcctgaatctgctgatggtgaatctgtgtcgaagaattgtagcttagtgacgttggtacttagttgtacagtcgctgctggtgttcaatttggttgggcattgcaactttctcttcttactccttatattcagacccttggaatatcgcatgctttttcttcgtttatttggctgtgcggcccaattacaggccttgtggtccagccttttgttggcatttggagtgataaatgtacttcaaagtatggaagaagacgaccatttattctagttggatcattcatgatctcaatagcagtgataataatcggattttctgcagacattgggtatctgttaggagattcaaaggaacattgcagtactttcaaaggcacacgaaccagggcagctgttgtctttatcattgggttttggttgttggatctagcaaacaatacagtacagggacctgctcgtgctcttctagctgatctatcaggtcctgatcagcggaatactgcaaatgctgtgttctgcttgtggatggctattgggaacatccttgggttttctgccggtgctagcggaaaatggcaagaatggttcccttttttaactagtagagcatgttgtgctgcatgtggaaatctcaaagcagcgtttcttcttgcagtggtctttctcactatatgtactcttgtcacaatctattttgctaaagagattccttttacaagcaacaagcccacccgcatacaagattctgcacctttgttggatgatctccagtccaaaggccttgagcattcaaaattaaataatggtactgccaatggaatcaagtatgagagagtggaacgtgatacggatgaacagtttggcaattcagagaatgagcatcaagatgagacctacgttgatggccctggatctgttttagtgaatttgctaactagtttaaggcatttgccaccggctatgcactcagttcttatcgtcatggctcttacatggttatcctggttccccttctttctgttcgatacagattggatgggaagagaagtttaccatggggatccaacaggagatagtttgcatatggaactctatgatcaaggtgtacgtgaaggtgcacttggtttgctactaaactctgttgttcttgggatcagctcatttctcattgaaccaatgtgtcagcggatgggtgctcgggttgtatgggctttgagcaattttactgtatttgcctgcatggcaggaacagctgtaatcagcttgatgtctctcagtgatgacaaaaatggaattgaatacataatgcgtggaaacgaaacaacaagaaccgcagccgtaatcgtttttgcactccttggttttcccctagctatcacatacagtgtccctttctctgtcacagcagaagtcactgctgattccggtggcggtcaaggtttggctataggagtgttgaatctcgcaatcgttattccccagatgatagtatcacttggagctggtccgtgggatcaattgtttggaggaggaaacttaccggcgtttgttttggcgtctgttgctgctttcgctgctggagttattgcattgcaaaggcttcccacgctatcgagttctttcaagtccaccggtttccacatcggctaa

SEQ ID NO: 487 - DNA, 1533 bp, Arabidopsis thaliana
  CDS (1)..(1530)
atggctacttccgatcaagatcgccgtcacagagccactcgcaaccgtccaccaatacctcgaccctctaattcatcatctcgtcccgttgtacctcctcctcgatcaaaagtttcgaagcgtgtgcttctccgtgtagcttccgtcgcatgcgggattcaattcggatgggcgcttcagctttcgcttctcacaccttacgttcaagagctagggatcccacacgcttgggctagtgtgatttggctttgcggtcctctctctggtttgttcgtgcaaccgctcgttgggcatagtagcgataggtgtactagtaagtacggtcgtcggagaccgtttattgtcgccggagctgtggcgatttctatctctgttatggttattggtcatgcggcggatattggatgggcatttggggatagagaagggaagattaagccgagggcgattgttgcttttgttttagggttttggattcttgatgttgctaataatatgactcaaggtccttgtagagctctcctcgctgatcttactgagaatgataatcgcagaacccgggtggcaaatggctacttctctctctttatggctgttggcaatgttcttggctatgctactggatcatacaatggttggtacaagatcttcacttttacgaagacagttgcatgtaatgtggaatgtgccaatctcaagtctgccttctacatagatgttgtctttattgcaataactacgatcctaagcgtttcagcggctcatgaggtgcctcttgcttcattgacttctgaagcacatgggcaaaccagtggaacagacgaagcttttctttctgagatatttggaactttcagatattttccaggaaatgtttggataatcttgcttgttacagcattgacatggattggttggtttccatttattctgtttgatactgattggatgggtcgagagatctatggcggtgaaccgaacataggtacttcatatagtgctggggtcagtatgggtgcacttggtttgatgttgaattctgtttttcttggaatcacttcggtgctcatggagaaactttgcagaaagtggggggctggttttgtttggggaatatcaaatatcttaatggctatttgctttcttggaatgataatcacctcatttgttgcgtctcaccttggctacattggccatgaacaacctcctgccagcatcgtgtttgctgctgtgttaatctttacaattctgggcattccattggcgataacttacagcgtcccatatgcgttgatttccatacgtattgaatccctgggcctaggtcaaggcttatctttgggtgtgctaaatttggcgatagtcatcccacaggtaattgtgtctgttggcagtggcccatgggatcaactgtttggaggtgggaattcaccggcacttgcagtaggagcagctacaggcttcattggcggaattgtagctatcttggctcttccacggacaaggattcagaagcccatccctctcccatga

SEQ ID NO: 488 - DNA, 2036 bp, Oryza sativa
  CDS (67)..(1680)
tttcttggcctctcctcctctgacacaggggtgtgcaggtttgtgtttgtgcgtggcgcgtccgccatggctcgcggcagcggggccggaggaggcggcggcggtggtggcggggggctggagctgtcggtcggggtcggcggcggcggcgcgcgtggtgggggaggcggtgaggcggcggcggcggtggagacggcggcgccgatcagcctcgggaggctcatcctctccgggatggtcgccggcggcgtgcagtacgggtgggcgctccagctctccctcctcaccccctacgtccagacactcggactgtcgcatgctcttacttcattcatgtggctctgtggtcctattgctggcatggtggttcaaccatgcgtgggtctatacagtgataggtgcacctcaaaatggggaagacgaaggccatatattcttacaggatgtgtgttgatatgcttggctgtcgtagttattggattttcagctgacattggatacgccatgggtgatacaaaggaagactgcagtgtctaccatggatcacggtggcatgctgctattgtatatgtcctgggattctggcttcttgatttttccaacaacactgtgcagggtccagcacgtgctctaatggctgatttatcaggacgtcatggacctggcacagctaactccatcttctgttcttggatggcaatgggaaacatcctaggatactcctctggttccacaaacaattggcacaagtggtttccattccttaaaacaagagcttgctgtgaagcttgtgcaaatttgaaaggtgcatttctggtggctgtgattttcctgtccctgtgcttggttataactctgatatttgccaaggaagttccattcaaaggaaatgcagccctcccaacaaaatcaaacgagccagctgagcctgaaggcactggtccactagcagtgttgaaaggcttcaggaacttacctactgggatgccttctgtgcttattgtgactggccttacctggttgtcttggttcccattcatcctctacgacactgactggatgggccgtgagatctaccacggtgacccaaagggaactgatcctcagatcgaggctttcaaccagggtgtcagggcaggtgcatttggcctgctactgaattcgattgtgctaggattcagctcattcttgattgaaccaatgtgccggaaagtcgggccaagggtggtgtgggtgacgagcaatttcctcgtctgcatcgccatggctgcaactgcactgatcagcttctggtcactcaaggacttccatggaactgttcagaaagccatcactgcagacaagagcatcaaggctgtctgcctcgtcctctttgcgtttcttggagtccctctcgccgttctgtacagtgttcccttcgcagtgacggcgcaattagcggccactagagggggtggccaagggctctgcaccggcgtcctcaacatctccatcgtcatccctcaggtggtcatcgcgctgggagccgggccgtgggacgagctgttcgggaaggggaacatcccggcgttcggcctcgcctcgggattcgcgctcatcggcggcgtcgccggaatattcctgctgcccaagatctccaagcgccagttctggtcggtcagcatgggcggcggtcactgaccgcccgctctcgccgccggctgcggcggcggcggcggccggagcagcgccgccggaagtggtgagctttgtagttctcgtttgcaatggatcaaaggagccccctctttttttttacatagggtaattaattaattaaggctgttaattaggaaggggtgaggtggccctgcagctggggcccacgctttgttgccacctcggtagaagagaataagcagatcatgcagataatatggaactgtaaaactgttttgtgttgtgtgtgtgtgcagtgtgcttggtaattagtgtgtaatgaatggtcaggagaagtgcagtgaactaagtgaaagtgagcttccatcatcatcatc

SEQ ID NO: 489 - DNA, 1713 bp, Oryza sativa
  CDS (85)..(1605)
cttcgatctcttgggatataactagcttagctatagctctagctaaataggttcgtacgtataggatatttgatccattgatcgatggccgtcgacatggagctcgacggcggtggcgacggcaagggcaaagccccgccgcagataagcctgtcggggctattccttgcgtgcatggtcgccggtggcgtgcagtacggctgggcgctgcagctctctctcctcaccccgtacgttcagacattgggaattcctcatgcactcacttcagttatgtggctctgtggccctattgctggcttaattgttcagccatgcgtcggcctgtacagtgacaagtgcacatccagccttggaagacgtagaccgttcatcctcactggatgcataatcatctgcatatctgtgatcgtcatcgggttctcctcggacatcggctacgctctcggcgacacgactgaggactgcaaggtttacaggggtcctcgttaccatgcagcggcggcattcatcctcggattctggctgctcgacttctccaacaacaccgtgcagggtccagctcgcgctctgatggccgatttgtcaggtcggcatggcccaagcgcggccaacgcgatcttctgttcttggatggcattaggcaacatccttggctactcctccggatccaccaatgactggcacaagtggtttccctttctcatgaccagggcttgctgcgaggcctgcgcgaatctcaaagcggccttcttggttgcagtggtgtttttggggttgtcgacggcggtgacgatggtgtttgcgagggaggtggcgctggacccagtggcggcggcgaagcggaacgagggtgaggcgtcggggctcctcgccgtgttcaaggggatgaagaacctccccgtcgggatgccgtcggtgcttatcgtcaccggcctcacctggctctcgtggttccccttcatcctcttcgacaccgactggatgggccgcgagatctaccatggccgcccggacggctcccccgccgaggtcaccgccttccaagagggtgtccgccaaggcgccttcggcctcctccttaactcgatcgtgctgggcatcagctcgttcctgatcgagccgatgtgccgtcggctgggcgcccgcgcggtgtgggtgatgagcagcgccgtcgtgtgcgtcgccatggcggccgtctccgtgctcagcgcgtggtcgctcggcgacttcggcggctcggtgcaggacgcagcgcgggcgccggcggaggagggcggcgtcagggcgtcggcgctggcgctcttcgtcttcctcggcctccccttcgccgtcctctgcagcgtcccgttcgccgtcacggcgcagctcgcggcgagccgcggcggcgggcagggcctctgcaccggcgtcctcaacatctccatcgtcgtgccgcagatggccatcgccctcggcgccgggccctgggacgagctgttcggggaggggaacatcccggcgttcgccatggcgtccgtgttcgccgccgcggccgccgccgccggcgtcgtcttgctgcccaaggtctccgtccgctccgtcagcatggccggcggccactgatcactactagtctatcaccctttttttttccgtggttttaaatctcccgctatagctgctgctatctccagttagagcgggtactatagcaggctataagccagctgt

SEQ ID NO: 490 - DNA, 1539 bp, Arabidopsis thaliana
  CDS (1)..(1536)
atggtcagccatccaatggagaaagctgcaaatggtgcgtctgcgttggaaacgcagacgggtgagttagatcagccggaacggcttcgtaagatcatatcggtgtcttccattgccgccggtgtacagttcggttgggctttacagttatctctgttgactccttacgtgcagctactcggaatcccacataaatgggcttctctgatttggctctgtggtccagtctccggtatgcttgttcagcctatcgtcggttaccacagtgaccgttgcacctcaagattcggccgtcgtcgtcccttcatcgtcgctggagctggtttagtcaccgttgctgttttccttatcggttacgctgccgatataggtcacagcatgggcgatcagcttgacaaaccgccgaaaacgcgagccatagcgatattcgctctcgggttttggattcttgacgtggctaacaacaccttacaaggaccctgcagagctttcttggctgatttatcagcagggaacgctaagaaaacgcgaaccgcaaacgcgtttttctcgtttttcatggcggttggaaacgttttgggttacgctgcgggatcttacagaaatctctacaaagttgtgcctttcacgatgactgagtcatgcgatctctactgcgcaaacctcaaaacgtgttttttcctatccataacgcttctcctcatagtcactttcgtatctctctgttacgtgaaggagaagccatggacgccagagccaacagccgatggaaaagcctccaacgttccgtttttcggaggaatcttcggagctttcaaggaactaaaaagacccatgtggatgcttcttatagtcactgcactaaactggatcgcttggttccctttccttctcttcgacactgattggatgggccgtgaggtgtacggaggaaactcagacgcaaccgcaaccgcagcctctaagaagctttacaacgacggagtcagagctggtgctttggggcttatgcttaacgctattgttcttggtttcatgtctcttggtgttgaatggattggtcggaaattgggaggagctaaaaggctttggggtattgttaacttcatcctcgccatttgcttggccatgacggttgtggttacgaaacaagctgagaatcaccgacgagatcacggcggcgctaaaacaggtccacctggtaacgtcacagctggtgctttaactctcttcgccatcctcggtatcccccaagccattacgtttagcattccttttgcactagcttccatattttcaaccaattccggtgccggccaaggactttccctaggtgttctgaatctagccattgtcgtccctcagatggtaatatctgtgggaggtggaccattcgacgaactattcggtggtggaaacattccagcatttgtgttaggagcgattgcggcagcggtaagtggtgtattggcgttgacggtgttgccttcaccgcctccggatgctcctgccttcaaagctactatgggatttcattga

SEQ ID NO: 491 - DNA, 1982 bp, Saccharomyces cerevisiae
  CDS (101)..(1879)
cggctataacataactatatataaaggctctacacccacgagcaatcgccttttcatttgtttcaattttcaaaaaaggaccgacacaaatcaatagataatgacaatttcgaataaatcgtggaggagctacttcccacatttgagaaaactacccgaagatgatcagtacttatactcagacgatactaactccagtatcatagctgaagaggagctacatcatagcgtagataagtcctcgaagacagacgttacggcagaaactacagctgtagaacctcatcctcacaatttaaggcatgacttgccatatgaagtgagagatgaagctgggcgtaaatggtggaaatattttgatgaattcgagtatcgtgttaataaggaatacaagaaatcacgtaagtggtacgagtttttgtatcctaatcatactactcaaaccaaggctgaaagacggcttctttacaagctagacattattattgctttatacttttttatgttatgttggtccaagtcagtggatttgaataactacactaacgcatatgtttccaatatgaaggaagatttaaacatgaaaggtaatgattacgtttacacttctactattgctaatgttggtgccattgtcttccaattaccatttatgtatttgttaccaagatttccctctcatattattttgcctgtaatggacttgggctggacttggttcacatttgcatgttatagggcaaactcactagccgaactaagggcttacagatttattttaagtgcctttggcgctgcttactacccagtgtcccaatatatactaggttgttggtatgccccagatgaaattaattcaagagtctgtttattcttttgtgggcaacaattgggttccgtgacttcaggacttctgcaaagtcgcatattcaaaagtttgaacggcgtccatggtctagcaggctggagatggatgtttctgatcgatgccattgcaatttctcttcccacggctattattggtttttttgttattcccggtgtaccatctaagtgttactctttatttctgactgacgaagaaatacgaattgcaagggccagaaataagaggaaccaaatcaaagatggtgttgataaaagtaagctagccccattatggagcagaaaactttggaagaaagtattttgtactccagcattctgggtacttgttgtttttgatacatgttcgtggaataacatgactgcgtatagtggttcatatactttgtggttaaagtctaatacaaagtactccattgcccaagtgaacaacctgagtgttatacccgcatgtttaggatttgcgtatgtgattttttgtgcctttggtgccgatttatttagatgtaagtggatattcatggtttttgctgctataatgaataccgtttcttgtgccttacttatcaagtgggatattccttcgaaagctaaatggtacgctttcttcaccacgtatttcagtgtggccgcatcgccttgtctatggtcgtttattaatgacttcttaaggtttgatcctcaggtgaaggctattacatggatcgccatttattccttctctcaatccacttacgcctggattcctaccttggcgtggcctaccgtggagtcaccacgttttaagactggttacaccgtgagcttaatttttggtgctatttacggtttatggacgtttgttgtactttttttttacaagagaaacgaaaagaaacatgctctaggtaatggtatcatcttgtatgatagtaataagggtgaagagcttccagaatttgtaaagaaaaatatggaggaaagagatggttactactatttaaagcggtcctcgtagtccaatttacgtgaagtagataggtatattacgctttagacaccatacctcaaataaatatattcatgtatataatttaatcatcttctatctataatta

SEQ ID NO: 492 - DNA, 1913 bp, Arabidopsis thaliana
  CDS (63)..(1592)
gtaatttagctttcacaacaaaaaaactcttttctttttgtctgctcgtttttcttttcataatgggagccttggaagcagaaagagccgccaacaatgccacggcgttagagacacagtcgtcaccggaagatctcagtcaaccatctcctctgcgtaagatcatctccgtcgcttcaatcgccgccggtgtacagttcgggtgggccttacagctttctcttctgactccttacatacaactcctcgggatccctcacaaatggtcgtcttacatgtggctttgtggtcctatctccggcatgattgttcaaccgatcgtcggttaccacagtgaccgatgcgagtccagattcggtcgccgtcgtcctttcattgccgccggagtcgcactcgtagccgtctcggttttccttatcggattcgcggcggatatgggacatagttttggagataaactcgagaacaaggtaaggactcgagccattataatcttcctaaccgggttttggttcctcgacgtggctaacaacaccttacaaggaccatgccgtgctttcttagccgatttagccgccggagacgctaaaaaaacgcgagtcgcaaacgcgtgtttctccttctttatggcggttggaaacgttttgggttacgctgctggatcttacactaaccttcacaaaatgtttcctttcacaatgacaaaagcttgcgacatctattgtgcgaatctcaagacttgtttcttcttatccatcactctcctccttatcgtcacattctcgtctctatggtacgttaaagacaaacaatggtctccacctcaaggagacaaggaggagaaaacatcaagtctttttttctttggagaaatctttggagctgttagacacatgaaacgtcccatggtgatgcttctaattgtcacggtcattaattggatcgcttggtttccatttattttgtatgataccgattggatgggtcgtgaagtgtacggtggaaactcagatggagatgaacgatcgaagaaactttacgaccaaggagttcaggctggtgcattgggattgatgtttaattctatacttcttggtttcgtgtcacttggtgttgaatcgattggtcggaaaatgggaggagctaaacgactatggggatgtgtgaatttcatactcgccataggtttggccatgacggttcttgttactaaatcggctgagcatcaccgggaaatcgccggtcctttagccggaccaagcagtggtattaaagccggagtatttagtctctttaccgttcttggtatcccattggccattacttacagtattccatttgcactagcgtccattttctcaaccaattccggtgccggccaaggactttcattaggcgttttaaatatagcaatatgtataccacaaatgatagtatcattctcaagtggaccattggacgctcaattcggcggtggaaacctaccttcatttgtggtcggagcaattgccgcggcgattagtggagtcttagcgttaaccgttttaccttcaccgcctccggacgcaccagccatgtcaggggctatgtgattccattagttaactagtttatatatatatatatatatatatatatatatatatatgaatttccatctaatacagtattgttgtgcaaaagtgaaacccccaaaaaatggataaagtgagaaaaataaaccttggtcgtctgtcttttactgttctttagttttttttttttttttacttttgttattgatgttagtcaatttgttttcgttttgtttggacgttaataaattctgtgtttgactaaaaaaaaaaaaaaaaaaaaaaaaaaaaaaaaaaaaaaaaaaaaaaaaaaaaaaaaaaaaaaaaaaaaaaaaaaaa

SEQ ID NO: 493 - DNA, 1113 bp, Oryza sativa
  CDS (1)..(1113)
atgtcgtcggcgacggacggcgcggcgtcgaggctcggcgtcgccggggctctggggatgtcggtcacgtcgtcggtggctattgtcatctgcaataagtaccttatcagcaccctgggcttcttcttcgcgacgacgctgacgagctggcacctgatggtgaccttctgcacgctgtacgtcgcgcagcggctgcggttcttcgaggcgaagccgatcgatgcgcagaccgtcatctccttcgggctgctcaatggtatctccattggcctcctcaacctttgccttggattcaactcagttggcttctaccagatgaccaagctggctatcataccattcaccatgctcttggaaaccatctttcttagcaagaagttcagccggagcatcaagatctccctcatggtcttgctccttggagtcggtatcgcgtcggtgaccgatctccagctcaatctcctcggctcgatcatcgccgtgctcaccatcgccgcgacgtgcgtcagccagattctgacgaaccaaatccagaggaggctgaaggtgtcgtcgacgcagctgctgtaccagtcgtcgccgtaccagtccgccgtgctgctcgtcaccggcccgttcgtcgacaagctcctcaccaaccgcgacgtcttcgccttcacctacaccttccaagtcgtggcgttcatcgtgctgtcctgctcgatcgcggtgtgcgtgaacttcagcacgttcctggtgatcgggacgacgtcgccggtgacgtaccaggtgctggggcacctcaagacgtgcctcatcctctccttcggctacgtcctcctcagggaccccttcaccttccgcaacgtcgccggcatcctcgtcgccatcttcgggatgggcctctactccttcttctccgtctccgagtcccgcgacaagaagctcgccgacggcccctcccctcctctccccatctcttcctcccagatggcggagatgaaggactcggagccgctgctgggcggcggcggcggcgcggcggcgaagagctcgccgtggaacgaggtgaaggggttgcagagcttcgacgaggtgccgaggacggcgaagagcgcgttcagccggccgtga

SEQ ID NO: 494 - DNA, 1071 bp, Oryza sativa
  CDS (1)..(1071)
atgggggtgacaggggagaagttccagctggggacggtgggggcgctcagcctctcggtggtgtcctcggtctccattgtcatctgcaacaaggccctcatgagctccctcggcttcaacttcgccactactttgacaagctggcatctcctcgttacattttgctctcttcacgtggcattatgtatgaagctctttgagcacaaaccttttgatgcaaggactgtcatgggatttggtgtgctcaatggcatttcaattggtcttctcaacttgagtctaggtttcaattctgttggtttctaccagatgacaaagctggcaattatcccctgcactgttatacttgagactcttttcttcaggaagaagtttagtcggaatatccagctctcccttagtgttctcctttttggtgttggagttgcaactgtgactgacctgcagcttaatgctgtgggatctgtcctgtctttgctcgcaatcattacaacctgcattgctcaaatcatgacaaacacaattcagaagaaattcaaggtatcttcaacacagctgctgtaccaatcatgcccataccaagcattgaccttgttcatcgtcggccctttccttgatgggtttttgactaaccaaaatgtctttgcttttgattacacatctcaagttgtgtttttcattgtgctgtcatgcttgatatcagtctcagtgaacttcagcacttttcttgtgatcgggaaaacctctcctgtaacttaccaagtgcttggccatctcaagacatgcttggttcttgcctttggttatgttttgcttcacgatccatttagctggagaaatatacttggaatcctcattgctgtgattgggatggtatcgtactcatacttctgcacaaaagaggctccaccaaaacccactgaagcctccccacaactcaaccaggtaaaagaaagcgaatcggaccccttgatctcggactctttgagcactgctgaaaatgggggcaacgcaggcgacgacgaggctctgaaggtacctatgtggagctccaagtactcaaaggcatga

SEQ ID NO: 495 - DNA, 1390 bp, Zea mays
  CDS (165)..(1184)
gcgctagctgcggcacggaaccagcgccattagaggccacaagcccgcaccacgcctccctcgttctcgcgcgcgcgcacgcatgcacgaggagctgctgcagagaagaggaggcctgtcgatttgattgaactttccaaattcagattcagaagctggccaagatgactgccggtttccagctcggcgtgatcgggtctctcacgctctccgtcgcgtcgtcggttgccattgtcatctgcaacaaagccctcatcagcaccctaggctttccattcgctacgactctgacaagctggcacctgatggtgaccttctgcaccctccacgtggcgcagcgcctgcgctttttcgagcccaaggcgatcgacgggcagacggtagttctgtttggcttgctcaacgggacctcgattggccttctgaaccttagtttagggttcaactccatcggattctaccagatgacgaagttggccataatacccttcacggtgctgttggagactatattcctgaagaaaagattcagtgagacgatcaagttttctctgctggtcttgctgctcggagttggcatcgcctcagttacggacctcaagttaaactgcctcgggtccgttctttccggcctcgccatcgccaccacttgtgtcggccaaattctcacgaatacgatacagaggaagctgaaggtctcgtcaacgcagctcctgtaccagtcagcgccttaccaagcagccattctgttcgccactggccccttcgtggaccatctcctcaccggccgcagcgtcttcgcccatagatacactttcccggttgtgggcttcatcgtcctgtcgtgcttgatcgcggtgtcggtgaacttcagcacgttcctggtgatcgggacgacgtcgccggtgacgtaccaggtgctgggccacctcaagacgtgcctggtgctgtcgttcgggtacacgctgctgcacgatcctttcaccgtgcggaacatcctgggcatcctcgtcgccatcttcgggatggcgctctactccatcttctcggtgcgtgagggcaagaagaagtccgcaggcgacgccctcccggtgtcacagatgcctgacaaggagacggagccgctgttggcgaccaaggacaacagcgacaccaaaaaggcgaacggggttgctcacgactgctaagatgttcccgtttgccgttgcttatagcctaattagtccagctctagtgttactacgacgcactgttctgaatctcagaaagtcagggaagaagtcattcctttttgtttcttataatattgtatatgtaatattcctctattgcgaattataagccgtttcaatttttttgaaaaaaaaaaaaaaaaaaaaaaaaaaaaaaa

SEQ ID NO: 496 - DNA, 1860 bp, Oryza sativa
  CDS (3)..(1736)
acatgtcggccaccacgtccaattcccggcggctatgcaacggccggggacaggtcatacctgggcccaccttaccagaggctgtcaagatgggcccacacgccattcggattgtagtcggagggctcggagaaggcgagctctcgaccgccactactgtacacggcccagagcgagcctcctcctcctctgcaccaccggagatggcttccgccgcgctgccggaggccgtcgcgccgaagaagaagggcaacgtccggttcgccttcgcctgcgccatcctcgcctccatgacctccatcctcctcggctacgatatcggggtgatgagcggggcgtcgctgtacatcaagaaggacttcaacatcagtgacgggaaggtggaggttctcatgggcatactgaacctctactcgctcatcggctccttcgcggcggggcggacgtcggactggatcggccggcggtacaccatcgtgttcgccgccgtcatattcttcgcgggggcgttcctcatggggttcgccgtcaactacgccatgctcatgttcggccgcttcgtggccggcatcggcgtgggctacgcgctcatgatcgcgccggtgtacaccgccgaggtgtcgccggcgtcggcgcgtggcttcctgacgtcgttcccggaggtgttcatcaacttcggcatcctgctcgggtacgtctcgaactatgctttctcccgcttgccgctgaacctcgggtggcgcatcatgctcggcatcggcgcggcgccgtccgtgctgctcgcgctcatggtgctcggcatgccggagtcgccgcggtggctggtcatgaagggacgcctcgcggacgccaaggtggtgctggagaagacctccgacacggcggaggaggccgcggagcgcctggccgacatcaaggccgccgccggcatccccgaggagctcgacggcgacgtggtgaccgtccccaagagagggagcggaaacgagaagcgggtgtggaaggagctcatcctgtccccgaccccggccatgcggcgcatcctgctgtcgggcatcggcatccacttcttccagcaggcgtcgggcatcgactccgtcgtgctctacagcccgcgcgtgttcaagagcgccggcatcaccgacgacaaacacctcctcggcaccacctgcgccgtcggtgtcaccaagacgctcttcatcctcgtggcgaccttcttcctcgaccgcgtcgggcggcggccgctgctgctgagcagcacgggcgggatgatcctctccctcatcggcctcggcgccgggctcaccgtcgtcggccagcaccccgacgccaagataccttgggccatcggcctaagcatcgcctccaccctcgcctacgtcgccttcttctccatcggccttggccccatcacgtgggtgtacagctcggagatcttcccgctccaggtgcgcgcgctgggctgctcgctcggcgtcgccgccaaccgcgtcaccagcggcgtcatctccatgaccttcctgtcgctgtccaaggccatcaccatcggcggcagcttcttcctctactccggcatcgccgcgctcgcctgggtgttcttctacacctacctcccggagacccgcggccggacgctggaggagatgagcaagctgttcggcgacacggccgccgcctcggaatcagacgagccagccaaggagaagaagaaggtggaaatggccgccactaactgatcaaactaaccgcaaaatcaccaaatcctaagggttttcttgcaaaaacgtgtgctgtactggctagctagcaagtagtagcagcaacgtgggaagattcgctgatccggcgttgctggagagc

SEQ ID NO: 497 - DNA, 1522 bp, Oryza sativa
  CDS (136)..(1311)
cccacgcgtccgcgtactacggaaacttgtacactatcaagctcagcaactgcctgcccctctctttccctcgccattaagttttctcgtccggcggcgtcacccctgcgaattaactaactagctaggccggccatggagacggtggccgcggccagctacacccgcggggcggcgacgcgctcgccagcgtgctgcgccgccatgtccttctcgcagtcctacaggcccaaggccgctagaccgccgagcacgttctacggcgagtcgctgcgggttaacacggcgaggtcgctgccgtctgggaggcagtccaaggcggcgagccgggcggcgctcagcacccggtgcgagatcggggacagcctggaggagttcctgaccaaggcgacgccggataagaacctcatcaggctgctcatctgcatgggggaggcgatgaggacgatctcgttcaaggtcaggacggcgtcgtgcggcggcaccgcctgcgtcaactccttcggtgacgagcagctcgccgtcgatatgctcgccgacaagctcctcttcgaggctctggaatactctcatgtctgcaagtatgcgtgctccgaggaagtcccggagctgcaagacatgggtggaccagtcgatggtggtttcagtgtagcattcgaccctcttgatgggtccagcattgtcgacacgaacttcacagttggaaccatatttggtgtctggcctggtgacaagctgacaggcgtcaccggtggagaccaagttgctgctgccatgggcatctatggccctcgcactacttacattatcgctctcaaagattgtcctggaactcatgaattccttcttcttgatgaaggaaaatggcagcatgtcaaggacaccacaaccattggagaggggaaaatgttctctcctggtaacctgagggctacatttgataatcctgaatatgacaagctcatcaactactatgtcaaggagaagtacacattgcgttacactggaggaatggttcctgatgtcaaccagatcatagttaaggagaagggcatcttcaccaacgtgacgtctccgacagccaaggccaagctgaggctcctgttcgaggtggcgccgttgggtttcttgatagagaaagccggcgggtacagcagcgacggcaaacagtcggtgctggacaaggtgatcaacaacctcgacgagcggactcaagtggcctacggttccaagaacgagatcatccggttcgaggagactctctacggctcgtcgaggctcaccgccggcgccaccgtgggcgccgccgcctaatcttttgctgcaacgcgagcccagtgtctctgcaggcctcaaaaacgctgaaactgcagtcgttttagactcccatcctgtaatgcagattgggttgtagttgaagtgggacttgaaactgcaaagttatactcctttttgcaaggtacccgtttttttccccttttggtgtaaacagttgcatataaaggtaaattcgcattaaaaa

SEQ ID NO: 498 - DNA, 1440 bp, Oryza sativa
  CDS (171)..(1187)
gtcagttcccgcgccgtgtgaccaatactcaacacttaaaccgcgcgctttttagccgacccgagcagccggagagtgaggcgaggcgaagcgaagggaagagcgcgaggcagagtaagcagacgagaagaacagcgcgcggcgcggtagctgaggagagtggtgcggagatggatcacgaggcggacgcgtaccggacggacctgatgacgatcacgcggtacgtgctgaacgagcagagccgcaacccggaggcacgcggcgacctcaccatcctcctctcccacatcgtgcttggctgcaagttcgtcgcctccgccgtcaacaaggccgggctcgccaagctcatcgggctggccggcgagaccaacgttcagggagaggagcagaagaagctggacgtgctgtccaacgaggtgttcgtcaaggctctcgtcagcagcggccgcacctgcgttcttgtctccgaggaggacgaggaagcgacgttcgtggaccctgcgctgcgtgggaagtattgcgtgtgctttgatccactcgacggctcctccaacatcgactgtggcgtctccatcggaacgatctttgggatctacatgatcaaagataaggagaatgtgactcttgaggacgtgttacagcctggaaaaaacatggttgctgctggatactgcatgtacggcagttcctgcacgcttgttctgagtactggaaatggtgtcaatggcttcacacttgatccatctctcggggagttcatattaactcatccagacatcaagataccaaagaaagggaagatttattcagtgaatgaagggaatgcgaaaaattgggacgagcctaccgcaaagtttgtggagaagtgcaagttccctaaggatggttcatcacctaaatccttgagatacattggaagtatggttgctgatgtccaccgtacgttgctatatggaggagtatttttgtaccctgcagacaagaagagcccaaatggaaaactccgtgttctgtatgaagttttccccatgtcattcctgatggagcaggctggaggccagtctttcacaggcaaagaacgggctcttgacctcgttcctaccaagattcacgagagatccccaatatttcttggaagcttcgaagatgtggaggagatcaaagggttgtacgctgcacaggcgaagtaagctcggtttgatcgatctggcaccatcaaggcgtgcgaatggactccctggccttactgtaacatgcatgattcgtcaggcacttcttttattcgtcttactgtacgtttgtaaaattcagtgtaatagtgttgaggcctggaacagcttcatgagcaactaaggccttttctactattatttacaaaatacatacaccgtgcatctctagcagctaaagcactaatacaacaagtcactaaggcaaaaa

SEQ ID NO: 499 - DNA, 1201 bp, Triticum sp.
  CDS (14)..(1192)
ttctagagcagcaatggagaccgtcgcggctgccggctacgcccgcggggccgccacgcgctccccggcgtgctgcgccgccatgtccttctcgcagtcctacaggcccaaggctgccaggccggcgacctcgttctacggcgagtcgctgcgggcgaacacggcgaggacgtcgttcccggcggggaggcagtccaaggcggcgagccgggcggcgctcaccacccggtgcgcgatcggcgacagcctggaggagttcttgaccaaggcgacgccggacaagaacctcatcaggctgctgatctgcatgggggaggcgatgaggacgatcgccttcaaggtccggaccgcgtcctgcggcggcacggcctgcgtcaactccttcggcgacgagcagctcgccgtcgacatgctcgccgacaagctcctcttcgaggcgttggagtactcccatgtgtgcaagtacgcgtgctctgaggaagtccccgagctgcaggacatgggtggcccggtcgaaggcggattcagtgtggcgttcgacccccttgacggctccagcatcgtggacaccaacttcaccgtgggaaccatcttcggcgtctggcccggcgacaagctgaccggcgtcaccggcggtgaccaggttgctgccgccatgggcatctacggccctcgcaccaccttcgtagttgccctcaaggactgccccgggacacacgaattccttctcctcgacgaaggtaaatggcagcatgtcaaggacaccacgagcatcggagaagggaagatgttctcccttggcaatctgagggccacgttcgacaaccctgattatgacaagcttgtcaactactatgtgaaggagaagtacactctgcgttacaccggaggaatggtccctgatgtcaaccagatcatcgtgaaggagaagggcatcttcacgaacgtgacgtcgccgacggcgaaggcgaagctgcggctgctgttcgaggtggcgccgctggggttcttgatagagaaggccggcgggcacagcagcgacggcaagcagtcggtgctggacaaggtgatctccgtcctggacgagcggacccaggtggcctacggctccaagaacgagatcatccgcttcgaggagaccctctacggctcctccagactcgccgccagcgccaccgtcggcgccaccgcctaataatct

SEQ ID NO: 500 - DNA, 1501 bp, Ralstonia eutropha
  CDS (80)..(1399)
tcgataagcttgatgtaattggaggaagatcaaaattttcaatccccattcttcgattgcttcaattgaagtttctccgatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgcctgaagtccaaaggatgaccctgacgcagttcctgatcgaggaacgccgccgctatccggatgccagcggcggcttcaacggcctgattctcaacgtcgccatggcctgcaaggaaatcgcgcgcgcggttgccttcggcgcgctggggggcttgcacggcaaggccagcaatcaagccggagaagcaggggccgtcaacgtgcagggcgaaatccagcagaagctggacgtgctgagcaataccaccttcctgcgcgtcaacgagtggggcgggtacctggccggcatggcgtcggaggagatggaggcgccttaccagatcccggatcactacccgcgcggcaagtacctgctggtgttcgatccgctcgacggctcatccaacatcgacgtcaatgtctcggtgggcagcatcttctcggtgctgcgcgcgcctgagggcgcaagcgccgtcaccgagcaggatttcctgcagcccggcagcgcccaggtggcggccggctacgcgctctacggtcccaccaccatgctggtgctgaccgtgggcaatggcgtcaacggcttcacgctcgatcccaacctgggcgagttcttcctcacgcaccccaacctgcaggtgccggccgatacccaggaatttgccatcaatgcgtcgaacagccgcttctgggaagcgccggtgcagcgctacatcgccgagtgcatggccggcaagagcgggccgcgcggcaaggatttcaatatgcgctggatcgcgtcgatggtggccgaggcgcaccgcatcctgatgcgtggcggcgtcttcatgtacccgcgcgactccaaggatcccgccaagccgggccgcctgcgcctgctgtacgaggccaatccgatcgccttcctgatggagcaggctggcgggcgcgccagcacgggccggcagacgctgatgtcggtggcgccgggtgcgctgcaccagcgcattggcgtgatcttcggctcgcgcaatgaagtggaacggatcgagggctaccacaccgaccagaccgatcccgaccttccgagtcccctgttcaacgagcgcagcctgttccgcgcgtctgcctgaggtgcctggcaagggcgaattccagcacactggcggccgttactagtggatccaattcccgatcgttcaaacatttggcaataaagtttcttaagattg

SEQ ID NO: 501 - DNA, 1301 bp, Chlorella sorokiniana
  CDS (90)..(1238)
gtgacgaccacaaaagaattccctctatataagaaggcattcattcccatttgaaggatcatcagatactgaaccaatccttctagacgatgcaggccaccgctgtcgccaccgccgcccctgcggcccgcgtcgccaccactggcaaggccgccaccggcgtcaaggccgccccccgcgtggccgtgcgcgccgccggcgccagcgccagcagcagctttgccaccggcgcccgcctgagcgccaaggccagccgcaccgccgcccgccgcgccgccgtggccgcccaggccaagatcggcgacacgctggaggagttcctgctggaggccacccccgaccccaagctgcgccagctcatgatgtccatgtccgaggccatccgcaccatcgcctacaaggtgcgcaccgcctcgtccggcggcaccgcctccgtcaactcgttcggcgatgagcagctggccgtcgacctgctggccgacaagctgctgttcgaggccctcaagtactctggctgctgcaagctggcgtgctctgaggaggtgcctgagcccctggacctgggcggcgagggcttctccgtggcatttgaccccctggacggctcctccatcgtggacaccaacttctctgtgggcaccatctttggcgtgtggcccggcgacaagctgaccggcatcacgggccgccagcaggccgccgccggcatgggcatctacggcccccgcaccgtcttctgcatcgccctcaaggacgcccccggctgccacgagttcctgctgcaggacgatggcaagtggctgcacgtgaaggagaccgagaccatcggcgagggcaagatgttctcccccggcaacctgcgcgccacctttgacaaccccgcgtacgagaagctgatcgcctactacatcggcgagaagtacacgctgcgctacaccggcggcatggtgcccgacgtgttccagatcatcgtgaaggagaagggcgtgttcaccaacgtcatctccccctccaccaaggccaagctgcgcctgctgttcgaggtggcgcccctggccctgctggttgagaaggcaggcggcgcctcctcctgcgacggcctgtgcgtgagcggcctggacgtggaggtcaagcagcacgaccagcgcacccagatctgctatggctccaagggcgaggtgcggcggtttgaggagtacatgtacggcaactccccccgcttctccgaggtcaccgcctaagcggctggtcatcgcctgagcggctcagtgctgctgactatgcagccggcggctgactat

SEQ ID NO: 502 - DNA, 1101 bp, Nitrosomonas europaea
  CDS (94)..(1095)
gggagaggatatttagctctttttttcatacgctcgttatggttgccaaaccagtataattgacgcttttttaatttctcgagaggaaagctgatgcataccggtactacccttacccagttcatcattgaagagcagcgtcacatcgcgggagcgagcggtgatttcaccgcattgctgaacgatatcgtgactgctatcaagaccatttccaatgcggtgaacaagggggcgctgattggtgtgatgggggcgctggatacagaaaacgttcagggtgaaacccaaaaaaagctggatgtgattaccaatgaaatcatgatccgcaacaatgaatgggctggtcatctttctggcatggcatcggaggaaatggatgatgtctactcgattccgtctccttatccactcggcaaatatctgctggtatttgacccgctggatggttccagtaacgtggatctcaatatttccgtcgggacgattttttcgattttgcgctcgccagtgccaagccgggctgccagtatggaagatttcctgcaacccggcgtcaaacaggtttgtgcaggttatgcattgtatggttcatccaccatgttggtgctgaccacaggccatggtgtcaatggttttacgctggatcgtgatatcggtgaattcgtgctgacacatccaaacatgaggattcccgccgataccagggaatttgccatcaatgcctccaaccagcgtttctgggaagcaccggtacagcgttatgtggcggagtgtctggcaggaagtaccgggccgcgcggtcgcgatttcaatatgcgttgggtggcttcgatggtggcagaggtgcatcgtatcctcactcgcggtggtattttcatgtatccgcgcgataccaaagatccctccaaacccggcagactgcgtctgatgtacgaagccaatccgatgagttttatcgtcgaacaggcaggcgggttatccaccaccggctacgagcgcattctggatgtcgtgccgcaggatctgcatcagcgtgtaccggtgattctgggctcgaagaacgaggtcgaggtggttctggagtatcacaatgcctgatgc

SEQ ID NO: 503 - DNA, 1038 bp, Nostoc PCC7120
  CDS (1)..(1035)
atggaaaatacacttggattagagattattgaggtagttgagcaagccgcgatcgcatccgcaaagtggatgggtaagggcgaaaagaatactgctgaccaagtagcagtagaagcaatgcgcgagcgcatgaataaaatttatatgcgcggtcgcatcgtaattggggaaggggaacgtgatgacgcgcccatgttgtatatcggggaagaagttggtatttgtacccaaccaaatgctgaccaattatgtaaccccgatgaattagtagaaattgatatcgctgttgacccctgcgaaggtacaaacctcgtagcttatggtcaacccggctcaatggcagttctggctatttccgagaaaggtggattattcgctgcgcctgacttctacatgaagaaattagccgcacctccagccgctaaaggcaaagtagacattaacaagtcagctacggaaaacctcaagattctttccgagtgtctagaccgttctattgacgaacttgtagtagtcgtcatgaaacgcgatcgccaccaaggtttaatcaaagaaatccgcgacgctggcgcaagagtacaactgatttctgatggtgatgtaggcgcagcaatatcttgtggttttgcggggactaacgttcatgcgctcatgggtattggtgctgcacctgaaggtgtcatttccgcagccgctatgcgtgctttgggcggacacttccaaggtcaattgatatacgatccagaagtagtgaaaacaggcttgattggggaaagcaaacaagcaaaccttgaccgtctcagctctatgggtatcaatgaccctgataaggtttacgatgctcatgaactagcatcaggtgaaaatgttctcttcgccggttgcggtatcacctctggtaatctcatgcaaggtgtacgcttcttccacggcggtgctagaactcaaagcttggttatttccagccagtcacaaactgctcgttttgtggacacaattcacatggctggacagcccaagactgtgcaactgcactag

SEQ ID NO: 504 - DNA, 1038 bp, Nostoc punctiforme PCC 73102
  CDS (1)..(1035)
atggaaaatacacttgggttagagattattgaagtagtagagcaagccgcgatcgcatccgcaaagtggatgggtaaaggcgaaaaaaacatcgctgaccaagtagctgtggaagctatgcgggagcggatgaataaaatctatatgcgcggtcgcattgtgattggagaaggcgaacgtgacgatgcgcctatgttatacatcggggaagaagttggtatttgtactcaaccaaatgccgaagctctctgtaaccctgatgaattaattgaaattgatatcgccgttgacccctgtgaaggtacgaacttggtagcttatgggcaacctggttcgatggctgtcttggcaatttctgaaaagggtggattatttgctgctcctgacttttacatgaagaagttagcagcacctcccgcagctaagggcaaggtagacatcaacaagtcagcaacagaaaacctcaagattctctctgagtgtctagagcgctctattgaagaactcgtaatcgtggtcatgaagcgcgaacgccacaacgatttaattaaagaaatccgtgaggctggagcgagagtcgccctaatttcagatggtgacgtaggtgcagctataagctgcggttttgctggaactaatatccacgcgttgatgggtattggtgcggctcctgaaggcgtaatctcggcagcagcaatgcgtgctttgggtggacacttccaaggtcaactgatttacgatccagcaatagtaaaaacgggtctgattggagaaagcagagaagccaacatcgatcgcttaaagtctatgaatatcaatgaccctgataaggtctatgatgctcatgaattggcatctggtgaaactgttctgttcgctgctagcggcattacgagtggtaatctgatgaatggtgtacgtttcttcaacggcggagctagaactcaaagcttggtaatttccaaccagtcgaaaactgctcgatttgttgacacaattcacatgtttggtgaacccaagactctccaactgaactaa

SEQ ID NO: 505 - DNA, 3150 bp, Saccharomyces cerevisiae
  CDS (1695)..(2894)
tgcacgtttatctatctatgttgcctccaaagggttattctctcaaaaagctcaatcactgtggaaccgaaaaataatgttatgaagattttttgagcagtatgtcttgtcaaaagctcaactagtgcagctgatgttgcttaaaaaaataaaaaccaaatttttctactttgctcttgtacgttgcacaaagaagattatgtaacaaacttgaagggactctcaaaaacttgctataaattgtacaaaagcctcaatatcacctagtagtggttctatacctgtctcgagccatcgccaaatagttgataaatttgattaatttctgcccttattcgcacgtgccataacacctgtacctctcacgctaaagacctttataatcaaggaaacttgttgctgcagaggaaataggaggtaatgaattgtgataaggcacatcacatcaatttttcttgcattcttgcatagaaagataggctgatgcaattagcgcgtttcaatcgcgtgccaaagacgtatatactaagcaatataaccgaattgattaagtagttggttaattgtatattttgtgataaagatggttaactgacttaggcggacataatagtagaaaatctatataatttttcccatgcagttgttattacaaaatgcaattcttgagatagcacaagcaagaataatagggcacggtacgttcattccacgtagcgttagctagtgctgccacaaggtaaacgtacgattatattcatttttgaaacggaagttctttgtaaccctcatgctcgtttgatagtcacttaactacaagatattctcgttcagtgattgcttgcttataaatcaggaaacttcatttttattccttacattttcgaaaagcccgcaaggttttcttcgccacgctcaagcattcatcgttgaaaagcaaaactgtgcacactgtaccttaggcgactcttctccgaacaagctcatggctcatttttaaaatcacaagcttcgtataattgccaagacataatctaattgagaaggtcagacggcaaaacaaatgaccgaaatcttcgtttattggttcgcctgcgttgccaactggtacattttcccagagtaccagcaaaggaaggcatccttgatgcctactctgatactgtggaggatttaaactgaaaatgatagtctgcgcggcaaatctttctatttctactaaagttggatcctccggccgatataacgtattctttttatccaataatgtcaattttaaatgctcgattactaatcgttactaaaatagcggacgcgcttatgcgtcttcgacggatagttttcagatcatccctctcagaaagcaatgcaggaaccgcctgtaaaactatcttttgctggcactcacacattatggtattgatgccacctgaaaatacggaaattaaccattccttgtacggagatctaagagcaactattattgaattgttgccgttaaagtttcatttcagttccgtgtgtggtcaagtacaagactactgatgaaatatgttgtacacacacggaaatatatatatatatatatatataacaatattgtgggttgaggtggagacttgatttttcttatacagtatattcttgttcattttttaccattttcaacaaaccacacaaagactttattcattatgctagccgaaaaaacccgttccataatcaaagcaaccgttcctgttttggaacagcagggcactgtcatcacgcgtacattctacaaaaatatgcttactgaacacaccgaattacttaatatttttaacagaactaatcaaaaggttggcgcacaaccaaatgccttggccactactgttttggcagcggctaagaacattgacgatttgtctgtgcttatggaccatgtcaagcaaattggccacaagcatcgtgccttgcaaattaaacctgagcattatccaatcgttggtgagtacttgttaaaagcaatcaaggaagttttaggcgatgctgcgactccagagataattaatgcatggggcgaggcttaccaagcaattgctgacatcttcatcactgttgaaaaaaaaatgtacgaagaagctttatggccaggttggaaaccatttgacattactgccaaagagtacgttgcttcagatattgttgaatttactgttaagccaaagttcggttctggtattgaattggaaagcttgccaatcactccaggtcagtatattacggtaaacactcacccaattagacaggaaaaccaatacgacgctttaagacactactctctttgttctgcttcaactaaaaatggtttacgatttgcagtaaagatggaagctgccagagaaaattttcctgcaggattagtctctgaatatttacacaaggacgctaaagttggtgatgaaattaagcttagtgctccggctggtgatttcgcaataaataaagagttgatacaccaaaacgaagttccattggtgttactatcgtctggtgttggtgttacaccacttttagctatgttagaagaacaagtcaaatgcaacccaaataggccaatttactggattcaatcttcctatgatgaaaagactcaagcattcaaaaaacatgtagatgaactattagctgaatgtgcgaatgtcgacaaaataattgttcatactgatactgaaccactgattaatgctgcattcttgaaggaaaagtcacctgcgcatgccgatgtctacacttgcggctctttagcttttatgcaagctatgattggtcatctaaaagaactagagcatcgtgatgatatgattcactatgaaccatttggtccaaagatgtcaaccgtgcaagtttaggcgttaagcctcggaaacttcaattttattactgattcatttgataatttcacttgttcgatttcacagtttgagaagttatattacgaaataagaaaaatttttaaaacatgagaccattgctaatcttttgttgttatactgtgttagaaatcctcgtgaaatccttgtgaaatcctatgtggaatatttagatagtaagtaaagattgtgtatgtatttataagatgaataagcgccaggtgctaaacagagt

SEQ ID NO: 506 - DNA, 1709 bp, Glycine max
  CDS (45)..(1607)
gcctcacaaaagcaaagatcaaacaaaccaaggacgagaacacgatgttgcttgaacttgcacttggtttattggttttggctctgtttctgcacttgcgtcccacacccactgcaaaatcaaaagcacttcgccatctcccaaacccaccaagcccaaagcctcgtcttcccttcataggacaccttcatctcttaaaagacaaacttctccactacgcactcatcgacctctccaaaaaacatggtcccttattctctctctactttggctccatgccaaccgttgttgcctccacaccagaattgttcaagctcttcctccaaacgcacgaggcaacttccttcaacacaaggttccaaacctcagccataagacgcctcacctatgatagctcagtggccatggttcccttcggaccttactggaagttcgtgaggaagctcatcatgaacgaccttctcaacgccaccactgtaaacaagttgaggcctttgaggacccaacagatccgcaagttccttagggttatggcccaaggcgcagaggcacagaagccccttgacttgaccgaggagcttctgaaatggaccaacagcaccatctccatgatgatgctcggcgaggctgaggagatcagagacatcgctcgcgaggttcttaagatctttggcgaatacagcctcactgacttcatctggccattgaagcatctcaaggttggaaagtatgagaagaggatcgacgacatcttgaacaagttcgaccctgtcgttgaaagggtcatcaagaagcgccgtgagatcgtgaggaggagaaagaacggagaggttgttgagggtgaggtcagcggggttttccttgacactttgcttgaattcgctgaggatgagaccatggagatcaaaatcaccaaggaccacatcaagggtcttgttgtcgactttttctcggcaggaacagactccacagcggtggcaacagagtgggcattggcagaactcatcaacaatcctaaggtgttggaaaaggctcgtgaggaggtctacagtgttgtgggaaaggacagacttgtggacgaagttgacactcaaaaccttccttacattagagcaatcgtgaaggagacattccgcatgcacccgccactcccagtggtcaaaagaaagtgcacagaagagtgtgagattaatggatatgtgatcccagagggagcattgattctcttcaatgtatggcaagtaggaagagaccccaaatactgggacagaccatcggagttccgtcctgagaggttcctagagacaggggctgaaggggaagcagggcctcttgatcttaggggacaacattttcaacttctcccatttgggtctgggaggagaatgtgccctggagtcaatctggctacttcgggaatggcaacacttcttgcatctcttattcagtgcttcgacttgcaagtgctgggtccacaaggacagatattgaagggtggtgacgccaaagttagcatggaagagagagccggcctcactgttccaagggcacatagtcttgtctgtgttccacttgcaaggatcggcgttgcatctaaactcctttcttaattaagatcatcgtcatcatcatcatatgtaatatttactttttgtgtgttgataatcatcatttcaataaggtctcattcatctaaaaaaaaataaaaa

SEQ ID NO: 507 - DNA, 1485 bp, Glycine max
  CDS (52)..(1059)
attcggctcgagaacatttttgatcttccttcctctgaaacaagaaccaaaatggagaattcgaccgaagaatcccatctccgatcggaaaactccgtcacttacgagtccccttaccctatctacggcatgtcattctccccctcccacccccaccgcctcgccctcggcagcttcatcgaagaatacaacaaccgcgtcgacatcctctctttccaccctgacaccctttcggtaactccccacccttctctctccttcgaccacccttaccctcccaccaaactcatgttccacccccgcaaaccctccccttcctcttcctccgacctcctcgccacctccggcgactacctccgcctctgggagatccgtgataactccgtggatgccgtctccctcttcaacaacagcaagaccagcgagttctgcgcccccttaacctctttcgactggaacgacatcgaccccaaccgcatcgccacctccagcatcgacaccacctgcaccatctgggacatcgaacgcaccctcgtcgaaacccaactcatcgctcacgacaaggaggtttacgacatcgcctggggagaggccagagtcttcgcctccgtctccgccgacggctccgttagaatcttcgaccttcgcgacaaggagcactccaccatcatctacgagagcccccaccctgacacccctttgctccgcttggcttggaacaaacaggacctgaggtacatggccaccattttaatggacagtaataaagttgtgattttggatattaggtctcccactacccctgttgcggagttagagaggcaccgtgggagtgtgaacgccattgcttgggctcctcatagctccacgcatatttgttctgctggtgatgatactcaggctcttatttgggaattgcccacgcttgcttctcccactgggattgatcccgtctgcatgtactctgctggctgtgaaattaaccagctgcagtggtccgccgcccagcccgattggattgccattgcttttgccaacaagatgcagcttttgaaggtttgaggtcagaacaaacaattacacattctagccacttcattgtggcatagacatagcaacttctgatcacttgagtgactgagttatatatattattgtagttgtgcaaactagtttgccctcctcatgttttacttgtggcgaaattaacgatgttcaatttgtctgttaaagatggatttttaacctgttgtgaagtaagatttcttgtctgtgatgtggaagccatagctattagtttcttagttaacatgagaaatcacatgtagtatgtggaatcaattaccacacatccagattataggtcgtaaaatcttcagtgtttgtattcccatttgattttaaacaccctacctctgatatgtatggactatggatctgtattcttgagcttttgccataaaaaaaaaaaaaaaaaaaaaaagg

SEQ ID NO: 508 - DNA, 1253 bp, Gossypium hirsutum
  CDS (19)..(1056)
agggagtggcagtggaagatggccgctagcagcgatcctaacccggagggttccgatgagcagcagaaacgatccgagatatacacttacgaggccccttggcatatctacgccatgaactggagtgtccgccgcgacaagaaataccgtctcgccatcgccagcttgctcgagcattacaacaaccgccttgagattgtccagctcgatgactccaatggcgagatccgatcggacccaaatctctccttcgatcatccttatcccccgaccaagaccatcttcatccccgacaaggagtgccagaaacccgaccttctcgccacgtcctccgacttcctccgcatttggcgcatctccgatgaccactcccgcgtcgacctcaagtctctccttaatggcaataagaacagtgaattctgcggtcctcttacctccttcgactggaatgaggcggagcccaagcgaatcggcacctcctccattgatacgacttgtactatatgggatatcgagagggagacggtggatacccagcttatcgcccacgataaggaggtttatgatattgcctggggcggcgtcggtgtttttgcttccgtctctgctgatgggtccgttagggttttcgacctgcgcgacaaggagcactccactatcatttatgaaagttcggagcccgatactccgcttgtacggttggggtggaacaagcaggacccgagatatatggctactataattatggacagtgctaaggttgttgttttggatatccgcttcccgacactgccggtagttgagctgcagaggcaccaggctagcgtcaatgccatcgcatgggcaccccacagctcttgccacatttgcaccgccggggatgattcccaggccttgatttgggacttgtcctccatgagtcagcctgtggagggtgggcttgaccccatccttgcctacaccgctggggctgaaatcgagcagttacagtggtcatcttcccagcctgattgggttgccatcgccttctccaccaagcttcagattctcagggtatgagtgaatgggattggtatattgggtcgtattcaatgctaaattgctaattcatagtctagtaattgtactcagatctagaggaataacaagattgttgctgtcgttgtgtctgagctgactaaaagtcccaaaactgttttggttttcctgttgtttcgtttgtcttcaacatgtttggatagttgattgaaaaa

SEQ ID NO: 509 - DNA, 2054 bp, Escherichia coli
  CDS (293)..(1483)
ggcctttataggcggtcctgttggacaacggcgaacagtataaccgaatcattgtgcgataacaggtcttgacaaaggaatttacgcaaacgattaccttcaggctacgcaaggctttggagaataaagagcttgcaaccggaaacggatttcttttcaggtttgtgatgcaaatttttcacttcatcacattctttctgaaaaacaccaaagaaccatttacattgcagggctattttttataagatgcatttgagatacatcaattaagatgcaaaaaaaggaagaccatatgcttgacgctcaaaccatcgctacagtaaaagccaccatccctttactggtggaaacggggccaaagttaaccgcccatttctacgaccgtatgtttactcataacccagaactcaaagaaatttttaacatgagtaaccagcgtaatggcgatcaacgtgaagccctgtttaacgctattgccgcctacgccagtaatattgaaaacctgcctgcgctgctgccagcggtagaaaaaatcgcgcagaagcacaccagcttccagatcaaaccggaacagtacaacatcgtcggtgaacacctgttggcaacgctggacgaaatgttcagcccggggcaggaagtgctggacgcgtggggtaaagcctatggtgtactggctaatgtatttatcaatcgcgaggcggaaatctataacgaaaacgccagcaaagccggtggttgggaaggtactcgcgatttccgcattgtggctaaaacaccgcgcagcgcgcttatcaccagcttcgaactggagccggtcgacggtggcgcagtggcagaataccgtccggggcaatatctcggcgtctggctgaagccggaaggtttcccacatcaggaaattcgtcagtactctttgactcgcaaaccggatggcaaaggctatcgtattgcggtgaaacgcgaagagggtgggcaggtatccaactggttgcacaatcacgccaatgttggcgatgtcgtgaaactggtcgctccggcaggtgatttctttatggctgtcgcagatgacacaccagtgacgttaatctctgccggtgttggtcaaacgccaatgctggcaatgctcgacacgctggcaaaagcaggccacacagcacaagtgaactggttccatgcggcagaaaatggcgatgttcacgcctttgccgatgaagttaaggaactggggcagtcactgccgcgctttaccgcgcacacctggtatcgtcagccgagcgaagccgatcgcgctaaaggtcagtttgatagcgaaggtctgatggatttgagcaaactggaaggtgcgttcagcgatccgacaatgcagttctatctctgcggcccggttggcttcatgcagtttaccgcgaaacagttagtggatctgggcgtgaagcaggaaaacattcattacgaatgctttggcccgcataaggtgctgtaatttgatgttgccggatggaaacatccggcaacccttgacgcggtttaaattgccgcgtcgtcctcttcaccggtacggatgcgaatgacccgtgccacgtcaaagacgaagattttaccgtcaccgattttgccggtttgcgccgtgcgaataatggtatcgacacaggtatcgacaatgtcgtccggtacgacaatctcaattttcactttcggcagaaaatccaccatatactccgcgccgcggtacagctcggtatggcctttctggcgaccaaagcctttcacttcggtcaccgtcatgccggtaataccgacttcggccagtgcttcgcggacatcgtccagcttgaagggttttataatcgcatcaatctttttcatgctattccttgaaaaggtcgcctgtcttttgatctgctaaacgtaacacataacgccaattcattccttgaaatcgtttgcatccagctcgtgtcgggaaagcagtttataaaattctgtccggttgcgccccgccattctcgccgcgtgggtgacgttgcctttggtgatttgcagcagcttacgca

SEQ ID NO: 510 - DNA, 1361 bp, Saccharomyces cerevisiae
  CDS (101)..(1258)
gtgtgcttataccagcttgagaaagtactgacccttgaatcgttaagtttacttctacaaaatctccaagtaaagaaggaatataagtaatataagtacaatgtccgccgctactgttggtaaacctattaagtgcattgctgctgttgcgtatgatgcgaagaaaccattaagtgttgaagaaatcacggtagacgccccaaaagcgcacgaagtacgtatcaaaattgaatatactgctgtatgccacactgatgcgtacactttatcaggctctgatccagaaggacttttcccttgcgttctgggccacgaaggagccggtatcgtagaatctgtaggcgatgatgtcataacagttaagcctggtgatcatgttattgctttgtacactgctgagtgtggcaaatgtaagttctgtacttccggtaaaaccaacttatgtggtgctgttagagctactcaagggaaaggtgtaatgcctgatgggaccacaagatttcataatgcgaaaggtgaagatatataccatttcatgggttgctctactttttccgaatatactgtggtggcagatgtctctgtggttgccatcgatccaaaagctcccttggatgctgcctgtttactgggttgtggtgttactactggttttggggcggctcttaagacagctaatgtgcaaaaaggcgataccgttgcagtatttggctgcgggactgtaggactctccgttatccaaggtgcaaagttaaggggcgcttccaagatcattgccattgacattaacaataagaaaaaacaatattgttctcaatttggtgccacggattttgttaatcccaaggaagatttggccaaagatcaaactatcgttgaaaagttaattgaaatgactgatgggggtctggattttacttttgactgtactggtaataccaaaattatgagagatgctttggaagcctgtcataaaggttggggtcaatctattatcattggtgtggctgccgctggtgaagaaatttctacaaggccgttccagctggtcactggtagagtgtggaaaggctctgcttttggtggcatcaaaggtagatctgaaatgggcggtttaattaaagactatcaaaaaggtgccttaaaagtcgaagaatttatcactcacaggagaccattcaaagaaatcaatcaagcctttgaagatttgcataacggtgattgcttaagaaccgtcttgaagtctgatgaaataaaataggagtacttaattaaactaagtaagcatgactcaaattttctggaatactttgaaaatcaacgtcctacattctatcaaatatcatatatatgcgcacaat

SEQ ID NO: 511 - DNA, 1110 bp, Escherichia coli
  CDS (1)..(1110)
atgaaatcacgtgctgccgttgcatttgctcccggtaaaccgctggaaatcgttgaaattgacgttgcaccaccgaaaaaaggtgaagtgctaattaaagtcacccataccggcgtttgccataccgacgcatttaccctctccggcgatgacccggaaggtgtattcccggtggttctcggtcacgaaggggccggcgttgtggttgaagtcggtgaaggcgtaaccagcgtcaaacctggcgaccatgtgatcccgctttacaccgcggagtgcggcgagtgtgagttctgtcgttctggcaaaactaacctctgtgttgcggttcgcgaaacccagggtaaaggcctgatgccagacggcaccacccgtttttcttacaacgggcagccgctttatcactacatggggtgctctacattcagtgaatacaccgtagtcgcggaagtgtctctggcaaaaattaatccagaagcaaaccatgaacacgtctgcctgctgggctgtggcgtgaccaccggtattggcgcggtacacaacacagctaaagtccagccaggtgattctgttgccgtgtttggtcttggcgcgattggtctggcagtggttcagggcgcgcgtcaggcgaaagcgggtcggattatcgctatcgataccaacccgaagaaattcgatctggcgcgtcgcttcggtgctaccgactgcattaacccgaatgactacgacaaaccgataaaagatgtcctgttggatatcaacaaatggggtatcgaccatacctttgaatgcatcggtaacgtcaacgtgatgcgtgcggcgctggaaagtgcgcaccgcggctggggtcagtcggtgatcatcggggtcgcggttgccggtcaggaaatctccacccgtccattccagttggtcactggtcgcgtatggaaaggttccgcgtttggcggcgtgaaaggtcgttcccagttaccgggcatggttgaagatgcgatgaaaggtgatatcgatctggaaccgtttgtcacgcataccatgagcctggatgaaattaatgacgccttcgacctgatgcatgaaggcaaatccattcgaaccgtaattcgttactga

SEQ ID NO: 512 - DNA, 1110 bp, Nostoc PCC7120
  CDS (1)..(1110)
atggaagtgaaagcagcaatagcttacggcgcgggtaagccgttgacaattgaaaccgttcaactagaggggccaaaagctggggaagtattggttgaagttaaagccagtggcgtttgccataccgatgcttacaccctttcaggaaatgatcccgaaggtttgttccccgccattttaggacatgagggtgcgggggtagtagtagatgtgggcgctggtgttaccagtgtcaaaccaggggatcatgtgattcctctctacaccccagaatgtcgccaatgtgcctattgtttaagctttaagactaatctgtgtcaagctattcgtggtactcaaggacgtggtgtgatgcccgatgggactagtcgttttagtatcaatgggcagatgattcatcactatatgggtacatctacgtttgctaactacacagtgttaccggaaattgctgtagccaaaattcgagaagatgccccatttgacaaggtttgttacattgggtgcggtgtaacgacaggtattggtgcagtcatttatacagccaaggtggaagcaggggcaaatgtcgtcgtttttggcttggggggtattggtttaaacgtcatccaaggggcgcggatggtgggtgcgaatatgattgtcggcgtagatattaatcccagcaaacgcgccttggctgaaaaatttgggatgacacattttgttaatccccaagaagttgagggtgatttagttgcttatttggtggacttaacgaaaggcggcgctgattacagttttgaatgtattggtaacgtcaatgtgatgcgccaagccttagaatgctgtcataagggttggggtgtgagtgtaattattggtgtagctggtgcaggacaagaaattagtactcgtccctttcaattagtgactgggcgtgtgtggaaaggttctgcttttggtggcgctagagggcgtacagatgtgccgaaaattgttgattggtatatggatggaaagataaatattgatgatttaattactcatgtgatgccaattgaaaaaattaatgatgctatggatttgatgcacagaggtgaatcgattcgcagtgtggtgactttttaa

SEQ ID NO: 513 - DNA, 4027 bp, Oryza sativa
  CDS (204)..(243), (391)..(527), (1160)..(1206), (1296)..(1621), (1946)..(2028), (2107)..(2182), (2805)..(2962), (3285)..(3446), (3541)..(3657)
ctaataatttggaaatgcgatattccaatatccaaagtggacccggcccaattaacccaaccaaaacccacgcccactcctctccccttctcggcgtgctcttctccccctccctatcctctcctctcacctcgcaatcacatcctcttcccttctcttgtccatcgcatctaccaccgagcgtgcaaggagggggggtgaaaatggcttcctcgacccagggccaggtcatcacctgcaaaggtaacctcttggttcccctctcttagtatcgtggattcgtggtggtagatttgctagtgtgctagagttggatgtatggttgctgtttcttggagtgttcttggtttgatctggagtgggggatcccccggtgtggtggtggtgcagcggcggtggcatgggaggccaacaagccgatgacgatcgaggacgtgcaggtggcgccgccgcaggccggcgaggtccgtgtcaagatcctcttcaccgcgttctgccacaccgaccactacacctggagcggcaaggtttctctctctctgtcccaccgactcttactcgccgtgtttcttcgaaatctagatttctcgaactcgccatttacactggtagtagggtagtatactctttccaaccacgtatctggtgatggtagttggtgaccgcactggatggaacccgattcatttttttgtttaattagtggattagtatttaattgtcaagtaacatcgttatgttattgtttcaaggatttaggtgtttcttcagattattatgaatgggaagattaaacaattttgtactagaggactctgggtttcttctaggcttctagctagcgttgcatgagttcgtcctatatttttatttttccttgactgcaaaatgggtgtagattgatggcaatcatctgtaggaaatcaaaattactggcagaaacctggaagtgttgagtatttctacagtggtctctactggcaggcagtagaccatcagtattctcgtcagtagtagcatctaaaccgttgatttgagttctactagtataatacaatattctaccgccagtagattactgtaccttgtggcaaatgttggcaacattattatataccaaccaaacaggcccttatcaagtgatttacgtgtcatgcaggatcctgagggtctatttccttgcattcttggtcatgaagctgctgggtaagcatatagatgtgctaattacatatatgatcatgcacagctaagataattgagcatcgatatgtttcttctgtttatgtttatagaattgttgaaagtgttggggaaggagtaactgaggtgcagcctggggaccatgtcattccttgttaccaagcagaatgcagagaatgcaagttttgcaagagtggaaagaccaacctctgtggcaaagttcgtgctgccacaggggtcggtgtcatgatgaatgatcgcaagagccgtttctcaataaatggaaaacccatttatcatttcatgggaacatctacattcagccagtatactgttgtgcacgatgtcagtgtcgcaaagataaacccacaggcacctctagacaaagtttgcctgcttggctgcggtgtttctactggtaggttcttcattggaggccaaacttttattcaccaattatagttccttttgtacctactatcattttgtagctttacaaaccttacatgcagagctcgttgggttgtttgaatgcattgtgcttgattttttttaccatatttcataaatatggaaagcctcactatatctgtgtcaatgatacctccaaatttccaattcttacttttcttttggtacactggatacaatattacataccattgcctcgcacattcttgttattctcttctagataattatgatatattcgtatgtgtatctcacaaattactattgttaggcctcggagcagtatggaataccgcaaaggttgaagcaggttccatcgttgctatttttggacttggcacagttggacttgcagtaagtcaaaatatgtccatgcacatttaacatgttagtctggaaagagagctttgacatctaagattttcattttaggttgctgagggggcaaaatcagctggtgcttctcggattattggcatcgacattgatagcaaaaagtttgatgtcggtatgtttcataatttccatttttctgtttattgcaccttttggttggtagagtaaagggcatattccactctcttaagtatatctggtgaaagcaggcaatccatgtctggtggtgcaacttgctaatagacctttctctcttgaatcgaacctgaaagtgcaaatctacgtattgtttgattatcaacaaatactagaataaattccaaaggcttactatccctttatagtaattcgtttttgacttgcaaaggcagtgatgcaccatcaacaattcctgaatttgccaccattgtatttgtctgagttgtgataggaaagattttgatctgtgatccattgttaacttgttattaccatttatcttcttttgcttgcatgcaccttgctcttattaatcatcacattgcttttcggcatcaggtccagagatcaaacttattattatttgtttatttccgcccatatgcaccacaaatgtgttcttacaaattggatgctttgtatgtgttattgaatgataaagaatgtattacattgcatgagttatttcataaaaattgtctgcaaatcaaacatagcttattttccaactctttttctgctgttattgtttgcagcaaagaactttggggttacagaatttgtgaacccaaaggaccatgacaaaccaatccaacaggtcatagttgaccttacagacggtggtgtggactacagctttgaatgcattggaaatgtttctgttatgaggtctgcattggagtgctgccacaaggtaagctacggctgcagcttttattcggacatctttgtgaattttggtcgcctggtacaaattaatgacaaacttcaaaagaattaataaattgagttgaatcatttggtgcggtaatgtctatttctaatgaattaatgacatttgatctgaatcatatcttaaatgtgttgcactgtcatttggataaactgcttttatttgaaatacagcgtatctgtttttatatttccatttatagatcaatcatactgttttccacccatcacaaagtaaaatattttcgctttcaactgttaaatttctgcgggtattactgtagggctggggaacctctgtcatcgttggtgtagctgcttctgggcaagaaatctctacacgaccattccagctcgtcactggccgtgtctggaagggaacagctttcggcggcttcaagagccgaagccaagttccatggctcgttgagaagtacttgaacaaggtaacaaatcatcacagtctaaactctaaacctgcagaagtttcgtcaatctgtagtgattcatctgaccagaattctcatgtaatccgcacaggaaatcaaggtggacgagtacgttactcacagcatgaacctgactgacatcaacaaggcgtttgacctgctgcatgaaggtggctgcctgcggtgtgttctggcaactgataaatgaaccgatgatggttcatctgcttttggctgtgcttctgagctgtgtcacgccaaattgtaatccagatctaccagccttggaaattgaattattctgctcgtttcgcttagaagcactttgaactgtgacaccactctgctataataatatatgtgctgtttggatctttggggatgattgctgttagaacattgccgtgattttgttgaataagcgcctctttgtcatgttttctacagtagaagttctgcactattaccattagacctactcccaccgtcatatttttgtacacaacagtttttcgtttatgcttatacttatcagctacaatttaaatttcaaccttaaatttaaaatttgtgcctat

SEQ ID NO: 514 - DNA, 1446 bp, Zea mays
  CDS (82)..(1227)
ggccggggacctcacagccacatctctccactgctccgtccagcgcgtccacctcccaaacccctactcccccaggaagcaatggcttcccccacccagggccaggtcatcacctgcaaagcggcggtggcgtacgagccgaacaagccactcgtgatcgaggacgtgcaggtggcgccgccgcaggccggcgaggtccgcgtcaagatcctcttcaccgcgctctgccacaccgaccactacacctggagcggcaaggatcctgagggtctttttccttgcattcttggccacgaagctgctggaattgtggaaagtgtcggtgaaggagtaactgatgtgcagcctggggatcatgtcattccttgctaccaagcagaatgcaaagaatgcaagttttgcaagagcggaaagaccaacctctgtggtaaggtccgtagtgccacaggcgtaggtgtcatgatgaatgatatgaagagcaggttctctgtaaatggaaagcccatttaccatttcatggggacatcgacattcagccagtacactgtggtgcatgatgtcagtgttgcaaagatcaacccacaggcacccttagataaagtctgcctgctcggttgtggtgttcctactggtcttggagcggtgtggaatactgcaaaggttgaatctggctcagttgttgctgtttttggccttggaacagttggacttgcagttgctgagggagcaaaagctgctggtgcttctcgagttattggcattgacatcgacaataaaaagtttgatgttgcaaagaactttggagttacagaatttgttaacccaaaagagcatgacaaaccgatacagcaggtcctggtcgatcttacagatggcggcgtggattacagctttgagtgcattggaaatgtttcgattatgagggctgcactggaatgctccgacaagggctggggaacctccgtcatcgtcggagttgccgcctctggccaggagatctccacacgaccattccagctcgtgactggtcgtgtctggaagggaaccgcttttggtggcttcaagagccggacccaggtcccatggcttgttgacaagtacatgaagaaggaaattaaggtggacgagtacattacgcacaacatgaacctggctgacatcaacgacgccttccacctgctgcacgaaggtggctgtctgcgttgtgtgctggcgatgcagatctgaaattcctaagctaagcagtttttggatgtgtcggcatagactgtcttttgttttggaactagaattcctttttgcctcgttaggcctggacccactgtataatgctatgttgctttggatggctgacgatggttaccgctgtgttgctagccatgtggtacttgatctgtatcacggttgcaaataagtgctgtttctaaaacactccctcggtgaata

SEQ ID NO: 515 - DNA, 1383 bp, Zea mays
  CDS (108)..(1265)
gttctcctcctctcactgctgctgtgaccatcaaggtatcacactgaacccgcagctgcacccactcacccacccaatccgcgaagcactaatacaaagcttacgccatgtccgacactgcaggaaagaccatcacttgcaaagccgccgtagcatgggaggccggcaaggacctcgtggtcgaggacatcgaggttctgcctccacgagctcatgaagtccgcatacaagtctactacactggtgtgtgccacacagatgcgtacatgctgagcggaaaggaccccgagggtgctttcccagtcattgcaggacatgagggcgctggtatcgtcgagagcgtcggcgagggtgtcaccaacgtgaaggttggcgacactgtcgttgccctatacacgccagaatgcaaagagtgcaaattctgcaagtctggcaagaccaacctctgcggcaagattcgcgcaactcaaggaaagggtgtcatgcctgacggcacttcacgcttcaagtgcaagggcaaggacctcctccacttcatgggctgctccaccttctcgcaatacaccgtgctcgctgacatctccgtcgttgctgtgacgccagatgcgccaatggacaggacatgcttgttgggctgcggtatcacaaccggctacggtgcagctgttatcacagcaggacgcggaggtgtagagaagggttccaacgttgcaatcttcggtgctggatgtgttggtctctccgtcatccagggtgccgtaaagcagggcgcctctaagatcattgtcgtcgatgtcaacgatgcgaagaaggaatgggcaaagaagttcggtgctactgacttcgtgaacccagccaaggatctcaaggagggcgagaacattcagagcagactcatcgacatgaccgatggtggatgcgactacacattcgactgcacaggaaacgttcacgtcatgagatcagcgctcgaggcttgccacaagggctggggtgagagcattatcatcggtgtcgctgctgccggacaggagatttccacaagaccattccaactcgtcactggccgtgtgtggaaaggatgcgctttcggtggtgtcaagggccgcagccaaatgggtcaactcgtgcaagattacatggacaacaagctcaaggtcgacgaattcatcacacaccgacagccactcggcggcatcaacgaggctttccacgacatgcacgccggagactgcattcgctgcgtcgtggacatgcgcaaggtttaaacaatgttagatttgggaaatgaaaaacaacttgtgaatagtgaagttagcgttgctgcaaccaaattgtgaagctataggtgtaaaaaaggaacgttcacattcataaaaaaaa

SEQ ID NO: 516 - DNA, 1390 bp, Zea mays
  CDS (95)..(1231)
tgtaaagagtgcgaagaagcagtagcaaaaggattccattctcgtgttcttggagtggtccatcgatcgagctccgtgagagagatagcaagcaatggcgacagcagggaaggtgatcaagtgcagagccgccgtggcgtgggaggccggcaagccgctgtccatcgaggaggtggaggtggcgccgccgcaggccatggaggtgcgtatcaagatcctctacaccgcgctctgccacaccgacgtctacttctgggaggccaaggggcaaaccccggtgttcccgaggatcttaggacacgaagcgggaggcatcgtggagagcgtcggagagggcgtgaccgagctcgcgccaggcgaccacgtcctcccggtgttcaccggcgagtgcaaggagtgcgcccactgcaagtcggaggagagcaacatgtgcgacctcctcaggatcaacgtcgaccgcggcgtgatgatcggcgacggtaagtcccgcttcaccatcagcgggcagcccatcttccacttcgtcgggacgtccaccttcagcgagtacaccgtcatccatgtcggctgcctggccaagatcaaccccgaggcgcctctcgacaaagtctgcatcctcagctgtggtatctcgaccggccttggcgcgacactgaatgtggcgaaaccagccaagggctcgacggtggcgattttcgggcttggggctgtaggccttgctgctatggaaggtgctagactggctggtgcatcaaggatcatcggcgtggacatcaacccagcaaaatacgagcaagctaagaaatttggctgcactgaattcgttaaccccaaggaccacgacaagccagtgcaagaggtgctgattgagctgaccaacggcggcgtcgaccgcagcgtggagtgcaccggtaacgtcaacgccatgatatccgccttcgaatgtgtccacgacggctggggtgtcgccgtgctggtgggtgtcccgcacaaggacgaccagttcaagacccaccccatgaacttcctcagtgagaagacactcaagggcaccttcttcggaaactacaagccccgcaccgacctgcccaacgtcgtcgagatgtacatgaagaaggagctggagctggagaagttcatcacgcacagcgtgcccttctcggagatcaacacggcgttcgacctgatgctcaagggggagagcctgcgctgcatcatgaggatggaggattagagcttcattgcaagcttgctcctcctgcagggcaggcatgtcgcacagcaaatgggcatgaaaagttgaaggcgctccagtcctccagcttgtgtagtacacagtagcaataaaacgttagtgtttgtcctgtgcccaaaaaaaaaaaaaaaaaaa

SEQ ID NO: 517 - DNA, 1475 bp, Glycine max
  CDS (30)..(1166)
taaattcctcgtggaatattgaagaagccatgtctacagctgggcaggtcatcaagtgcagagctgcggtggcatgggaagcagggaagccactgtcaatagaaaccatagaagtggcaccaccccagaaaggtgaagtgcgtttgaggatcctcttcaactccctttgccgtagtgatgtttattggtgggatgctaaggaccagactcctctgtttcctcgtatcttaggccacgaagcttcagggattgtggagagcgtgggcgagggtgtgacacatctgaaaccaggtgaccatgcactcccaatattcactggggagtgtggtgaatgcacttattgtaagtctgaagagagcaacctgtgtgagctactcaggatcaacactgacaggggtgttatgctgagtgatggaaaaacaaggttctccaaaaatggccaacccatttaccacttcgttggaacctccactttcagtgaatacactgttctccatgaaggatgtgtagccaagattaaccctaatgccccacttgacaaagttgctattgtcagctgtggattctgcacaggttttggggctactgtgaatgttgcaaaaccaaagcctaataatactgttgctgtctttggcttaggagctgttggtcttgctgcctgtgaaggggcaagggtttctggtgcatctagaatcatcggggttgatttacttcccaatcgatttgaacaagccaaaaaatttggggtcactgattttgtaaacccgaaagatcacaacaaaccagtccaagaggtcattgctgaaatgactaatggaggagtagatcgtgctattgaatgcactggaagcatccaagcttcaatctcagcatttgaatgcactcatgatggttggggtactgctgtccttgttggtgtgccaaagaaggatgttgaattcaaaactaatcctatgaagttcatggaagggagaactcttaagggtaccttctatggtcactacagaccccgcactgacattcctggtgttgtggagaagtacctcaacaaggagttggaactagacaaatttatcactcactctgtgccattctcaaagatcaacactgcatttgatcttatgctgaaaggggagggcataaggtgcctcatctgcatggaagagtaaatcaatgatgaatgatgttccctgctgtgagaacaatgtttctgtgttatgtgaaaagagaattgaataaatttggcatgcaattcggttgttggattcatgctatatgagtgtgtaaagaggtaacggggggtgatgactttcttggtcattgtcgtggctttgtgacttctattgcaaatgttgtcttgtaactttgttgtattttcggcaatatatctatatgatatctatctttctatcttttttttgtgaaaaaaaaaaaaaaaaaaaaaaaaaaaaaaaaaaaaaaaaaaaaaaaaaaaa

SEQ ID NO: 518 - DNA, 1491 bp, Sorghum bicolor
  CDS (107)..(1288)
cccacgcgtccggaaacccccaaatccgctcccttcccctatccacctcgactcccttccttccatagcagcggcagcggcggcggcggcgaagggcggcggagccatgggcggagccggcggcggcggcgaggcgaagcggtcggagatctacacctacgaggccgcctggcacatctacgcgatgaactggagcgtgcgccgcgataagaagtaccggctcgccatcgccagccttctcgagcaggtcaccaaccgcgtcgaggtcgtccagctcgacgaggcctcgggcgacatcgcccccgtcctcaccttcgaccaccagtacccgcccaccaagaccatgttcatgccggacccgcacgcgctccgccccgacctgctcgccacctccgccgaccacctgcgcatctggcgcatcccgtcccccgacgacgccgacgacggcgccgcctctgccaacaacaacaacggctccgtccgctgcaacggcaccccgcagccgggcatcgagctgcgctgcgagctcaacggtaaccgcaacagcgactactgcggcccgctcacctccttcgactggaacgacgccgacccgcgccgcatcggtacctcctccatcgacaccacctgcaccatctgggacgtcgagcgcgaggccgtcgacacccagctcatcgcccacgacaaggaggtctacgacatcgcctggggcggcgcgggggtctttgcctccgtctccgccgacggctctgtccgcgtctttgacctacgggacaaggagcactccacaatcatttatgagtctggttcaggtggcggcggcggcggttccaactcgggcgccggggatggtgggactgcgtccccgacaccactcgtgaggttgggctggaacaagcaggacccaaggtacatggccaccatcatcatggacagccccaaggtggttgtgcttgatatccgctacccaacactgccagtggtagagctacatcgtcaccatgcccctgtcaatgccatagcgtgggcgcctcactcttcttgccacatctgcacagctggggatgacatgcaggcactgatatgggatttgtcatctatgggaactggtagcaatggtagtggcaatgggaatggtaacgcagctgcggcagcagcagctgagggcggtcttgatcccattttggcatatacagcaggggcagagattgagcagttgcagtggtcggcaacccagcctgactgggttgcaattgcatttgccaataagcttcagattctcagggtctgatttcctaattctgccctgtttcactgaggagtaaaaagaatgccaaacttggataatgaggttaggccatgggaggataatcttttgtgcttgctttagttgcttatttatgttgtggacaactgatattcgtggtgggtcatttctagttatagaacagaagacttgctaaaaaaaaaaaaaaaaaaaaaaaaaaaaaa

SEQ ID NO: 519 - DNA, 1661 bp, Zea mays
  CDS (141)..(1388)
tgacggccttcactgcacactacaatcaatcagccggcttttcctctcttcccctcgacagaagcccccaaatccgataccttcccctatccacctcgagtcccttccttccttagcggcggcgcgaaggcggcggagccatgggcggagtcggcgaaggtgacgcgtgggcggatcaggagcagggcaacggcgggggcagccgtggtgttggcggtggcggcggcgaggcgaagcggtcggagatctacacgtacgaggccgcctggcacatctacgcgatgaactggagcgtgcggcgcgataagaaataccgccttgccatcgccagccttctcgagcaggtcaccaaccgcgtcgaggtcgtccagctcgatgaggcctcgggtgacatcgcccccgtcctcaccttcgaccatcagtacccgcccaccaagaccatgttcatgccggacccgcacgcgctccgccccgacctgctcgccacctccgccgaccacctgcgcatctggcgcatcccgtcctccgacgacgccgaggacggcgccgcctccgccaacaacaacaacggctccgtccgctgcaacggcacccagcagccgggcatcgagctacgctccgagctcaacggcaaccgcaacagcgactactgcgggccgctcacctccttcgactggaacgacgccgatccgcgccgcatcggtacctcctccatcgacaccacctgcacaatctgggacgtcgagcgcgaggccgttgacacccagctcatcgcccacgacaaggaggtctacgacatcgcctggggcggcgcgggggtctttgcctccgtctccgccgacggctctgttcgcgtctttgatttacgggacaaggagcactccacaatcatttatgagtctggttcaggtggcagcagcggcggcggttccaactctggcgccggagatggtgggactgcgtccccgacaccactcgtgaggttgggctggaacaagcaggacccaaggtacatggccaccatcatcatggacagccccaaggtggttgtgcttgatatccgctacccaacactgccagtggtagagctacaccgtcaccatgcccctgtcaatgccattgcgtgggcacctcactcttcttgccacatctgcacagctggggatgacatgcaggcactgatatgggatttgtcgtctatgggaactggtagcaatggcagtggcaatgggaatggtaacacagccgctggagcagcagcagagggcggtcttgatcccattttggcatatacagcaggggcagagattgagcagttgcagtggtcggcgacccagcctgactgggttgcaatcgcattcgccaataagcttcagattctcagggtctgatttcctagttccaccctgtttcagtgaggagtaaaaaatgctaaacttggataatgagctgatgcccggaggataatcttgcaattgctttactgttgcttatttatgttgtggacaactgatattcatggcgggttagttctagaaatagaacagaagactttctagttagaagctgaattgtcaatgaatttggtttgtagagtaaggaactgctctggtgttagcgatggtgataatgggaactgaatttagtttgttctaaaaata

SEQ ID NO: 520 - DNA, 988 bp, Agrobacterium tumefaciens
  CDS (98)..(865)
tgcgcttgcgctctaccgcgaggcgttctgacccatttcttacagcgatatcttcagttccaagggaggaaaacgagtgaccgatatcagactttacatgcttcagtcgggtacgctgaaatgcaaggtacacaacattaagatgaaccaggggaacggtgcagactatgagatccccgttccgtttttcctgattacccatccggccgggcacaccgtgatcgacggcggcaacgcgattgaagttgcaacagatccgcgtggccattggggcggcatctgcgatgtctattggccagtactggacaaggaccagggctgcgttgaccagatcaaggcgcttggtttcgatccggccgatgtcaaatatgttgtgcagtcgcacctgcatctcgatcataccggcgccatcggtcgcttccccaacgcaacccacatcgtgcagcgctctgaatatgaatatgcctttacgcccgactggtttgctggcggcggctatatccgcaaggacttcgacaagccgggtctgaagtggcagttcctcaacggtgcgcaggacgattattacgatgtttacggcgacggcacgctcaccacgatcttcacgcccggtcatgcgcccggccaccagtccttcctggtgcgcctgccaaacagcaaaccgcttctcctgacgatcgatgctgcctacacactggaccactgggaagagaaggctttgcctggcttccttgcctcgaccgttgacacggtccgttctgttcagaagctccgcacctatgccgaaaagcatgatgcgacagtcgtcaccggccatgaccctgacgcctgggcgaacttcaagaaggctcccgaattttacgcgtaaatagaacgcgcaagtcaacggccagatacggcgaggttgcatgcaatctcgccgatttttatcatatgagccaagggcaccgagccgagcgggaccgtgtatttcggcgcatcgaccttt

SEQ ID NO: 521 - DNA, 1500 bp, Xylella fastidiosa
  CDS (365)..(1204)
atttcctttccatttatggaattatggatatggtaaaaatcctttttaattctcgagataatgaaaaagttgtttctgttcatatattatgtcatacgggttcaaggcagttctgagtactgagtggttggatgtttctttcagatgattttcacttaatgataaaccgaggatcatgtttttataaggaaataaaataaaaaagcatgaggttaatgaatgcaaagaaaaatgtagtttctgagttgggttggtttgatgaaatacatgaattcggtgtacagtacgacattaccagttaatgagaatattcactctttataatagatagagttttattcatttcaaaaaggaagaagccataatgatcacagtcacgccgttccagactggcacggtccgcatcaagacggctcaacaggcggggcaagacagtaagagtggtatcggtcgcaagcttgatatctttcgtgatccaaactggaccgaagtgctgcccattttttgtttcttgattgaacatccagaaggtcgcttccttgtggatacaggtgacacgtggcgcaactctatcccgggatatctgccacgctggaatccgtttctcactaagcaagtgatcgtcaaagtcgcgttgcacgaagagatcggcccgcagctattggcgaagaatatcgatccgtcgcgtgatgtcgaggccgttattctcacacatatgcaccatgatcacgctggtggcctcgatcacttcccacatactcgtatcatagtgacgaaggagaactatgatgcctctcgcggattctttggtagggttgcaggctgtctgcctcagcattggccaatctggttgaagccagagttgatcgaaccgactggacctgctgtcggtccgttcgcatcctcctatccaattacccgtgatggccgcattgtgcttgtaccaaccccaggccacgtcaaggggcatgtttccgtattggttcgtaacgatgatctgtcgatctttattgctggggatgcgacgtacgccgaggatattctacgttccgggaaggtagacggtgtgaccttcgatcctgtgctgtcgaaagatacccttcgtaggatcaccgagtacgcaacatcgacaccaacggtcatcatgccatcccatgatcctgatggcccagcacgtttggtggttcgtcaaacattcatttgaccaagcgatgccggctcacatatggtgtattagtttgttgtatttcctgcagcagtagctttgtccatgatcgctagtggggctgtttgctcgcttcctaatgaagtattcgaatgcatcgtgcgatagaaggttcgtggctgaggcttggaagaacgcgattacgtctagtgagcagctcgcagacttataccctgcgtatctaagcttcctggctcgctgatgagcggttatttgcgatggcaagccgtgtaggtggtacgccgaggcagatatcggtggttgtgtccggtttc

SEQ ID NO: 522 - DNA, 1167 bp, Xanthomonas campestris
  CDS (121)..(1044)
cgagcaccggccgcgcccgcctggcaactgcgcattagttttgattgctgctcttggcacgcacacacagccgtcaaagcagtgtgtgcgtgacggccgccgtcgccgcaccgctcaccgatgagcgacgacgccgttgcaatgctggcccgccaagcgcggagcgtgccgatgcgtgtgcaccacctcaactgcatctccacctgcccgctgggcggccacctgatggatggacgcacgcacggcgtgctcgagcgtggccacctgagctgccactgcctgttggtggaaaccaatgccggtctggtcttgatcgacaccggctttgggctgcgcgatgtcgccgagccacgcgcgcggcttagtgcgttctttctggcgctggtgaaaccggatctgcgcgaagacatgacggcgatccggcagatccagcggttgggcttcgatccgcgcgatgtgcggcatatcgtgctcacgcatctggatttcgaccatgctggcgggctggatgattttccgcatgcgcgcgtgcatctgatgacgcgtgagcgtgatgccgcgctggcgcaacacacctggatggaccggcaacgctttcgcccgcagcaatggtccacgcgtgggcaatggcgtacctacgacagtacctccggcgcggcctggatgggcctggagtgcgtgcacgatttgcacgggctgccgccagagatcctgctggtgccgctccccggccacacgttcgggcatgccgccgttgcggtgcgcacccctgagcgttggttgctgctcgccggcgatgcgtatttctatcaccgcgaaatggacccgcagccttattgcacgcccgggctgcgtttctatcaatggatgctggaaaaggaccgcactgcaaggctgcataaccagcaacggttgcgcgcactgcggcaacagcacggtgcggaggtggaggtgttttgttcgcacgatgtcgtggaattcgaacgcgttgccgggctgcccgcacgcttgcctgcaggcgcgttgcaacacgcgcccacggcgtgagcacgtgtgcttcacttcgccagaacgtgccgcagcgcgatcatgcgccaccagtgccgcagcagcgaggcggtgcgctacaggagaagcacgatgcagcagattgaagtgggccagatg

SEQ ID NO: 523 - DNA, 2123 bp, Arabidopsis thaliana
  CDS (592)..(2052)
ttcatagaacattatgtttatgaaacaaaaatgtaaatcaatcggaaactttggtggtatacaagtaaataatttggaaaaatacatgtttaagcaaaagtaattgttactaatatcctaatttctacaattgttgtttcgatggtccctttctttaggtgaggattgagacaatcttttagaatctttgattccactcttcgctccaaactctactttgctataacaacaacttcaaaatagattagttaagcgaatcaggttacattttaaagaaaacgatatagagagagcaactttgtatataattttaaaattcttcacctgaaagcctttaaaaaccagttcaagataaacccatctcaccaaactttagtaatcacaaaactaattaacgtcaaacaataacaattttttcacaaatttaattcttttattcctttattcgttgctcttatatttccatcgatctttctccttgtctcacaaacattctgacattttagagagcctcgacagagaattatttttttcttttttattttcgtttacaagtttcaattcttctctatatattaaaaaaacaaacagatgcaaccttggagaagaaaatttccattgttcgaaacaggagttacaatgaaacagaggaagaacagtaatctctcaatcttcgtcgtagtcttctctgttttcctcttcgggatcttcatgtacaatgaagacgtcaagtccatcgcagagtttcctttctccacctcaaaacctcacgacgtccacgacgaagcgacaccgatcacagagatcacaacactaccggttcaagagtcgatcaagaactcagacccaattcaggaatcgatcaaaaacgcagactcagttcaagattcagttaaagacgtagcagaaccagttcaagaggaggtatcgaaaacagaggaagttaaaaagattgagcttttcgctgcgacggaggatgaagaagacgtggaattgccgccggaggaatgcgatttgttcaccggagaatgggtttttgataacgagacgcatccattgtataaagaggatcaatgtgagttcttgacggcgcaagtcacttgcatgagaaatggaagaagagattctctgtatcagaactggagatggcaacctagagattgttctttaccaaagttcaaagcgaaattgctgttggagaagctaaggaacaagagaatgatgttcgttggagattccctaaaccggaaccaatgggaatcaatggtttgtttggttcaatcagtggttcctcccggtcgaaaaagcttgaacaaaaccggttctctctccgtcttccgagtcgaggattataatgcgacggtggagttttattgggcaccatttttggtggaatcgaattcagatgatccaaatatgcatagtatacttaaccgtataataatgcctgagtccattgaaaagcatggagtcaactggaaaggcgttgactttcttgttttcaacacttacatttggtggatgaacacattcgctatgaaagtcctacgaggatcgttcgataaaggagacaccgagtatgaggagatcgaacggccagtagcgtataggagagtgatgaggacttggggagattgggtggaacgaaatattgatcctctacgtaccactgtcttctttgctagcatgtctcctcttcacatcaagagcttggattgggagaatccagatgggatcaagtgtgcattagagacgacaccaatcctaaacatgtcaatgccattcagcgtaggaacagactacagactgttttcagtagcggaaaacgtcacgcattctcttaatgttccggtttactttctcaacattaccaaactctccgaataccggaaagatgctcacacttcggttcacacaatccgacaaggcaaaatgctgacgccggagcaacaagccgatcccaacacttacgccgattgtatccattggtgtcttcccggtttacctgacacgtggaatgagttcctttacacacgtatcatttcccgttcgtgacctacaaaatatttgaaatatctctttttcaatattttttcccactttgctccatccaatggaagagc

SEQ ID NO: 524 - DNA, 2001 bp, Arabidopsis thaliana
  CDS (370)..(1965)
aaaccatggccttgtctcacatagtatcaataatgtttaattaaacacgcttttaaaacactaactggtccccaccaaactgccgcaaaagtccatctagttcatgactttcagctaacctcacacccccgtcaccctaatgctgtcacatccaaccaatactttacttccacgtgtaatataaccaatgagttcacgccaaaaaccacaaacactatcgtgtcacgttagcacttcccaaaaccaccaccgtgataaaacagtcctctccatttctctactcaacatccatccgaaccaactcgaagatattatttttcatggattgagcaaagaagaggacgataatttcgaaaatatcgcgatacaatggacaagttctcgtacaattcgtatccagattcagctgaatcgtcgccaagatctcgcgatgtcgaatttgaaaatccgtcgccatgggaggaccagcagcagcagaactacaaggtgaagctcatgtgcagctatggcggcaagatccagcctcgtccacacgataaccagcttacttatgtaaacggcgataccaaaatcatgtcggtcgatcgtggtatcagatttccggctttagtatcgaagctctccgccgtctgcagcggtggtggtgatggaggagaaatctcgttcaagtatcagcttccaggtgaagatctagatgcgttgatttcggtgactaatgatgaggatctggagcacatgatgcatgagtacgatcggttgcttcgtttgtctactaaaccagctaggatgcgtttgtttctcttcccgtcttctcccatttccggcggatttggctccgaaggttcgactaaatcggatcgggatacgcttaatccaatccctagccgacctgaatcggagaaatctgtaaccgctcctccgaataatgctgatttcttgtttggatcggagaaagtagctccaattccgccgtcgccagtgaaggttcctcaaccggtaccggaaccagtggtgcttgaaccgccgcagatgttcgtagatcaacggatgttacaaccggaacacggcgtaaatccggcggagattcaaagacaaatccaggaatttcagatgattcaaatcagagaccaagagcaacaaatgcttcatcagaatcagctacatcaacaacaacaacaacaagaggctatacatcaaaatcagcttcatcaccaacaagaggttatacatcagaatcagctgcttcaacaagaggctatacatcagaatcagatgcttcaacaacaacaacaacaagaggctatgtacagaagaaaaaccgaagacgaagccggaagatacttccctcccacatacactcaaaatccggcgccggtgacgaatcaacaacctccggttggctactggcaaggaaacaccaacaacagtaatattcaggggaatatctacacaacaacgtcacagaatctaccggagcaacaacaacaacaacaacaagtatacatgattccagctcaatctcaagctccagggacattataccaaagcgtcatgagaccaacggtacaaggaaaccaaggttattacccatcacctgttcagcgacttcatcatcctgatgcatacatggaacagcagaaccagccaggttacaacgtggttcaaccacagccaacgttttcaggtggtccacaagttatgactagtgttggtccgcaagttatgactagtgtcggtcctccaatggggttacaggaaccttattcacagatggggaagcctgtgtactatacggtggctggagaaggcatgatggttcaaccgccaccagcccagcctcagcagcagcagcagcagtaccagggaatgggtcaaccggttagtggcatgaccgatctcagaaccggaccggatgggaaagtggcggttaacatggctgcaccacaagtttcagattcggtgtgagtgtgagattgagttaacattgaggttaatgttatg

SEQ ID NO: 525 - DNA, 1511 bp, Glycine max
  CDS (67)..(1329)
attcggctcgagtaggtgtctctcactctcccaccgaatccacattctaaagtaatacgccggagaatgacgtcacactcccactacccacccgacttagacgccgactccgtcacctcctccccacgctccgatcacttccacgacgcgccgccccgcatccgcttcatgtgcagcttcggcggcaagatcctcccccgcccccacgacaaccagctccgctacgtcggcggcgacacccgcatcgtcgccgtcaaccgctccatcactttctccgccctcattctcaaactctccaaactctcaggcatgagcaacataacagccaagtaccagctcccgaacgaggatctggacgcgttgatctcggtcaccacggacgaggacgtggagaacatgatggacgagtacgaccgcgtcgcacacaatcagaacccgcgatcggcgcggctccggctcttcctcttccccgaaggagaagactcccgcgccagcagcatcagctcgctcctaaacggctcagccaagcgcgaaaactggttcctcgacgctttaaacggcggcgtttcgggcctcgaacgaggccgctccgaagcctcttctatggtctctgaagtacccgattacctcttcgggttagacaactccgaagaaataacaaatcaccaacgcgacccgagacccaaacccggacccattattcaagataacgtttccgtttcagatccgggttcgcccgccccggttgtctcgtccccttattgttccacgtcatcagcgccgcccgtgccctctctcccgaaccttccctatgttaaaaccaaacctttaaacttaaatccggttcctgatactgactccaaggaaaatcaaaccgaacctgaaacggaacctcacccgaacctgaacctgaaccaaaacccgaacatgtattcaaataaccctgttgttcactaccctccagaagctgcttattcggcgcattcagtaaacccggttccggtttactatgtttccggtccggttcgaccgggatccgtgccggttcctatgcaaaccccttatcactacgttcaacaatcgtatcatgctgtggtgccacctcaggttcctatcgggtaccatcctttggttccgggttcgggtcaagtatatggagcgggcgtgaggcacatgaccccactgcaaccttacagcccctccaccacggcggtggttcatgacggtttgaaacagcacgtgtatcatgccgtgccaaattcgggtccggttccggttcacccagttattccgatgacgggtttggatgaaccgcagagaggtggagcgtaatttgtgacgggtcggggccccaattcacttaataactgatcccatttttatttagtggatgggtgctgaatttttactaccataccatcatgcaaatggtaatttatgtctatatatatacaagtgccttcactaaaaaaaaaaaaaaaaaaaaaaaaaaaaaaaaaaaaaaaaaaggg

SEQ ID NO: 526 - DNA, 1599 bp, Glycine max
  CDS (37)..(1464)
attcggctcgagtttccacatatctgacagaaaaaaatggagaactatcagtacccggcgtcgtaccctgactccggcgagtcctccccgcgctcgcgcgagatcgacttcgagaacccgccgccgtgggacgagcagcagaaccaaaactacaaggccaagttcatgtgcagctacggcggcaagatccagccccgcacccacgacaatcagctctcctacgtcggcggcgacaccaagatcctcgccgtcgaccgctccgttaagttctccgccttcctctccaagctctccgccctctgcgactccccgccacaggacctcaccttcaagtaccagctccccggcgaagacctcgacgccctcatctccgtcaccaacgacgacgacctcgaacacatgatgcacgaatacgacagactctatcgccctaacctaaaacctgttagaatgagactcttccttttcacactctctaattcaaaccctaattcctctttctcctccgaacgcgaccgtttcgttgaggctcttaattcgggtccggttccttctcaacccgatccgatcaaaaccccacccgttacgccttctaatgttgattatctcttcggtctcgataaagccgttgctcctccaaatcttcctccgaacttcgcagcggttaaattccacgatccggtgccggaacctgtcgctccgacgccggtagagtatcaatcgagagtttccgatcgggttgttggatcggatccgaatgtgaattcgatggaaattcagagacagatgcagcaggagatgcagcgattgcagattgcggagaatgaatatcgtagaaggagtgaggatggatttgcaactggttatgctgctgcagccggaggagattattacatgcagaaggtgcaggagaaggttccgccgcagaatgcggcggtgccgcctccggcggcgtactggtcggagaagcagttttccggggagggatatcagacgacggtgacgacggcggctccgggaggaggtgaccagccgatgtatgttatggcggcgccggggacgttctatcaccactcgccggtgatgcgacctccggcggcggcgcagggatactacgctgtgcagaggatgggttctgatggctaccgtgaacagcaggcggtgtacggaggcatggctgcgccgaaagcggggttttcgacggcggggatggttaaggggccggcgtattcggagggatatagtggcggcgtggtgaggccggcggggttgccggataatgcggcgtatgcgcaggtggcgtatgatagcgcgagtgggagacaggtttactatactgcgcagggaggagtggtgcacgcgccgccgcagtaccaggggggtccgcctcaggatgtgaggccgggtggggtttcggtggggcaggatggtaaggtggttaacaaggttaaccaaggttctgtgtgattataatagctgtgattgagattgtcattatgttaattttgaaataaataatacactaaatatgttttgctttttttttcatggtttatatataataccaatattgttagcttataaaaaaaaaaaaaaagg

SEQ ID NO: 527 - DNA, 2308 bp, Glycine max
  CDS (49)..(1971)
gcccccaaaacagagcaaaacagaggatccactccaccactactcctaatggatcctccacccctctctgccgccactcaaaaaaaccatcccgaatcggtagagtccttttctccatgtttccgcgttgcggaaacgtggactgatgagactctaccggcggttcctggtgccaagctgcgcctcatgtgcagctacggtggccacattatgccacgccctcacgacaaatctctcagctacatcggtggcgacacgaggatcgtggtggtggaccgccactcgtcgttgaaagatctatgttcacggctttcccgaactatcctcaatggaagacccttcacactcaagtaccagcttcccaatgaagaccttgagagtcttatcactgtcaccactgatgaagaccttgacaacatggtggaagagtatgatcggataatggcaaaaggttcggcttcttcgcggctcagggtgttcctgttcttcaccaaacctgaggccacagtttcaatggggtcactccttgatgatgccaagtcggagacatggtttgttgatgcactcaacaactctggcatgatatcaagagtggtgtcagattctgctgccggggattcttttgttaaccttgatggtgttggtgttggtggtgttagtgctagtggttcaagcaacaacttggagtctttgcctgatgctaacaaggttaagaattttcctgaagtggtgcaagtgcaatcaacacctggttcgcctatgatggagaacagttcttcttctccttctttctctccttctctggttaatctgcctccaattcgggttcatgttgatgacaatggtagtaggcttcagcaagagaataaggttggtttggtggtggaggagcaatttgctcagatgacaattgcaagtggggtgaagccagatgatggattggtgaatgttgtttcttctgcagtggctgtgcctgtaattcctgcatctgtgactatggcatcagctggggtgattactactagtgataatgtgatgaatagagttgtttgtgaggatgacagatcagatcccgggtttcagaagccccctttaccattgcagcttgtgcagccaaggactagtggtggtgtgggtttgccttcacctgattcagttgcaagtgatagtagtattgcagctgcaaattctttctccaagactgtttactaccaagatcaagtccaagctgcactactagacaacaaaattgttgctatgccaaatgccaagagtgaaatatctgatcagatgattcaggtccaaggacaacttcaagattctggctacacattacccccacaattggatccaaacaagcaacatttccagcagcagaagccatttgtccatgccagcactcactacatccaccacccagcagccacaggtccagtgccagtttcatcatactacccagtttatgccccaccacaacctcaacaacttcaccctccaattggtcaacaacagtacccagtttatgtaatgccagttggacctacacaagtaacacaaccctacaacatggcattgcagcccaatatagctgatcctaatgtggtagcttcaagcaggtcattaatgccacaaagtattgttacctcagcagcatacaaagatggtactccacctatttaccccaccaagtcagttagctctactatggcatcaaattctggatatgctccaatacctaccaaccaatttcaaccacagtatgtgggtttgcatcagttccatcatccaccacagtccattgctgtggctccttctagtactactactaataataattatggttatgaatatggtggccatgtgcaagaccaagcttactacactcaacaaaccaccactgctccattgcttcctcagtaccaatccatgaccccagctgcagctgctgcagcactatcagatgcttcaaaatagtttcctgcagacaacattcagcagccaactagagcatcacaaccagtatgaatcaaaaagtggagaaaaatgaatgaatgagtttggtggaggcatgttggggaggggtggggtgaggggcaattagactttactttcattttttaaccatgaacatatgcaccctaatttctacagaaaaaaaaaaaaaaggaaataaggagtaaagcataggttatttcttttttatctataatgaaatgaatgacatgtaagatcatattctgcaaacttagctttttctggtcgtcacagtttactcagttgaataaagcaagttgttgccattaaaaaa

SEQ ID NO: 528 - DNA, 2138 bp, Oryza sativa
  CDS (100)..(1722)
ggcacgagctcgtgccgaattcggcacgaggaaaaatatggggagtatttgtgcgtttttatttttgtttttgggtcgcactgttcgatcgtagcatccatgaccactgtggcatcgctgtctttgctgccgcacttgctcatcaagccttccttcaggtgttgctccagaaagggtgttggtagatatggaggaatcaaggtgtatgcggtgctcggtgatgatggagctgactatgcaaagaacaacgcatgggaggccttgttccatgtcgatgacccggggccaagggttccaattgcaaaaggcaagttcttggatgtcaaccaagctcttgaggtggtccggttcgatatccagtattgcgattggagggcgcggcaggacctcctcaccatcatggttcttcacaacaaggtggtagaggttcttaatcctttagcaagggagttcaagtcaattggaaccttgaggaaagagcttgcagaattacaggaagaattggcaaaagctcacaatcaggttcatctgtcggaaactagagtatcatctgcccttgataagttggcacaaatggagacccttgtcaacgacagactgttgcaagatggaggctctagcgcatctacagccgagtgcacttcccttgctccaagcacgtcatcagcgtcccgtgttgtaaacaagaaacctcctcgccggagtctgaacgtgtctggtccagtgcagccatacaatcccagtctgaagaacttctggtacccagttgctttctccagtgacctaaaagacgatacaatggtgccaatagattgttttgaggagcagtgggtaattttccgaggaaaggatgggagacctggatgtgttatgaacacatgtgctcacagagcttgccctcttcatcttggctcagttaatgagggcagaatccaatgcccttaccatggttgggagtattcaactgatggaaaatgtgagaaaatgccatccacaaagatgctcaacgtgcgcatccggtcattaccatgctttgagcaagaaggaatggtttggatatggcctggcaatgacccaccgaagtcgactatcccttctctgctgcctccttcaggatttacaattcacgcagagatagtgatggagctaccagtggagcatggacttcttctggacaatctattagatcttgctcatgctccttttactcatacatccacctttgccaagggttggagtgttccaagcttggtgaagttcttgacaccttcatctgggcttcaaggatactgggatccatacccgatcgacatggaatttcgaccaccatgcatggtgttgtcaaccattggcatctcaaagcctggaaaactagaggggaagagcaccaagcaatgttcgacgcatctccaccagctccatatctgtttgccctcctctaggaataaaaccaggctgctctaccggatgtctctcgacttcgctccatggatcaagcatgtccctttcatgcatatactatggtcacattttgctgagaaggtcttgaatgaggatcttcgagtcgtgctcgggcagcaagacggatgtcaatggcgcaaatgtctggaactggccagtatcatatgcaagcttggtatccggtatcggttgtggagagacgccattgagaggggagtagacaggttgccattcagtaaccaaagtgagagtggatcatagtagctgcattgccaatagcctcttttcaattcttgtcgtatttcttggcgagatgaagatgaagatgaagatgatgatggccagaactagtcagtggatgtatatgcacagtttgtttaggcgtgcgtccctgcatggttggttcaccatctccctgagcttcgttgcagattgaattgggttctggagaggaaaggctaatggaaggagagaatgataggcgacgtcattctgtgtaattttaagtgtacactagcgacagcatcacgggatgcaattgtaatctgaggttgatttgtttttcttcttttttttttcctccccttttacccatgtaaaagtcgatcgcatgtcacgctatgatgcatatatatgatcatactattgattattgagccaaaaaaaaaaaaaaaaaa

SEQ ID NO: 529 - DNA, 2802 bp, Saccharomyces cerevisiae
  CDS (1002)..(2621)
tgctaagtcgaggcaatctcgcggcgcgactactttgaagcctttttttagttcttttttatgatcaaaatgtttatataattacccagattatcaacccacttcgatgatgggccgcacctgacagaaaaaaatgaatcaactggctactaaagatggtacaaaagttcactttattcagatatagaattgctgaatcgctgcttaccgccatacgcttgactacttttacacccgtacaccacacatacaaccgtacgactacttttcatgcaacagcgtgcgtttcgacatgtcttacacacgagtagatcatcccactggaaaaatggcttgtcacctgaggcagattttggcaagcccactgtttttcgcaaattatgtactacatgcagccattcactacccttcgagcgacatacgcggcgacatcctgtagagcaatgttgtccttaccaagacgtcttgatgaaggataagcatacgcgaagagatttcctctcggagagcctgcagggagcggcgcacctcgccagcggagttatcacacgtaatggtactgagtgagagaccccgcccgacaccgcacggccatttgcagaaagaaaaacaaagtccactacggctaattactgcagaatgcttttttttctttttttttgtggttggtatgttcccttctaacaggattcttccttcggtagatccttgaggggtttaaggggttttctgtttgcgtaatggcgtaattgccagctatatataacattatcatcacatatatatccttatacgtagcttgcccttatatatatattgatatgcggatattcgttgaatgtagttcagtcgtaatcgctacttattggtaatcatagcaattgaatgcttctatattcctttcttactttttttaattgcgcattataaaaaacttgaaggtgcatatttccgattagggccatcaatagtgaccataattatcggtacattaatacgtcatgccattgaatgaaaaatacgagaggcctccgcaacctcctccagcatatgatcccaaccataggccgcccagttcttccgagaactctgccgcggcgaatgtcaacgatggccagacgccgtaccattttagacaggatcaatattacaatctaaattccaaaacgagtggggctcctatagggagcttcgacgaggcctttcctactgaaaatgacaacaagcccaggtggaacgattggccatttaccatttttttcctatgcacggtaggcggattcatcgccattgctgccataaccttaagagcgtggtcccaaacctatagcagtacgggttccggaatatacgatggtgtgaatactggtacgctgaacaccaatgctgccatcctgctagttttcgtgtgcattattgccctagtattctccgttttgggcctcacactttgtcgaatttttccgaagcagtttatatattgcggtatggtcatcaacctagtggcttctcttgggactgccatcatgtacatgtctttgaggtactggtctgcaggtattgtgtttttagtcttcacgttcatgaccgcgtggtgctactggggtatgaggtctagaattcccctttctgtggcggtattgaaagtcgtcgtcgatgccatgaagaaatgcccacagatcttctttgtttcatttgttggagcgctagttgctagtgcgtttgggtttctcttctcagcagtcattgtggctacgtacataaagtacgatcctaatagctcgaatggcggctgtgacgtttctggtggcagctgttcgcattccaaattgattggtgttttggttgtggtttttttctgcggctattatatctctgaagtaataagaaacgtcatacattgtgttatttctggcgtctttggcagctggtattatatgtcaaagtctgaccaaggaatgccaaggtggcccgcatttggagcattgaagagagccatgacttactcgttcggttccatttgctttgggtccttgctagtcgctttgatcgacctgttgagacaaatattgcaaatgatcagacacgatgttacctccagcggtggcggtcaaattgccatccagattttgtttatggtgtttgactggattatcggctttctgaagtggctcgccgagtatttcaatcattatgcatactcgttcatcgctctttatggtaaaccgtatttaagagcggccaaagaaacctggtatatgttaagagaaaagggaatggacgccctaatcaatgataatttaattaacattgcactgggtctattttcaatgtttgctagttatatgaccgctttgttcacgttcttgtatctaaggtttacctcgcctcaatacaattcgaacggcgcttacaacggcgccctaatggcattctcatttgttattgctttacagatttgcaacattgcaacagaagccattagatccggtactgcaactttctttgttgctcttggtaatgacccggaggtcttccatcattcttaccctcataggtttgatgagatttttagggcatatcctgatgtactcagaaaattgagtcaccagaatgtgtgaagagatgtttatcatatgtcactatttctccttgttcttcttaacaattctatatttaattacaatattttaatacttaattttttctacttcaattacctttaagttctatctttattaaattgtttattttgtttttatacattctgtgcagattaacaatatgctatttattaaatga

SEQ ID NO: 530 - DNA, 2475 bp, Saccharomyces cerevisiae
  CDS (419)..(2110)
actggttgaagtcacattacatataactacttattttatctaagtcctatatagttctgttattcactagtttgtatattgtacctctaatttatcttataatttcgtcagtaatgacttataattggctttattttcttctcttttttttcacatgcgcagaacctatataacgaaaaaaaaaaaaatgaaaactgaagataagcggccttgacttctctaaactgccgatatttcaacgaaagttagccaacttatttataaaagccttgaataccaacaattggaaagaaggtgtctgtgcttatcatatatagcttgcataaagaaaaattataatatcttcgaacttccatagaaagaatatctttcagtgttaactggctcatttactcagaaattagtattttgaagaacgatgagtattcggaatgataatgcttccggtggctatatgcagccggatcaatcttcgaacgcttctatgcacaaaagagacttaagagttgaggaggaaataaagccattggatgatatggatagcaagggtgctgtagcagcagatggtgaagttcatctaagaaagtcattttcgttgtggtcaattcttggtgttggattcggtttgactaattcctggttcggtatttctacatcgatggttgcaggtatatcttctggtggacccatgatgattgtttacggtataattattgttgccctgatttctatttgcattggtacctcgttgggtgaattatcttccgcatatccgcacgccggtggtcagttttggtggtctttgaagcttgcccctcctaagtacaaaagatttgcggcctacatgtgcggttcatttgcttacgcaggatccgtgttcacaagtgcttcaactacgttatccgttgctaccgaagtggttggtatgtacgctctgacgcaccctgaattcatcccaaagagatggcatatattcgtttgctttgaattgttgcatttgttcttgatgtttttcaactgttacggtaaatccttacctatcatttcatcttcctctctatacatttccctactatcctttttcacaattacaattactgtattggcatgttctcatggaaagttcaacgatgcaaagtttgtttttgccacatttaataatgaaacaggttggaagaacggcggtatcgcctttattgtcggtttgattaacccagcttggtcattttcgtgccttgactgtgcaacccatatggcgtttgaagttgaaaaaccagaaagagttattcccattgctatcatgggaacagtcgccattgggtttgtcacttccttttgttatgttatcgctatgttcttctctatacaagatctggacgctgtcttgtcttctacaacaggcgccccaatcttggacatttataatcaggcattgggtaataaatcaggtgcgattttcctgggttgcttgattctatttacctcttttggttgcgtcattgcttgtcacacttggcaggcaaggttatgttggtcatttgccagggacaatggtcttccattatcccgtttatggtcgcaagttaacccacacactggtgtacctttgaacgctcatttaatgtcatgcgcttggataaccctcattggcctactttatttggcttccagtacggcttttcagtccttaattacaggttgtattgcatttttattgttatcctacatcattccggttatatgtttacttgctaaaaagcgtaacatagctcatggtccattctggcttggaaaatttggatttttttcaaacattgttcttttgggttggactgtcttttctgtggtctttttttcctttccaccagttttacctgtgacaaaggataacatgaactatgtttgtgtagttattgttggttatactgcgtattcgattctttactggaaatacaagggtaagaaggaattccacgctttagaagaatctgagaacgaacaggctgaatatagtaataacttcgataccattgaagatagtcgagaattttccgttgcggcctctgacgttgaactcgaaaatgaacacgtaccgtggggaaagaagtgaatttatagtgttgatcagtcgaccgttatttattttaagtatattatttgcatagaagtaataaaagtgaattttttttaatggtttgttaagccattttagacgagggactaagatatttcaacctaaatatccctcaggctttgcgctcttgaaagcgatgtgactgtaattcaaatttcttgaaatatttttgcgggaaaaagatgaaaaatttttcacctcatcgcataagaagcaaataaaaaaaaaatattaataatagataggcaacaatatagcagctcagagatatagcttaacttcattttacagccttttaacgaaagcataagtattaacagtttgatatataggggattaaa

SEQ ID NO: 531 - DNA, 743 bp, Zea mays
  CDS (145)..(384)
ccacgcgtccggcagcttcggctcgttgcaagtgctggcgcctgcaggctgcagttccagtgatatacaggactggcatcatttgcagctgcagctcacgtcttggcgagtgtcaaaacccaggagagagagcccaagcaagcgatggcgcgtatcggcgcgagtcatctactcctcgtcgtcttgctgctctctgcggtcctgagctccggctcggctcgggttcccagagaacgaccggacgcgatgctgccggccggtcagacggcggcaatggccgagatgaccgtgcccggcgaagggcagagcagtgggccggcgtttggagtggcggcgcacgagtccaagcgcctgagccccggaggccccgaccctcaacaccattagctgatggtagtaaccgtgatgagttattagctcgtgtgctgcatgcctctggaagacggtttcttatgtatcgtacgtcgcctcgtcggatgagatagagagttgttgtggagatcatcatcaacaagcatgacatctccctaagcgttctttcagatactatatatccctatctgttcatgtttgttcggttgtaagcgtttcctttgtttttgttgtgcttgtgtgcgtttttcactagacgttgggatcataatttttgtatctattcgatatattgattatgatttaataaaatcttttctttattcagaaaaaaaaaaaaaaaaaaaaaaaaaaaaaaaaaaaaaaaaaag

SEQ ID NO: 532 - DNA, 507 bp, Zea mays
  CDS (22)..(255)
gcagtacacttctcatcagccatgaagctcgtcctgtgcttctgcatctgtgtcgttctcgtcatcgcctcgtcgccggtcacgctctctgatagccgccctgcgatggggcgacgctggctgcgagacgaagttgtcattgccaggggccctgaaggcaacacgacctctgcctggtcggaggaggcgccggggatgataccgtacgacgggtcgaagaggctcagccccggtggtcccaacccgcagcatcactaatcgtcgtccgatcttgttggcaagtgccactgcggacatcttgctacgggaatctgtggttgattactacactttggttctgatcagcttttcttttctgtcctttctgatcagcttttcttttctgtcaaggccgtttgatcaaggagtaaacgtaacaaattattgccacgatttttctgaatgtatccaagtcatgtgagtgataataatgatatgctgtcattaactaaactaaagagtcgttgc

SEQ ID NO: 533 - DNA, 423 bp, Triticum aestivum
  CDS (102)..(365)
ttcaggcattgagaaatcgagcgtcaatctgctgatcactcgcatttgcgttgagcagatcacttgctgtgtagattgcaggtacaggttcctgagcttgcatgcgcatggccaaggcttgcctactccgcggtgtggggctggtggtgtgcgcactcctgcttctctcgccctctttcatggcggctgaggcaactggccggaaatgggatcacgggagagaggccacggtggccgtgatgccgatggcgggagggcgttttgcgaggaaggtgttgcgggaggagatggtccaggcagacggcgacgtcgacattgccggctctaagaggaaaagccccggtggcccagaccctcagcatcattaactgatgtcgaggtctcctcgcatgcatatttctctacaaaggcagcatatacatg

SEQ ID NO: 534 - DNA, 732 bp, Zea mays
  CDS (69)..(356)
gaaactcctcctcctcctcctcctccaccaccacctcgccttctcttctttttgtcttgcgtcgcagcatggtgaggaaccccctaaaagccaggccgacgctggtgctcatcagccttcttctaatggcggacctggcaaccgttggctatagccgaagagttgcagaactgggtgcgttagccgtgagcgacagcggcggcggtggcggtggctcgccgccgggcaaaggctgctgcttgcccaaccagtcatcttcttcagcgtcagggcgacacctcggtgacgattgttgcaagcaaatgcgtattgtgtccaagaggctggtgccccaggggccaaaccctctgcacaactgaccagctccgggctccaggtctgcacttgcatgcatcgagagataggcagaggctttttcctttttgtaacgcagccatgcagagtgattagtggagctgcaggtcttcctcttccatgaggtcatgtaaattataggcctacagcttagtttgccgctagctcatacgctctctctgtcacacacttttgtcacttttgattgagagccgctcttcatcggtgacggtgagagactgaaactttgtaataatggatggtcgagggcaaaactcttgcataggctggaattctattttcctttatctagaaactgccttttgatgatgagaatttttactgggacctgtggttctgaaaaaaaaaaaaaaaaaa

SEQ ID NO: 535 - DNA, 595 bp, Zea mays
  CDS (46)..(441)
caccttggacatatatatggaaaatagcttcacagtctagattccatggcatcaaggatggggatggtggctattctgtccttgtttgtttgtgctcttgttgcttcaacatctgtcaatgctaatgtgtggcagactgatgaggatgctttttatagtacaaataaactgggagtcaatggcaacatggagatggcacaacaacaaggtggatttattggccatcgcccaagacttgcattattcaatagggcatcaaaacaactggaccgtgaaaaaagacctgtgcctagcgggccagaccccatacatcacagcatcccatcacatgctcctcagcatccaccatcatatggcaaagctccttatgaagatgacaagagcatagcatctcctggtctgtccaacccgataggtcctccaccatttttagatagatactagttcatgcaaaagtagtgagtatttatgcacctatgccaatgaataacctctaattacctacatgtattggcctggtgtttggtaacatgaagcaataactttctcttatcgaaaaaaaaaaaaaaaaaaaaaaaaaaaaaaaaaaaaaaaa

SEQ ID NO: 536 - DNA, 1099 bp, Zea mays
  CDS (38)..(1036)
tcactgttctctgataacaacgttgttagttgtcaccatggttgttctgtctcagccagcattaaaccagtttttccttctgaaaacatgcaagcccacgcccttgttcgcggggattcctgtggtcgacctcacggaccccgatgccaagacccacatagtcaatgcctgcagggacttcggcttcttcaagctcgtgaaccacggtgttccgttacagttcatggccaatttggaaaacgaaaccctcgggttcttcaaaaaacctcaatccgagaaagacagggctggtccccctgacccttttggctacggcagcaagaggattggccctaacggcgatgtcggttgggtcgaatacctccttctcaacaccaaccctgatgtcatctcccccaagtcacagttcattttcagagaaggtcctcagaatttcagggcggtggtggaggaatacattagagcggtgaagaacatgtgctatgaggtgttggaattgatggctgagggattggggataacgcagaggaatgtgttgagtaggttgctgaaggatgagaagagtgattcttgcttcagacttaaccactacccgccatgcccggaggtgcaagcattgaacggaaggaatttggttggatttggagagcacacagacccacagataatttctgtcttgagatctaacagcacctcaggcctgcaaatctgtctcacagatggcacttgggtttctgtcccacctgatcaaacttcctttttcatcaatgttggtgacactcttcaggtaatgactaatgggaggtttaaaagtgtaaagcatagagttttggctgacccaaccaagtcaaggttgtcaatgatctactttggaggaccacccttgtgtgaaaagatagcacctttaccttcactcatgttaaaaggagaagagagtttctacaaagagttcacatggtgggaatacaagaaggctgcgtacgcgtcaaggctagcggataatagactcggcccttttgagaaatctgctgctgattaaggaggcaaagtgtgtcaaaattctactactcaattttggcacgtgttgttaggccaactt

SEQ ID NO: 537 - DNA, 1557 bp, Oryza sativa
  CDS (74)..(1219)
ccaacatcctgagctccaatctcccactccattccggccgcgcattctcccgctctcgatcgatcgatcgatcatggtggtgccttccgcgacgacgccagcgaggcaggagacggtggtggcggcggcgccgccagctgcggcggcgtccggtgtcgtcggcggcggcggcggcgtgacgatagcgacggtggacatgtcggcggagcgcggcgcggtggcgaggcaggtggcgacggcgtgcgcggcgcacgggttcttccggtgcgtcgggcacggcgtgccggcggcggcgcccgtcgcggcgaggctggacgccgcgacggcggcgttcttcgcgatggcgccggcggagaagcagcgcgccgggccggcgagcccgctcgggtacggctgccggagcatcgggttcaacggcgacgtcggcgagctggagtacctgctcctccacgccaaccccgccgccgtcgcgcaccgggccaggaccatcgacgccatggacccctctcgcttcagtgctattgtgaatgagtacattgaagccatgaagaagctcgcatgtgagatcctggacctgttaggagaggggctaggtctcaaggaccccagatacttcagcaagcttaccacaaacgctgacagtgactgcctcctgaggatcaaccactaccctccatcatgcaacattcacaaacttgaccatgatgaccaatgcaatatcaagagccttgttagcaccaaggctagcaatggtgggaatctgatggcaggtgggcgcattgggttcggcgagcactctgacccgcagatccttagcttgctccgagcaaacgatgtggaagggctacaggtgtttgtgccggaccacgagggcaaggagatgtgggttcaggtgccatcggacccatcggccattttcgtcaatgttggtgatgtcctccaggctctgacaaatgggaggctgataagtatccggcacagggtaattgcaaccgcctgcaggccaaggctgtccacaatatacttcgcatcaccacccctgcatgcacgaatctcggcactcccagagacaatcacagccagcagcccacgccgataccgatcattcacctgggctgagtacaagacgacaatgtactcactccgcctgagccacagccgcctagaactcttcaaaattgacgatgatgacagcgacaatgccagtgagggaaaagcataggaattgctggttaaattgcagacgatgcctatggaccagtggggattaggaagctgaaactgtccccaaaattttggctctctggcagtctggctactatcgtcagatatctcactattatgatggtgtagtgcctaagttgacgggtgtgtaatatcgttagcagtctacagaagctatggttgtacggaagtaatgtactgtcgccttttcagctaactatccatgttctctcttatatgtaatgagttagttgacggatgtgtaatattgctagcattgtatataagctatggttgtatggaagtatgtaatatagccttttcagctaaaaa

SEQ ID NO: 538 - DNA, 1672 bp, Zea mays
  CDS (17)..(1531)
gccagagtcctcacggatggcctcgccagcgatggtcccgctgcggcagctcttcgtcgacggcgagtggcgcccgcccgcgcagggccgccgcctccccgtcgtcaaccccaccaccgaggctcacatcggcgagatccctgcgggcacagcggaggacgtggacgccgcggtggcggcggcgcgggcggcgctcaagaggaaccgtggccgcgactgggcgcgcgccccgggggccgtccgggccaagtacctccgcgctatcgccgccaaggtgattgagaggaaacctgagctggctaagctagaggcacttgattgtgggaagccttatgatgaagcagcatgggacatggatgatgttgctgggtgctttgagtactttgcggatcaggcagaagccttggataaaaggcaaaattccccagtttctcttccaatggaaacttttaaatgtcatctccgaagagagcctattggggtagttgggctgataactccttggaactatcctctactgatggctacatggaagatagcccctgcattggctgctggttgtacagctgtgctgaagccatctgaactggcttctgtgacttgcttagagcttgctgatatctgtaaagaagtcggtctcccttctggtgtcttgaacattgtgacaggattaggtcctgatgctggcgctcctttgtcagcacacccagatgttgacaaggtcgcttttactgggagttttgaaactggcaagaaaattatggcatcggcagctcctatggtcaagcctgttacactggaacttggtggaaaaagtcctatagtagtatttgatgatgttgacattgacaaagctgtcgagtggactctgtttgggtgcttttggaccaatggtcagatttgcagcgcgacatctcgtcttcttatccatacaaaaattgctaaaaaatttaatgagaggatggttgcatgggccaaaaatattaaggtttcggatccacttgaagagggttgcaggcttgggccagttgttagtgaaggacagtatgagaagattaagaagttcatatcgaatgccaaaagccaaggtgctactattctgactggaggtgttagacctgcgcatcttgagaaggggttctttattgaaccaactattattactgatatcaccacatcaatggaaatctggagggaggaagtctttggtccagtcctgtgcgttaaagaatttagcactgaagatgaagccatcgaacttgccaacgatacacagtatggtttggctggtgctgtaatttctggtgatcgggagcgctgccagaggttatctgaggagattgacgctggatgcatctgggtaaactgctcgcaaccctgcttctgccaagctccctggggcgggaacaagcgcagtggatttggacgtgagcttggagaagggggcattgataactacctgagcgtcaagcaagtcacggagtacatctctgatgagccgtggggatggtaccaatccccctccaagctgtaaactggcaagacgaaaatttgtctgtttcggtagaataaatatatctcgatgctatacagaacgaacccgtgtatcacattgaatgacatggtgaaaaaggcacatctgcaggataaaggcgagagttgagttgaaacc

SEQ ID NO: 539 - DNA, 1887 bp, Oryza sativa
  CDS (93)..(1610)
gcagggcagcctgaaagaaagcggcggcggcagcaggtcactggctcactgctctgtcctctcgtctccagagttcagaccaccgcatcgccatggcgccgccgcagacgatcccccggcgcggcctcttcattggcggggcctggagggagccgtgcctcgggcgccgcctgcccgtcgtcaacccggccaccgaggccaccatcggcgacatcccggcgggcacggcggaggacgtggagatcgcggtcgccgcggcgcgggacgcgttctcccgcgacggcgggaggcactggtcgcgcgcccctggggccgtgcgcgccaacttcctccgggcgatcgccgccaagattaaagacaggaaatctgagctggctttgctggagacacttgattctggaaagcctctggatgaagcaagtggagacatggacgatgtcgctgcatgctttgagtactatgctgatctggcagaagctttagatgggaagcaacagtcaccgatctctctgcctatggaaaactttaagtcgtatgtacttaaagaacccattggggttgttggactgatcactccttggaattatcctctgttgatggcaacttggaaggtcgcacctgccttggctgctgggtgtacaactatattaaaaccttcagagttggcttctgtgagctgcttagagcttggtgcaatatgtatggaaataggcctaccaccaggtgtcttgaacataattactggtctgggccctgaagctggtgctccattatcctcacattcccatgtggataaggttgcttttactggaagtacagagactggtaagaggataatgatttcagctgcccaaatggttaagcctgtttcattagagcttggtgggaaaagtcctcttattgtctttgatgacattggtgacattgacaaagctgttgaatggaccatgtttgggatcttcgcgaatgctggtcaagtctgcagtgctacttctcgtttactgctgcatgagaaaattgcaaagaaattcttggatagattggttgcatgggcaaagaatataaaagtctcagatccactggaggaaggctgcagactgggttcagttatcagtgaaggacagtacgagaagataaagaaattcatctcgactgcaagaagtgaaggtgccacaattctgtatggaggtggccgaccacagcatctcagaagagggttctttcttgaacctacaattataacagatgttagtacgtcaatgcaaatttggcaagaggaagtctttggaccagttatctgtgttaaggagtttaggacagagagtgaagctgtggaacttgcaaatgatactcactatggtttagctggtgccgtgatctccaatgatcaggagaggtgcgagcgcatttcaaaggctcttcactctggtattatttggataaattgctcgcaaccatgcttcgtccaagctccttggggagggaacaagcggagcggttttggtcgggagctcggagaatggggtcttgataactacctgacagttaagcaagtcaccaagtattgctcggatgaaccgtggggatggtaccagcctccatctaagctgtgaaggggcattcactccagggaatgtaatgcatcattaactgacagcatcagtcctgttaatggacaggagctcgtgtacagtacagtgctcgtaaaaaaagctctttgatggtaaagttgcttgctgctatcactactccagaccagaattcaggactggagagtacgatgtcatgagttgtactacttgttagtctgcactcttatcattcgaagtttggcagtggtgtgtagttgcacttggaagattgcaataataataaagataattggat

SEQ ID NO: 540 - DNA, 3445 bp, Saccharomyces cerevisiae
  CDS (617)..(3226)
gtaatcagagccatagcgtatcagaaaaccacacctaattagatggttcttgcatctgtacctcttatcactaaaagcggcactaaacttccaacattaaatgtttgccttgttaaatatatatttttgccttggtttaaattggtcaagacagtcaattgccacacttttctcatgccgcattcattattcgcgaagttttccacacaaaactgtgaaaatgaacggcgatgccagaaacggcaaaacctcaaatgttagataacgtggatctccgacacatgtgaatttataagtaggcatatgaaaatacagattctttccactgtgttcccttttattcccttctcatgtgaagagttcacaccaaatcttcaaaatataactaatatagtagagtttgattcaaaggacctttttttttgcctctttgattagtttatcttcttttcttcattttatcccctaattttatacgttagttcaacctaacaatccaggatttcattaacaagaaaggtaaaagtaacctatcaaggctattttgaaaaaaaaaattccgccctgaatatttcgagtgattttcttagtgacaaagctttttcttcatctgtagatgtccagttgtaaaaccactttgtctgaaatggttggttctgtgacaaaagataggggcactatcaacgtcgaagccagaacacgttcgagtaatgtaactttcaaaccacctgtaacccacgatatggtgcgttcgcttttcgatccaactttgaagaaatctctgctggaaaaatgcatcgcgctagctattatatcgaattttttcatttgttattgggtcttccaaaggtttggcttacagtttaccaaatacttttttctggtacagtatttattttggagaattgcttataatttaggtattggactggttctgcattaccagtcacattatgaaacactaacgaattgtgctaaaactcatgcgattttcagcaaaataccacagaataaagatgctaattcgaatttctcaacaaattccaattccttttcagaaaaattttggaattttattaggaagttctgtcaatatgagattaggtctaaaatgccaaaggagtatgatttatttgcctatccagaagagatcaacgtctggttgatatttcgccagtttgtcgatttaatcttgatgcaagattttgtgacttacattatttacgtttacctttctattccatatagctgggttcaaatcttcaactggagatctttgctaggtgttattttgattttatttaacatctgggtcaagttagatgcgcatcgcgtggttaaagattatgcttggtactggggtgatttcttctttttggaagaatctgaattgatttttgatggtgtcttcaacatctctccacatccaatgtattctattggttatttgggttattatggcctatcattgatttgtaatgactacaaggttcttctggtgtccgtatttggacattattctcaatttttgtttctgaaatacgtcgaaaatcctcatattgaaagaacgtatggtgatggcactgattccgattctcaaatgaatagcagaattgatgacttgatatcaaaagagaattacgattattcaagacctctaattaacatgggtctttcttttaacaacttcaataagctaagatttactgactatttcacaattggtaccgtagcggcacttatgttaggaacaatcatgaatgctaggtttatcaatttaaattacctctttattaccgtttttgtaacaaaactggtttcatggttatttatctcgacaatattgtacaagcaatctcagtctaaatggttcacgagattgtttttggagaatggttacacacaagtttattcctatgagcaatggcaatttatttacaattattatttggtattaacctacacacttatgataattcatacagggcttcaaatttggagtaatttttccaacataaacaacagtcaattaatttttggtttaattcttgtggctttacaaacatggtgtgataaggaaacgagactagcaatctctgattttggttggttttatggtgattttttcttgagcaactatatctcaactagaaagctgacttcccaaggtatctacagatatttgaatcacccagaagcggtattaggcgttgttggagtttggggtactgtattgatgacgaattttgccgttacaaatattatcttggctgttttatggacattgacaaattttattcttgtcaagtttattgaaacacctcatgttaataagatatatggtaaaactaaacgagttagtggtgttggaaaaactttactaggcttgaaacctctaagacaagtttcagatattgtcaatagaattgaaaatattataatcaaatcattagttgatgaaagcaagaactccaatggtggggcagaacttttgcccaaaaattatcaagataacaaagaatggaatattttaattcaggaagcaatggatagcgttgcaacaagattgagtccatactgtgaattgaaaattgaaaacgagcaggtagaaaccaattttgtcttgcctactccagtaactttgaattggaaaatgcccattgaactttataacggagatgattggattggtttgtataaagtcattgatacaagggcagatcgtgaaaaaacaagagttggatcaggtggtcattggagtgcgacttctaaagattcatatatgaaccatggattaagacataaagaatctgtaacagaaataaaggcgactgaaaagtacgttcaaggtaaagtgacattcgacacgtctttgctttattttgaaaatggtatctacgaatttaggtatcattctggtaactcccataaggtgttattgatttctacaccatttgaaatttcattgccggtactaaataccacgacacctgaactgtttgagaaggatttgactgagtttttgacgaaagtcaacgttttgaaggatggtaaatttcgtccattaggaaataagttcttcgggatggacagcttgaaacaattgattaagaactcaattggcgtcgaactttcgtctgagtatatgaggagagtcaatggtgacgctcacgttatttcgcatcgcgcttgggatataaaacaaacgcttgatagtcttgcttgagttttttttttttgagtatatatatttaaaaagtactaggattcaagttaacattttgaatagaagtagttatgttgttgtaatataatggagctaccatatatgcagaatgacattataaattatgatgttgatgtacaatgcctttgtgcgcttcttttaccatgaattttttcttaacctctttcacttttctttccgactaggataatctcgtgt

SEQ ID NO: 541 - DNA, 970 bp, Saccharomyces cerevisiae
  CDS (160)..(780)
atgcaaacccacacatgcatcgttggtttctgtccactgccactgcaatgaccactggataaggggtctttataagagaacacatatgaagaacatgaacgttcttggacagagccataaacagcaattgaagacaacaagaatagcgcaagtcaagcgatgaaggagtcagtccaagagatcatccagcaactcatccacagtgtcgatttacagtcttccaagttccagctggccattgtgtgcacgatgttcaatcctatcttttggaacatcgttgcaagaatggaataccacaagcattctctcaccaagatgtgtggtggggccagaaagggctgttacatgttggcggcgaccatattttcgctaggtatcgtcagagacatggtgtacgagtctgcattgcgtgaacagcctacgtgttctctgatcacgggcgagaactggaccaagctgggtgtggctctctttggtttggggcaagtgcttgttttgagttccatgtacaagctgggtatcacagggacgtacttgggtgactatttcggcatcctgatggatgagagagtcaccggcttccccttcaacgtttccaacaaccccatgtaccagggttccactttgtccttcttgggcatagccctttacaaaggaaagcctgcggggctggttgtttctgccgtagtttacttcatgtacaagatcgctcttcgttgggaagaaccttttactgccatgatctacgctaaccgtgataaggccaaaaagaatatgtaagtgctctatttctatatattctataatgttagaagcctatgctattaccgtttctatatagctccataagcaatttcttcgcgaaagtgaaaaaaaaaaattttaatgcgatgctctatttaacaaggaatacaatgagagcatctagcgcacacaaacaactacaaaacgcaataacgacacagcaaga

SEQ ID NO: 542 - DNA, 2787 bp, Zea mays
  CDS (392)..(1894)
cgttcatccatcacagtatcacaccatccccactctcttctctccacccggcgagcggacactcccctgtcctcttgacccgatcccgtccccgcccgcccgccccgccgccgcgcgcgctggtccggacgctcgggcgctggtgatccggttgatgcagcagcggggcctcgcccacaactgccgctcccgcggcttctcccgctcccgccgcgcagtcgagggcgcctgaaacgcacccgccccacgcacgcagggcaaccgaaaacccctcgatccggctctcctcgcgctgtagcttttataacgccgtagacgacaacgaaagagaacggaaagaaataaaacccaccacacctaccgtcgtccgtagaggaaggaaggactcgagatggacaccgtcagcgtccccgtggtggccgttgcgaatgggatcggggaggtggagcgcaaggtgcagaagagctactgggaggagcactccaagtgcctcactgtcgagtccatgatgctcgactcccgtgccgccgacctcgacaaggaagagcgacccgagatcctgtctttgcttccctcttacaaagggaaatcagttctagaacttggtgctggaataggacgctttactggagatctggcaaaagaagctgggcacgttctggctctagacttcattgaaagtgtgattaagaagaaccaaagcataaatgggcatcacaagaacataaccttcaggtgtgccgatgtgacatctaacgacttgaagattgaagataactctgttgatctgatattttcaaactggctattaatgtatctttcagatgaggaggtccaaaagcttgtggggaaaatggtaaaatggttaaaggtcggaggccatattttctttagagaatcatgttttcaccaatctggagattccaaaaggaaggtgaacccaacacactatcgagaaccaaggttttataccaaggtatttaaagagggccattcatttgatcaagatggaggttcgtttgaactttctctagtgacctgtaaatgcattggggcttatgtcaaaaacaagaagaatcaaaaccagatatgctggttatgggaaaaggtaaaatcaacagaagacagagattttcaaagattcctggacaacgtgcaatacaaaacaagtgggatattacgttacgagcgtgtctttggtgaaggttttgtgagcactggtggaatcgagacaacaaaggaatttgtgggcatgctcgatcttaaaccgggccagaaagtacttgatgtcggatgtggaattggaggcggcgacttttacatggctgcaaactatgatgtccatgttcttggtattgatctttcggtgaacatggtttcatttgcaattgaacgtgccattggacgcaagtgctctgttgaatttgaagttgctgattgcaccacaaaggattacccagaaaatagttttgacgtcatctacagccgtgacaccatccttcacatacaagacaagcctgctctgttcagaagcttcttcaaatggctaaagcccggtggcaaagtcctaatcagcgactactgtaagaatcctggaaaaccatcagaagaatttgctgcgtacattaagcagagaggctatgaccttcacgacgtgaaggcttatggacagatgctgaaggatgctggttttcataatgtcatcgcggaagatcgcactgagcagttcttgaatgttctacagagggagctaggtgaagttgaaaagaacaaagacgctttcctggcagacttcacccaggaggactatgacgacattgtgaatggctggaacgcgaagctgaaacggagctctgccggcgagcagaggtgggggttgttcattgccaccaagtgatttggcctggcagcaggagggctcttcggaataagaatggatgtggctctaactctgcttctagaccggtgatggttcagcttagaagcaggggatcttcatcatcagaataaaaacgtgtgttgttgtgttgctgtgtctacgccactagtatttctgttgttacttatgttctaggtaaactgcgcagccagagcagagctgaagaatatgtactgcttgctcgctcttgtgtggttgtgtctacccctactagcatttcagctttgttgtaggtaaactgcgaacccagagttgcagaacccgtactgctcgtttaagttcatggtgaactacgagctaaaaggctgttgccagagtggatgtcacttgtcactggaggtccccggttcaattcagatgttgctttggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggccaagctccaaccccacgccttcactacagccaacctttttttatagtgccacccaaattaaaaacacaggccaaaatataaaaaaccccgggattaaaaaaaccttggggttacacaacactttccctttgcaaaatatccccttttcccaaacgcccccattaacaaaaagtcccaaaaagagagccctccccaaaactcccccccacccaaattgtaaatgggaatcaccctcggccggggcattaaacacacccagagtgggggttacacttatcggaaccccaacacgagccaattccctatcgcccccccctttttctttcaccttttttttttttcctcccttatcgggttacccccggcgccctt

SEQ ID NO: 543 - DNA, 2101 bp, Escherichia coli
  CDS (36)..(2069)
attttaaatagtaacaataacagtggggatactggatgacagacctttcacacagcagggaaaaggacaaaatcaatccggtggtgttttacacctccgccggactgattttgttgttttccctgacaacgatcctgtttcgcgacttctcggccctgtggattggccgcacgctggactgggtttctaaaaccttcggttggtactatctgctggcggcaacgctctatattgtctttgtggtctgtatcgcttgttcgcgttttggttcggtgaagctcgggccagaacaatccaaaccggaattcagcctgctgagttgggcggcgatgctgtttgctgccgggatcggtatcgacctgatgttcttctccgtagccgaaccggtaacgcagtatatgcagccgccggaaggcgcgggacagacgattgaggccgcgcgtcaggcgatggtctggacgctgtttcactacggcttaaccggctggtcgatgtatgcgctgatgggcatggcgctcggatactttagctatcgttataatttgccgctcaccatccgctcggcgctgtacccgatcttcggtaaacggattaacgggccgataggtcactcagtggatattgcagcggtgatcggcactatcttcggtattgccactacgctcggtatcggtgtggtgcagcttaactatggcttgagcgtactgtttgatattcccgattcgatggcggcgaaagcggcactgatcgccttgtcggtgataatcgccacgatctctgtcacctccggtgtcgataagggcattcgcgtgttatcggagcttaatgtcgcgctggcgctgggattgatcctgttcgtattgtttatgggcgacacttcgttcctgcttaatgcactggtgctgaatgttggcgactatgtgaatcgctttatgggcatgacgctcaacagttttgccttcgaccgtccggttgagtggatgaataactggacgctcttcttctgggcatggtgggtggcatggtcgccgtttgtcggcttgttcctggcgcgtatctcgcgtgggcgtaccattcgccagttcgtgctgggcacgttgattattccgtttaccttcacgctgttatggctctcggtgttcggcaatagcgcgctgtatgaaatcatccacggcggcgcggcatttgccgaggaagcgatggtccatccggagcgcggcttctacagcctgctggcgcagtatccggcgtttacctttagcgcctccgtcgccaccattactggcctgctgttttatgtgacctcggcggactccggggcgctggtgctggggaatttcacctcgcagcttaaagatatcaacagcgacgcccccggctggctgcgcgtcttctggtcggtggcgattggcctgctgacgctcggcatgctgatgactaacgggatatccgcgctgcaaaacaccacggtgattatggggctgccgttcagctttgtgatcttcttcgtgatggcggggttgtataaatctctgaaggtagaagattaccgccgtgaaagtgccaaccgcgataccgcaccgcgaccgctggggcttcaggatcgcctgagctggaaaaaacgtctctcgcgcctgatgaattatccgggcacgcgttacactaaacagatgatggagacggtctgttacccggcaatggaagaagtggcgcaggagttgcggttgcgcggcgcgtacgtggagctaaaaagcctgccaccggaagagggacagcagttgggtcatctggatttgttggtgcatatgggcgaagagcaaaactttgtctatcagatttggccgcagcaatattcggtgccgggctttacctaccgcgcacgcagcggtaaatcgacctactaccggctggaaaccttcctgttagaaggcagccagggcaacgacctgatggactacagcaaagagcaggtgatcaccgatattcttgaccagtacgagcggcaccttaactttattcatctccatcgtgaagcgccgggccatagcgtgatgttcccggacgcgtgattgttattgcataaaaccgcgccatgtctgca

SEQ ID NO: 544 - DNA, 2101 bp, Xenorhabdus sp.
  CDS (29)..(2068)
tctttttcacttacttcaggaactgcctatgaatatcggagacagtccaaaaaacactcagaaggattcactaaactctgtcgttttttttacctcagccgcattaattattctcttttcgcttttcacgctcttttttacggatgcaacaagcatctggataaaaaacaccctgaactgggtttcgaaaacatttggttggtactacttgctggcagccacgctttacattgtctttgtcatttttgtggcagcttcccgctttggcgctattaagctcggcccggaacaatccaaacctgagttcagtctgctcagttgggcggcaatgttgtttgcggctggcataggcattgatttgatgtttttctccgtggctgagccgattactcaatatatgcgtccgccaacgggtgaaggagaaacaattgaagcagctcgtcaggcgatggtgtggacactgtttcactatggactgacgggctggtctatgtatgctttgatggggattgcactgggctatttcagttatcgttacaatctgccgttaactatccgttcggcgctttatcctattttcgggaatcgtatcaaagggccgattggtcataccgtggatattgccgcagtgatagggacgattttcggcatcgcgacaacacttgggatcggggttgtacagttaaactacgggctaaaggtgttgtttggattgccgcaggggttgggagttcagggcgggttaatattgctgtcggttatcgtggcaacaatatctgtaacctctggtgtcaacaaaggtattcggtttctgtctgagctgaatgtactgttagcgttagggttagtgctgtttattctgtttgtgggagatacagaatttctgcttaatgggctggtacagaatgtgggtgattacatcagccggtttatgggcatgactctcaatagtttcgcatttgagcgaccgacggagtggatgaatagctggacgttgtttttctgggcgtggtgggttgcctggtcaccgtttgtcggattatttcttgcccgtatttcccgaggtcgaacgatccgccagtttgtgatgggtacgctgattattccatttgtgtttaccctgatttggctgtctgtttttggcaatagcgcgttatatgaaattattcacggcaaccacgaattagcggaaacggtgttagttcatcctgagcgggggttttataacctgctggcactttatccggctttcacgttgagtgcttctgttgccacaattacagggctgctgttttatgttacgtcggcagattctggctcactggttttaggtaattttacgtctaatctcagtgacattaataacgatgcaccgaactggttgcgaatattctggtctgtggcaattggtgtactgacgctgggtattttgatgactgacggcatctcagcgttacagaatatgacggtaattatggggttgccttttagttttgtgatcttctttatcatggcaggattatataaatcgttgcgggttgaggattttcgcaaagccagcgcattgcagaatacatctccgacattggtgcatgataatggatcgctgaactggaaacagcgcctgagccgtatgatgcattttccgggtacgaaaagtactcagcgtatgctggatatggtgtgtcgtcctgcgatgcaggaagttgcaaaagagctggagttacgtggtgcaagtgtgcagtttaatatgctgccgtcagaagaagataaacgtcttactccaattgagttgattgtcgatctgggagatgaacagaattttatctatcagatttggccccagcgttattctgttccgggattcacttatcgtgcaagattaggcaaatcttattatttccggctggaaactttcttaatagaaggaactcagggtaatgatttgatggggtatacaaaagaacagattatcagtgatattctcgaccattatgagaagcatctgaattttattcatctgaatcgtgaatctccggggcagacgttaattttcccaaatggggtataaatcagaggtggcctgcaagagtattgcagg

SEQ ID NO: 545 - DNA, 1153 bp, Zea mays
  CDS (102)..(1070)
cgtccgctggctctgcatatcccgcgcccgactcccgttgctgcgtgcggcggcccgactagtcgcgccgcgctgcgcttggcttgattgaaccggccgggatgggggtgttggaagacctcgtggcgagagcgggcgggtgcgcggtcatcgacggcggcttcgccacgcagctagaggcgctcggcgccgacatcaacgacccgctctggagcgccgcttgcctcatcaccaggccgcacctcgtcaaggaggttcatatgcagtatcttgaagctggtgcggacgtcatcatttcatcatcttaccaggcaacaatcccgggtttcatagctagaggaatgtctgtcgctgaggcagaagatttactgcgaacaagtgtaaaactggccaatgaagctcgagatgaattttggaagtcaacactgaggaagtccaaacctatttacaaccgtgctctggttgctgcatccattggtagctacggagcctatcttgctgatggatcggagtacagtggatcatacggtgctgacatcacagccgagaagctgaaggacttccacaggcgccggctgcaggttcttgcaagtgccggtcctgacctgattgcgtttgaggccattcctaaccaaatggaggcacaggcattggttgagcttctggaggaagagaaagtccagatcccttcctggatctgcttcagctccgtggacggtaagaacctgtgctctggggagagttttgcggactgccttaagatcctcaacgcgagcgagaaggtggccgttgtaggcgtgaactgcacacctcctcagttcatcgagggcatcatatgtgaatttaggaagcaaaccaagaaggcgattgcagtttacccgaacagcggcgaagtttgggacgggagagcgaagaggtggctgccggttgagtgcttgggtcacaaaagcttcgacgctctcgcgaagagatggcaggaggcgggggccagcctcatcggagggtgctgccggacaacgccttcaactattagggctgtttccaagatcctcaaaggaaggacggggcattgatttgtttattataattgagctgttgttgcattatgtcactagccagaataacattcagaatatgtatcctgttgctcttc

SEQ ID NO: 546 - DNA, 1526 bp, Zea mays
  CDS (94)..(1107)
ccctcaccctggtctggtctcctctccaagcgggcagcgctcctccaaactgaaccctatcctagcacgagtgcacgtcggtggcagcaggagatggtggggacggcggaaggcggcgcggagagggcggtgcggcggtgggtggacgccgccggcgggcgcctggtcctggacggcgggctggccacggagctcgaggccaacggcgccgacctcaacgacccgctctggagcgccaagtgcctcctctcctccccgcacctcatccgcaaggtccatatggactacctagaagctggggcgaacattataatcacagcatcgtatcaggccactatccaagggtttgaatcaaagggcttttcaaaagaacaaagtgaaaacttgttaacaaagagtgttcagattgcactggaagcccgtgagatgttcttgaaggaacatttggagaaatccactcctatacagcatcctattctggttgcagcagctctagggagttatggggcttatcttgctgatggctctgagtacagtggggattatggtgaagctggtacgaaagagttcctgaaggactttcatcggcggaggcttcaggttcttgctgaagcaggcccggatttgattgcttttgaaacgatccccaacaaattggaagctcaggcatatgttgaactccttgaggaatgtaacatcaatatcccttcatggctttccttcaactcaaaagatggagtgcatgttgtgagtggtgattcgttaattgaatgcgctactattgctgacaagtgtgcaaaggttggtgcagtcgggataaattgcacacctccaagatttattcatggactgatactctccattcgaaaggtcacagacaagcctattctgatatatcccaacagtggtgaaagatatgatggtgaaaaaaaggagtgggtggaatccactggtgtgtcagatggtgattttgtttcgtacgtaaatgaatggtgcaaagatggggctgcgcttatcgggggctgctgcaggacaactccaaacactatcagggccatacacagaactcttaaccaaggctgccacaagcatcagttacctgtagcatagatctgtgctccactcctgatgctctcctcccagcagtaccttgagctgtatccccgagattccttaaccagcgcgaaccaatatactgttgcgtgttctcctgcaaatgagatgttctgcacctatgtttgtaatgttgtatttctgggtttttaagctatccaacttggagatacaaccggtgaggaagcagcaacaataggtagttctacttctgagtgaggaaaaacaacttgcggctgagttaatgaagcttagtagctaccaccgttgtatgacagttgctcagagatgttatcttcattaagtgcttatattaccgctagttcgctgtgaaatttgttaaaccattatatgtaagttttgtttgacaagactgcatctcctgaaactaagatcttagtttcctgctaaaa

SEQ ID NO: 547 - DNA, 1001 bp, Escherichia coli
  CDS (21)..(953)
cgcaaaacaggagccagaacatgtcgcagaataatccgttacgcgctcttcttgataaacaggatatcctgctgctggatggcgcgatggcgacggagctggaagcgcgagggtgtaacttagccgacagcctgtggtcagccaaagtgctggtagaaaacccggagcttatccgcgaagtgcatcttgattactaccgggcgggggcgcaatgcgcgatcactgccagctatcaggcgacgccggcgggcttcgccgcgcgaggtctggatgaagcgcagtcgaaagcgctgattggcaaaagcgtggagctggcgcgtaaagcccgtgaagcgtatctggcagagaacccgcaggcgggaacgcttctggtggcgggatccgtcgggccttacggcgcgtatctggcggatggctctgaataccgtggcgattatcattgtagcgttgaggcatttcaggcgtttcatcgcccgcgcgtggaagccttgctggatgccggggccgatctgctggcctgcgaaaccctgccgaatttttccgagattgaggcgttggccgagctgttgaccgcatatccgcgtgcgcgggcgtggttctcatttaccctgcgcgacagcgaacacctgagcgacggtacgccgctgcgtgacgtggttgcgttgctggcgggttatccgcaggtggtggcgctaggcattaactgtattgcgctggaaaacaccaccgctgcgttgcagcatttacacggtttaacggtgctgccgctggtggtgtatccgaactcgggcgagcattacgatgccgtgagcaaaacctggcatcatcacggtgaacattgcgcgcagctggcggattatctgccgcagtggcaggccgctggcgcacggttgattggcgggtgctgtcgcaccacgcctgcggatatcgccgcgttaaaagcgcgaagctgagggtttatcgggtctacatcgttcattgtaggcctgataagcgcagcg

SEQ ID NO: 548 - DNA, 1101 bp, Saccharomyces cerevisiae
  CDS (60)..(1034)
agaagaaatctgaatcagcaacttttagtgtgcaacttgaaaaagtaatcaaaaaacagatgaagcgcattccaatcaaagaactaatagttgagcaccccggaaaagttcttatccttgatggtggacagggtacagaattggaaaacagaggcattaacataaatagtccggtatggtctgcagctccttttacgagcgaatccttttgggagccatcttctcaagagcgaaaggtggtagaagaaatgtacagagactttatgattgctggcgcaaacatattaatgacaattacttaccaggcaaactttcaaagcatatctgagaatacctcgattaaaactctggctgcttacaagcgttttctcgataaaatcgtgtcatttactcgtgaatttattggtgaggaaaggtacttaatcgggagtattggcccatgggcagcacatgtatcctgtgaatatactggtgactatggtccccatcctgagaatattgattactacggctttttcaaaccccagctggagaacttcaaccaaaatagagatattgatcttattggttttgaaacgattccaaattttcatgagttaaaggctattttatcctgggatgaagatattatttcgaagcccttttatattgggttgtcggtggatgacaatagtttgctacgagacggtaccactttggaagaaatttctgtccatataaaaggcctcggaaataaaattaacaagaatctcttattaatgggagttaactgtgtcagtttcaatcaatcggcattaattcttaaaatgttgcacgagcatctacctggcatgcctctgctagtttacccaaacagtggagaaatctacaatcccaaagagaagacatggcaccggccgactaataagttggatgactgggagaccacggttaagaaattcgttgataatggtgcgcgcattattggcggttgttgtagaacgtctcctaaagatatcgccgaaattgcatcagctgtagataaatactcctaattcaatttcttttaacaaatatcttgtatctacaaaactaaaagcagtgtatatacgtcaatgtgcg

SEQ ID NO: 549 - DNA, 3801 bp, Oryza sativa
  CDS (37)..(289), (1008)..(1239), (1601)..(1794), (1915)..(2048), (2422)..(2621), (2796)..(2943), (3677)..(3790)
ctgcagagtgtgatacaagtatagcaacaagctaagatggtactgttgaattcagaagaagtctcttgcaatgatcatcatcaggtagatgttgttgcagcagccgggctgcagtgcagtggtgacatgctgggagacaagcagcttgtaagccaagtgatattggaaggtttggagattgaagagcctcctgcagatgagatggaggctgcagagaagaaggcagggatatctaggttaatggctggctatgtgcagcacctccaacataggtctgcctaccatctcggtatggtaatttaattatccacagctattaattcacatattgtatatatcgatcaataatacatataaatgtatagcttatagattcagcatcatacagaatcttttctctgcatatatgccataataaatagtacatgtgtaggccaatatgcattgggttattaataggaacatggcagattggcctacatatatactgattaatctttttagcaagtcaaattggagttggattataataattaatataactgaaggacttaagcagttatatatatgcatggtcaattgcaactatttcttatgccttgagtttggatatatgttccatatatatacatattacattttattaatatttgcattaagatggataaagtggtttggttgtgtgcttattgatagaggccggagatgcgaactatttctattatctaaaaaaaatatactggctattctgttgatttatttttctagttatatctttaggtaactagtgtttacataattgattagtgttataaaaaagagagttgtggaagtttgttctagtttctcctcttttgagatctttaagccacatccaatcaattttgttatatagcagatgttttaaaatgaaatattatatattcattaaactaggtaataaagtttttgttgtgctattctttgtttcagtaaatatgtattgattaattcacttgtatttttaggttatccactcaactttgactacgactttagccccctcgcaccttttctgaacttttccctcaataatgctggtgatccatttgctaaggtcaacaacagtgttcactcaagacaatttgaagttgcagtattgaattggtttgctaatttttgggatgtacaaagagaccaattctggggatacatcactagtggtggaacggaagggaacttatatgggctattggttgggttagtacttcttcaatatatattgtgggcaagctttctctcaaatttcattacatttcttaccacttgaaggtataaataatctaatatatgtttttcaaaaaattacatctatcgtatatatatatgtgaacccccattttacatggactgattggtgtgctacctgatttttcgtttcaaaaaaaataaaacaagttgaatccttattactttatcactacagaacagatttaatcccagatgctccagcagaatcaattaaattagtggccaattactaaaactttcattaatttagtctatctttacttcttttgtgttggcttgtttgcaaactaacggttgcattgtactacaggagagagctttttcccgatgggatcttgtatgcttcaaatgattcacattactctgtcttcaaggcagctaaaatgtatagagttaagtgcatcaggattgccactacagtttctggagagatgaattatgcagacttaaaatctaagctacaacataacaccaacagcccagcaattataaatgccaatattggttagatttcaaatccagtgatattcacttgtctaattttatttgtttttaccaatctttccatgttctagtaacactaatattgactgattatgccctgattttttgggtgatctataggtactacctttaaaggagctgtagatgatatcgaccagataataagtacacttgaaaaatgtggatttcaaaatcgttactacattcattgtgacagcgctctctctggaatgatgacgccctttatgaaacaagtaggttccatttttctttttgtgtgtgcttagatgattaacaatatagtgaactgcactcaaataattatgtttttatttgattgacaaaatactatcaacaaccatgatttttccaataaaactcactataccatctcaaaacagacccttactatatatacagcacaaaacaaccactattgcacaagggcaataaagtattacaatacgttgtatatattttgtatttgagtactaattatgcccatgtcgcaaaaatatttatgtgaagatatcttttgattgagatttagttaaagaactatcattatgtgataatatgtttcgttttcttattaaatcaactaaactaatggttcatttcgcttaggccccaaaggtgtcattcaaaaaaccaattggctctatcagcgtgtcagggcacaaattcttgggttgtccaatgccatgtggtgtagtcatcaccaggttggaacatgccgaagtcctgtcaacagatattgagtacatagcttctagggattccactatcactggaagccgaaatggtcatgctccaatcttcctctggtatacattaagcaaaaaagggtacaaaggacttctgaaagaagtacacatatgtatgggaaatgcacgatacctcgaggtattattgaaacaagttggtataagcgcatcttgcaatacattaagcaacatagtggtgtttgaaaggccaaaggatgaaagaattgtgtgtaggtggcaacttgcttgtgagggaaatttagcacatattgttgtgatgccaaatgtcacttttgaaaagctcacagtttttgttgaagagcttgctgagaagagaaaagattggtatcaggacaagggattcgatattccatgccttgcggttgacattggcaaggaaaattgttattgcaacctgcacgcaaaaaagttaagaattcctaaaatgtgactgtagaagtgttgcaagttacatattctttgtaacttggttgttttttttttacaagtgtaaccttatgataaacattacaaatgtagcttgttcttctttttttatggaaataacttgttattcctttcctcaaagcattaagaaaaaaatcattcttaggaaatatctttcttatttatcaccaacacaacacatcacactgcaggatatttaataaagaggattatatatattaaatgagtttctttaagctttacaaacttctatccaacaatacatgtttgaatattgtcatctataaataaaaaaaaagaaatacactcctgtgcatattcttgtttcttcattacattattgtaacgatatcactcattataggtgcataactcagctttatattataaattgaggagataggaatagcacagctaggggcatcggatcatggtcctacctccgatcggagcactttggtgctagggctccatcctatcactatcaatgtgatcacaactcctttcacctagccacccagtggtggatctagaaaactgcagatatgtcaatatcataacgtacttaccgatgtcttaatgtgatagccatacttaaaccagggtgctattttctatgtgtaggtatgctgtttaattggtcatagattttgcctaagtcattgtgggggcacttgacactgaccttgtactgtagctccactcctacaaccacctctgccatggaaacaactagaggaggtggcagtggtttcttataattaagtttgcc

SEQ ID NO: 550 - DNA, 1569 bp, Zea mays
  CDS (21)..(1376)
ccgccgcggagacgctcccgatggagctggatccgtcggaggccttagttgccgctgcggtggaggcgaagggcgaggaggctgccaacgggaggagggagttcgtgatggggaggaacgtacacacctcctgcttcgccgtgaaggagcccgacgcggacgacgaggaaaccggcgagcgggaggcaaccatggctagcgttctcgcgctctaccgccgctcgctcgtcgaacgcaccaagcaccacctcggttacccatacaatctggactttgattatggtgcactgacccagctgcagcacttctcaattaacaaccttggtgatcccttcatcgagagcaactatggtgtccattcccggcagtttgaggttggagtgctggattggtttgctcgcctctgggagttagaaaaggacgagtactggggatatattactaactgtggtacagaaggaaatctgcatgggattcttgttgggagggaggtgttccctgatggaatattgtatgcttctcgtgagtcccattattcagtattcaaagcagcaagaatgtacagaatggattgtgtcaaagttgacacccttatgtctggggaaatagattgtgctgatttccagagaaagttattgcagaaccgagacaaacctgccatcattaatgttaacattggaacaactgtgaagggggcagttgatgatctagacttggttatcaaaacccttgaggaaaacggctttaaagatcggttttatattcattgtgatggtgccctttttggattgatgataccatttgttaagaaggcacctcaagtgacatttaaaaagcctattgggagtgtcagcgtctctgggcacaagtttgtcggatgccccatgccatgtggtgtccagataacaaggttggagcacataaatgccctttctagcaatgtggagtatctggcgtcaagggatgcaacaatcatgggaagcaggaatggtcatgcccctatcttcctctggtacaccctcaacaggaagggctacagaggcttccagaaagaagtccaaaagtgcttgagaaacgcgcactacctaaaagatcgcctcaaggaagcaggaatcggagcgatgcttaacgagctcagtagcacggtcgtgtttgaaaggccaaaggatgaagaatttgtccgaaggtggcagctggcttgtgaagggaatattgctcacgttgtggtgatgcccagtgtcaacattgacaagctagactatttcctgaatgagttagttgagaaacgagcgacttggtaccaggatgggataagccagccaccctgcattgccagagacgtaggtgttgagaactgtctctgtggccttcacaagtagcgagccttttgctttgcaagtgggttcattcttgagtcgagttaaaagtgttatgttgtactgtgttcattcttgagttgagttaaaaagtgttatgttgtactgtgtccatgcgttctgcttctgtgttgtccacagtgtagcttatttgttgccatgggaataaaattccttctattaaattgaaaaa

SEQ ID NO: 551 - DNA, 1668 bp, Glycine max
  CDS (94)..(1542)
cgctttattgcatctcagaggccaattctttcgccgcttcttctctctttccaacgcttccccctgtggtgttctcgtgttgctggtaacaatatggttgttgacgctttgaatgaggatttgagaatcaacggagcagttgaaccgttgcctgaggactttgatgcaacagctgtaatcatagatcccgtgcctttggcagttgtagacaatggcattgtcaaggaggaggcgcagatcattaaaggaaaagagaaaagagaaatagtactgggaagaaatattcatacctcgtgtctagaagtcacagagcccgaggcagatgatgaggtcactggggaccgggaagctcatatggcaagtgtgttggccagatacaaaagagctttgactgaaaggacaaagcatcatttagggtacccctataatttggatttcgattatggtgcgctcacgcaacttcagcacttttccataaacaaccttggagatccatttattgaaagcaactatggtgtccactcccggcagtttgaagttggtgttttggattggtttgcccgattgtgggaactggagaaaaatgagtactggggctatataacaaactgtggtacagaaggcaatctccatggcatcctagttgggagagaggtctttccagatgggattttgtatgcttcacgggagtcacattattctgtgtttaaagctgctcgaatgtacagaatggaatgtgagaaggttgatactctttggtctggggaaattgattgtgatgatttcaaggccaagcttcttagtcaccaggataagccagcaattataaatgtgaacataggtacaactgtgaaaggggctgtggatgatcttgatctggtcataaaaaaacttgaagaagctggattttcgcatgacagattctacatccattgtgatggggctttgtttggtctcatgatgcctttcgtgaaacgagctccaaaagttacttttaagaagcctgttggcagtgttagtgtttctggccacaaatttgtagggtgtcccatgccttgtggtgtgcagataacaagattggaatatgtaaatgctcttgccagggatgtggaataccttgcttctagggatgccacaatcatgggtagtcggaatggccatgctcccatattcctctggtataccttgaatcggaaaggatatagaggttttcagaaagaagtacagaaatgcttgcgaaatgcacactacttcaaaggccgccttgttgaggctgggattggtgcaatgcttaatgaactgagcagcacggttgtgtttgagaggccacatgatgaggaatttatacgcaagtggcagttagcatgcaaggggaatatcgcacatgtggtggtgatgccaaacatcactattgagaagcttgatgattttctgaacgagcttctggagaagcgtgctacctggtttcaagatggcaaggatcaaccctactgtatatcatcagacgtaggtgaaaagaattgcctttgtgctttgcacaagtaattgcagcatcccatctagtgtttattgctgtagttggtttttggagtgtttatccagtgtacgtcactatgttctatcaggactttgatgcaattaataacatttagaatcttctttgctgtc

SEQ ID NO: 552 - DNA, 1800 bp, Zea mays
  CDS (71)..(1525)
cggacgcgtgggcccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcaccgagcgctgcctcgactggggcgaggcgggcggccccgacctcatcgtcgacgacggcggcgacgccacgctgctcatccacgagggtgtcaaggccgaggaggattacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcacacggcttgcagctcactcgggccgttgtgtgctatgaagttcgctacactggcctgtcagttatcttttgcatgcatatgcattatcatatacgcagtcgcgtagcaggttttcttatggttatcgcttgagctgaggggggagggaaggagctgtttgcttttgctgaagaataatggtgtagtcggctggggtgaggcgatgtgcgttgccagatacagttttgtcttgttgactctacttatctgattatcatttgtaagcgatt

SEQ ID NO: 553 - DNA, 1823 bp, Saccharomyces cerevisiae
  CDS (567)..(1589)
tataaattaattatgttttatttgtttgcgcgattgctttcttgcctgtttttccgcaacatagttacagctaaacatttgcccaaaaccatcttcttatatatatatctgcgatggcgagcccagcggaagggatgtccgcttactaattccgacacaccggtttaaccccccggcgtgctggggtgggtgcccctaagggagcgggttctgtacttccagtaagcggcatttgcgctgtcatcgccttatcgaacccgctactgagatcatgtcctgagtgggtgagtcgcacgcccaatcggctgcacttcagagatacttacgtccaatttcgcatcatgccaatattacctgtggaagttgaaactttttttgcagatgccgataattttcacatggatgagtcgcagtgtcgtcgtacgtgatgagggcaggcttgaaaattattcttcgagcccaattctctttacttataggcatgccatgtctaattaggtagtcatctcagtttatcttgtgcagggtagaaccaaagataacagcaaaagaaagagcaagcaattatgaccgcaccattggtagtattgggtaacccacttttagatttccaagccgacgtcacggctgaatacctggccaagtattctctaaaggaaaacgacgcaattttggtcgatgccaaatcaggcgatgctaagatggctatttttgacgagctcttacagatgccagaaacaaagcttgttgcaggtggtgctgctcaaaacactgctagaggggcagcatacgttttgggcgccggccaggtggtgtacttcggttccgtcggtaaggacaagttcagcgagagattgcttaacgaaaacgaaaaagctggtgtcaagtctatgtaccaagttcaaaatgatattggtaccggtaagtgtgccgcattaatcactggccataaccggtccttggtcactgacttgggtgctgccaatttctttactccagaccacttggacaagcattgggacttggtcgaagcagctaagctcttctacatcggtggtttccacttgaccgtgtctccagacgctatcgttaagttgggccaacatgctaaagagaacagcaaacctttcgtgttgaactttagtgctcctttcattcctcatgtcttcaaagacgcattggccagagttttgccttatgctaccgtcatcatcgctaacgaatcggaggccgaagccttttgcgacgccttccaattagactgtgccaacactgatttggaagctattgctcaaagaattgtcaaggactctccagttgaaaagactgtcatcttcacccacggtgtcgaaccaacagtggtcgtgtcctccaagggtaccagcacatatccagtcaaacctttggactcttctaagatcgtcgacaccaacggtgctggtgacgccttcgctggtggctttatggctgggttgactaaaggtgaagatttggaaacctctattgacatgggtcaatggctagctgctttgtctattcaagaagttggtccctcttacccttccgaaaaaatatcttactctaaatagattcttcttacaatataatagaaataaaatatactctacgtgttccctctagcttttcattcgtagacatgtttaccgcttgttcttaaaccaaataagccaccgttaccacaataaggaaaagaggcgctataaagtacagcttcaagaaaaaaggacaagcagcgctaagaacaaaatactcgttcatcctctccacatacggccgtacacaagcaacaataacacaataat

SEQ ID NO: 554 - DNA, 1531 bp, Zea mays
  CDS (264)..(1289)
ccaaaggaggcggccggccgtgcccacatgtcacggaaatcatgtagcatcaccgtgcgtacgtccaccaaccaccgtcgaacacgaggagggtgacaggtgggccatccgaggtttgggcgagccaaacaaaaaccctcttcacaccggtcaccacttcatctcgcccacacgaactcgagacctcgcccgcccaaatacgaaagcctcagatctcagtgaccagcgccgccgcttcgttcgtgtcgaggggagaagaggaaatggcggcgagcgagggcgtgctcctggggatgggcaaccccctcctcgacatctccgccgttgtcgatgacgccttcctagcaaagtatgacatcaagctgaacaatgccattctcgctgaggagaagcacttgcctatgtatgatgagttggctagcaacagcaatgttgaatatattgctggaggagccacccagaactctatcagggttgcccaatggatgcttcaaactcctggtgcaacaagttacatgggatgcattgggaaggacaagtttggtgaggagatgaagaaaaatgctcaagctgcaggagttactgctcattactatgaggatgagactgctcctactggcacatgtgctgtatgtgttgttggtggtgaaaggtcattgattgcaaatctgtcggcggcaaactgttacaaatctgagcatctcaagagaccagagaactgggcactagttgagaaggcaaaatacatctacattgctggatttttccttacggtgtcacctgattctatccagttagttgctgagcatgctgcaacaaataacaaggtgttcctcatgaacctctctgctcccttcatctgtgagtttttctgtgatgcccaagagaaggtcctcccgtatgctgacttcatcttcggcaatgaaaccgaggcaaaaatcttcgccaaagttcgaggatgggagacagagaatgtcgaggagattgctttgaagatctctcagcttcctttggcttcaggcaagcaaaagaggactgctgtgattactcaaggcgctgatccagtggttgttgctgaggatgggaaggtgaaaacgttccctgtgatcctattgcccaaggagaagcttgttgacaccaacggcgcaggtgacgctttcgtcggaggctttctctctcggctggtccagggcaagagcatcgaggactgcgtgacggctggttgctacgccgccaatgttatcatccagcgcccaggttgtacctacccagagaagcctgacttcaactagtgcaatactcaggcacgttacgagcggttcggcgtgtacactcccctgtatcctttccggtccggccaattttttgtcgccgtgatatttgttcagcaactatggacgacgtcgcctctgttctgtacgaggcatggtttgccatcattattctgttagcttcggcgatgcttgcaatgcgacgagaatgcgttggaaccatatatgcaatgcaaagttagcaaaaaaaaaaaaaaaaa

SEQ ID NO: 555 - DNA, 1358 bp, Glycine max
  CDS (90)..(1112)
attcggctcgagctcattctcattcgttcactgtcactttacccaatcctaacactttcttctctctgttttccttcttcctcgcatcaatggagttggacggcgttctcctcggcatgtgcaaccctctcctcgacatctctgccgtcgtcgacgacgctttcttgcaaaaatacggtatcaagttgaacgatgcgattctcgccgaggataaacacaaacctatgtatgaagaattggctaacaatcctaatgtggagtacattgctggaggtgctactcagaattcaatcagggttgctcagtggatgcttcaagcaccaggtgccacaagttatataggttgcataggaaaggacaaatttggagaggagatgaagaagaaatgtacactagatggtgtaaaggttaactattatgaaatcgacaatacacctacaggaacttgtgctgtttgtgtggttggtggtgaaaggtcccttgttgccaacttatcagctgcaaattgctacaagtctgagcatttgacgagaccggaaaattgggcattagttgaaaaggccaagtattactacatttctggctttttcctcactgtatctcctgattccatacaattggttgctgaacatgcagctgcaaataacaagatcttcatgatgaacctttctgctccctttatatgtgagttctttaagggtgcactggacaaagttctgccatatatggattatgtttttggaaatgaaactgaagcaagaacattttctaaagctcaaggctgggagactgataatgttgaagaaatagctttaaagatttctcaattgccaaaagcatcagaaaaacataaaaggattactgttatcacccaaggtgcagatcctgtttgtgtcgctgaggatggaaaagtaaaattgtatcctgtgatactattacctaaagagaaattaattgatacaaatggagcaggagatgcttttgtgggaggatttctttcgcaattggttaagcagaagcccattgaagaatgtgtgagagctgggtgttatgcagccaatgttatcatccaaaggcctggctgcacatacccagagaagcctgattttcattaagtgatttctccttttctgttactgctatgaattattattattattttttatcattgagaagaattttaacagccacactctaactggtgtggggttttttaatcccccgtctagggaaaacaacgtgaaaaagttgcaggaaaagagataaaacttgaataagttcatatatttgaagtccgatcaggcatcaattctcaaaaaaaaaaaaaaaaaaaaaaaaaaaaaaaaaaaaaaaaaagt

SEQ ID NO: 556 - DNA, 1101 bp, Synechocystis PCC6803
  CDS (86)..(1087)
tccggtaaattaatctaaccattgtcagtcaagccattctgccctaggataacattcgttataaagtggaatccgtgaggttgcaatgggtcacaaatacgatgtctatggcatgggaaatgccctggtggatatggaatttgaggttaccccagagcagttggccagcctaggcattgataaaggggtgatgaccttggtggaagaggccagggaaaatgaattaattgcccaattggcccaacagcgtggcaagcaaagcagtggcggatcagcggccaatactctggtgtccctggcccaactggggggtacgggtttttatgcctgcaaagtgggtaaggatgaagcgggagccttttacctccaggatttgaacgattgcggcctcgataccaatccccaccatgaaaccgctggcgaaggcattacgggcaaatgcttagtgtttgtcacccccgatgctgaccgcaccatgaatgcttttttgggcattagtggcagtttgtccgtaaccgaaatggattggtctgctttaaaacagtcccaatacctttacctggaaggctatctggtcacttcccccagtgccaaagcggcctgcattgaagccaaggcgatcgccgaacaatccggggtgaaaacctgtctatccctatccgatcccaacatggccaaattttttcaagacggtttaaaggaaatgctggggtcaggggtagatctactattcgccaatgaagcggaagccctggaaatggccggtacttcagacctcaaccaggcgatcgcctactgtaaaagtattgccaaaaactttgccctgaccaggggcggagcaggctcactaatttttgatggtgagaatttattgaccattggcacccccaaagtccaacccatcgatacggtgggagcgggggatatgtacgctgggggatttttatatggcctaacccatggcatggactatgaaaaagctgggcaattggcttcggaaacagccgccaaagtagttacctgttatggtccccgcctagacacagaaattctgcaagagattttacagtctgttcaagcagtttagaacaaaaagctact

SEQ ID NO: 557 - DNA, 1832 bp, Zea mays
  CDS (38)..(1492)
attcggctcgagcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagacccttgaggagtactggtggtgcaccgagcgctgccttgactggggcgaggcgggcggccccgacctcatcgtcgacgacggcggcgacgccacgctgctcatccacgagggtgtcaaggccgaggaggagtacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcactccctgatggtctgatgagggccaccgacgttatgatcgccggtaaggttgccgtggtctgcggatacggtgatgttggcaagggttgtgccgctgcactcaagcaggctggtgcccgtgtcattgtgaccgagatcgaccccatctgcgccctccaggctctgatggagggtcttcaggtccttcccttggaggacgttgtctcggaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcagccagcacacggcttgcagctcactcgggccgttgtgtgctatgaagttcgctacactggcctgtcagttatcttttgcatgcatatgcattatcatatacgcagtcgcgtagcaggtttccttatggttatcgcttgagctgagggggagggaaggagctgtttgcttttgctgaagaataatggtgtagtcggctggggtgaggcgatgtgcgttgccagatacagttttgtcttgttgactctacttatctgattatcatttgtaagcgatttgctcaagttatttgtcgtttatgaataacttgctttcctcaaaaaaaaaaaaaaaagg

SEQ ID NO: 558 - DNA, 2001 bp, Saccharomyces cerevisiae
  CDS (142)..(1491)
aagccgtattttagattttccaatctcttatttagtaacgtggtttattaactccatgattccattcctatttgtttttctttctttctgaaaatcctcttctcctcgaaataacccaactgacaaaaagaacaattcccaatgtctgctccagctcaaaactacaaaatcgctgatatctctttggctgccttcggtagaaaggaaatcgaattggctgaacatgaaatgccaggtttgatggccatcagaaaggcttacggtgacgtccaacctttgaaaggcgcccgtattgctggttgtttgcacatgaccattcaaactgctgttttaattgaaactttagttgctttgggtgccgaagttacctggtcctcttgtaacatctattcgactcaagatcatgccgccgctgctattgccgcttccggtgttccagtttttgcctggaagggtgaaactgaagaagagtatttgtggtgtattgaacaacaattgtttgccttcaaggacaacaagaaattgaacttgatcttagatgatggtggtgatttaaccactttagttcatgaaaagcaccctgaaatgctggaagactgctttggtctttccgaagaaactaccaccggtgttcaccacttatacagaatggtcaaagaaggcaagttaaaggttcctgccattaacgttaacgactccgtcactaagtccaagtttgacaacttgtacggctgtagagaatccttagtcgacggtattaagagagccactgatgtcatgttggctggtaaggttgccgttgttgctggttacggtgatgtcggtaagggttgtgctgctgccttaagaggaatgggtgctcgtgtcttggttaccgaaattgacccaatcaacgctttacaagctgccatggaaggctaccaagttgttaccatggaagatgcatcccacattggtcaagttttcgttaccaccactggttgtagagatattatcaacggtgaacatttcatcaacatgccagaagatgccattgtttgtaacattggccatttcgatatcgaaattgatgtcgcctggttaaaggctaacgctaaagaatgtattaacatcaaaccacaagtcgaccgttacttgttgtcttctggtagacacgtcatcttgttggctaacggtagattagttaacttgggttgtgctactggtcactcatctttcgttatgtcttgttccttctctaaccaagtcttagctcaaattgctttgttcaagtctaacgataagtctttcagagaaaagcacattgaattccaaaagacaggcccattcgaagttggtgtccacgttttgccaaagatcttggatgaagctgtcgctaagttccacttgggcaacttgggtgttagattgactaaattgagtaaagtccaatctgaatacttgggtattccagaagaaggtccattcaaggccgaccactacagatattgatcaattcaattcccatttcagttcttctttctcactattttttaatgttcaaaaactcaacggtttgatcatcaaaaaagatcataaataaattgcaaatataaaaacaacagctaacaatcctatcacagtattaatactaatacatgtgatactaagttacgttatcgaaaagatagatcctgtatacctatatatataataaattcttcaacagtaaatatttcattcatgcacttgactttttttcataaataagggcacgtacactaaaaaagctacatttctctcagataatgagtagggcatgcatatccctgtggattcttatctaaatataactggtggtattcttcagcatcgtaaaagttcttgattggttcaataactgtggcaatcttattaccccattttggttgccattcttcctttattttggctaattcttttaaatcagcatctgaatgagcgaacaatccactgcgatactgtgtacctttatcaggtcct

SEQ ID NO: 559 - DNA, 2001 bp, Synechocystis PCC6803
  CDS (305)..(1582)
ttccagtgatgacaatgagtgcatttcaacttttctccgagaggcgaattataactcccattatcacatttccaaatagtgccccaaggagttgcttgaaaagtcccctggccccaagcctagggggataggtttaaagttctgcagggttgccagagctttggtaggaaaatttaggatcagattagagctttgcctacctgcgctaaccgtctgtcaatggacaaaggggcgatcgccattccagaccgataaaatgttaagttatatcacattcaagcaaagttcttaggaattaccccgtatggtagcaacgcccgttaaacagaaatacgatattaaagatattagcctcgctccccaaggtcgtcagcgcatcgaatgggcggcccgggaaatgcccgtgttaaaacaaatccgggaacgctttgcccaggaaaaacccttcgccggtatccgcttggtggcctgctgtcacgttaccaccgaaaccgctaacttggcgatcgccttgcatgctggtggcgctgattctttgctcattgccagtaaccccctgtccacccaagacgacgtggccgcctgtttggtagccgactacggcattcccgtttacgccatcaaaggggaggataatgaaacctatcaccgccatgtgcagattgcgctggatcaccgccccaacatcatcattgacgacggtagcgacgtggtagccaccctggtacaggaacggcaacaccaactcagtgacatcattggcaccaccgaagaaaccaccactggtattgtgcgtctgcgggccatgttcaacgatggggtactcaccttccccgccatgaacgttaacgatgcggacaccaagcatttttatgacaaccgctatggcaccggccaatccaccctggacggtatcatccgggccaccaatattctcctggccggtaaaaccattgtggtggctggctatggctggtgtggtaaaggagtcgccatgcgggccaaaggcatgggggctgacgtaattgtcaccgaaattagtcccgtaccggcgattgaagccgccatggatggtttccgggtcatgcccatggccgaagctgcccaccagggagacatcttcatcaccgtcaccggcaacaaacacgttattcgtcctgagcattttgccgttatgaaagatggggcgattgtttgtaactccggtcacttcgacattgaaattgacctcaaatccctcaaggaacaagccaaggaagttaaggaagttcggaacttcaccgagcaatacattctccccaatggcaagtccattattgtgattggcgaaggtcgtttagttaacctggccgccgccgaaggtcatcccagtgcggtgatggatatgagctttgccaaccaggccctagcctgtgagcatttggtcaaaaataaaggtcaactagaacctggcatgcactccattccggtggaagtggaccaagaaattgcccgcttgaaactccaagccatgggcattgccattgacagcttgacccccgaacaggtggaatacatcaattcctgggcttccggtacctaaaaccgtttacggattcattttttacctaaaaccccttcaatctcccatatttcgggggatttttttatttttaggcaggccatagacgcaatgcccataattccccaggctaagttttcaatcccccaatgttaggatttgcggatatcctctagtgggggatggtgatcggctgggcctccaaactaaccagaaattacccgacgcaggtccatcacatcactcatatttttaattttggccatgatgcccaatagctgttgatagtcgtgaatatcaattttgagactaataatggcgggtcgtcccaaatgggttttaacatcggcgttgcggacgttaatgtggttgtcgctgaggcgagaaagaatatccttcagcacccctacccggtcaatggcttcaatgacaatgtccac

SEQ ID NO: 560 - DNA, 2031 bp, Zea mays
  CDS (316)..(1644)
ccacgcgtccgccaaaagtgaactgtgaaccggacgatccaggcatccagctaaccgcttccccctcgtcgcgctcgcgccgcgccgcgcctcgcctccaccagctacgccgtcacgcgagctcacggcccgggggcctcggaagcacaaccaccacgcgtccacgccgaagccacgaggagagcctgtctctcctccggggattctatcgccggctggtctcagcggcgccacttggagcaggcggcacccgctccgtactgctgctgatttggtgagcgcgggcagccgcgggatgggagatctggtggcgtgatggtgagcccgggcagtaaccggggcggcctgtcgcgcgtatcgacgcggggcggcgtcgccgggccggggagcccgcgcgcctctcctgccgcgaccgctttcgcggcgctacggcgcaggtggcggtgggcgcccccgggctcgtcgacgctggagcgcgcggcccgcgcgttcctgctggcctccgcagcgctcgtgctctcctgcgcgctctacctctacgtgctgcgctacgtcggccggggaggtcgcgccttcgccgccgcgggcttcgtcggggacgccgtcctgggcctcggcggcgagccgtgcgacgtgttcgacggcgcctgggtgcccgacgacaccggcctccgcccgctctacaatagctccgggtgcccgttcgctgagcgcgggtttgactgcctcgccaacgggcggaacgacactgggtacctcaagtggcggtggaagccgcgccggtgcggcgtgccgcggtttgcggcccgcaccgcgctggagcggctgcgcgggaagcgggtggtgttcgtgggggattccatgagccgctcgcagtgggagtccttcatatgcatgctcatggccggcgtggatgaccccaggacggtcttcgaggtgaacgggaacgagatcaccaagacgatacgccacctggcggtcaggttcgcgtctcacggcctcaccgtggaattcttccggtccgtgttcctcgtgcaggagcatcctgccccgcggcatgcccccaagagggtcaaatccactttgaggcttgacaggatggataatttcagccggaaatgggtcaattcggacgtactgattttcaacactgggcattggtggacaccgaccaaattgtttgatacgggttgctattttcaggctggacgttctcttaaattaggtacatccattgatgctggtttcaggatggcactggagacctgggcctcatgggtacaaaaaagagttgatttaaaccgaacacatgtattctttcgcacatatgagccatcgcattggggggatacaagccaaaaggtgtgtgaggtaacagagcagccttcatcagaggccaaaggaaatgataagagtgaatttggggctatacttgctgatgttgtaaccaacatgaaagttcctatcacagtactaaatgtaactttaatgggatcgtttcgaagtgatgcacatgttggcacttggagttatcctcccactatacttgattgcagccactggtgtcttcctggagtccctgatgcttggaacgaactcgtgttttcgtaccttttgacaaatggttggcgaaacatggcgggctgaattttttggcagcacaatctacccgcacctattgcattgtgatatttgacattaccaggtatactagagaattaacatacgtccgggacaaggcagctgcagctgctaggtggttcactggacttctacattcttttcttctttttgatttttgactcgtatacacggtgaagcatgctacatgcaactagagttgtatgtagttggtaagggattagaaggccttggcattcgttctatttgctcaatttactaacggttcattttattatgttgttaaaaatcgagtttgtattgtaacctgtatgtacaaacatttacttgatacattgtgagaaagtgccctctctcaattggattgataaaaaaaaaaaaaaaaaaaag

SEQ ID NO: 561 - DNA, 1686 bp, Zea mays
  CDS (334)..(1512)
gtcctgcccacgcgacgcgagagcgggagcggtgggtcgagtgacgagctggaccccgccgctagtcccctacccctgcctgctcccccccgcctgccccgtgtttatatctgccgcgccgcacagggagagagtcgagtccagctcggcaggtcagtcagtagtggatagctccgctcgcggtcgcgggcggctcgagtcgcaccccagatcccaatgcgccccgccgcgccgcactaggccgcggaacggaagctaggtgcgtcacacgccggggccggtcgcggtcaccggaccggacgcacaggggcgccgtacgtgcagtcatcggccatgaaggtcctcgtcctcgccgtgctggcgctcgtcgccgccgcctccgccgctggtcagggcgaggaggggggcgggccgccgctgccgttcgcgttgggcgcggcgccggcgggctgcgacgtcgcgcagggcgagtgggtgcgcgacgacgacgcccgcccatggtaccaggaatgggagtgcccctacatccagccgcagctgacgtgccaggcgcacggccgccccgacaaggcgtaccagagctggcgctggcagccgcggggctgctcgctgcccagcttcaacgcgacgctgatgctggagatgctgcgggggaagcggatgctgttcgtgggtgactcgctgaaccgggggcagtacgtgtccctcctctgcctcctgcaccgggccatccccgacggcgccaagtcgttcgagacggtggactcgctgagcgtcttccgggcgaagaactacgacgccaccatcgagttctactgggcgccgatgctggccgagtccaactccgacgacgccgtggtgcactccgccgacgaccgcctcatccgcggcgcgcccatggacaggcactacagcttctggaagggcgccgacgtcctcgtcttcaactcctacctctggtgggtcgccggggacaaaatccagatcctgaggggcgccgacaacgacccgagcaaggacatcgtggagatgaagtcggaggaggcctaccggctggtgctgcaccaggtggtccggtggctggagcgcaacgtggaccccggcaagtcacgggtgttcttcgtcaccgcttcgccgacgcacacggacggcagagcgtggggcgacgacgacgcggagggcagcagcaactgctacaaccagacgtcgccgatcagcgccgcctcgtcctaccgtggcggcacgagccgggagatgctgcgcgcaacggaggaggtgctggccacgtcgcgggtgcccgtcgggctggtcaacatcacgcggctgtccgagtaccgccgggacgcgcacacgcagacctacaagaagcagtgggtggagccgacggccgagcagcgcgccgaccccaggagctacgccgactgcacgcactggtgcctccccggcgtgccggacacgtggaacgagctgctctactggaagctcttcttccccagcaacgatcaggtcctctgatggtgaattggtgcctgcatacatacgcctggaaaccaactgctaggggctagcccaaagaaaatgtgtctagatgaacaaagacatggggttcaaatgttttgttttgatttcggatatggacgctgtcgatgctcttgttctctgtggaattcttcttaccaaaaaaaa

SEQ ID NO: 562 - DNA, 2069 bp, Zea mays
  CDS (263)..(1552)
cccacgcgtccggcaagcttcggcctcacctccagcggcaggtggtgctgcggagcttctcctcgccctagatcccgcgcacccaacgccagatcagagatcagggcgcgccggccgtctccattgcccggcggatcctgcgatgcgagctggaccgagagggaggagcgagggagcgcgcgggtagagaaggcggggcggggggaggaaggaaggaaggagcgccggccggagcagacgtcccctcggggccctcggtcggatgagatcgacgatgaaggcgcagcacgccaacgggcgggggagcaggagccccttcctgacgtcctacgcgctcacgctcgccttcatcaccttcgtctccgtgctctactttaaggacttctcctccacgctgcaccgccccttcctccaccgcccccgccgccacgccgccccagacaaaagccaggcggggcgccgcgcggcggcggagcggctgccgttcgcggtgggcgcggcgccggcggggtgtgacgtcgggcgaggggagtgggtgtacgacgacgcggcgcggccgtggtaccaggaggaggagtgcccctacatccagccgcagctcacgtgccaggcgcacggccgccccgaccgggcgtaccagcactggcggtggcagccgcgcgggtgctcgctgcccagcttcaatgcaactctaatgctagagatgttgcggggtaaacgaatgttgtttgttggagattctctgaaccgtgggcaatatgtatctttggtttgcctcctgcaccgaatcatccctgagagctccaagtcaatggagacagttgattcccttacagttttcaaagcaaaggactacaatgccaccattgagttctattgggctccctttctggccgagtcgaattcggatgatgctgttgtgcaccggatcgcggatcggattgtaagagggacatccattgagaagcatgccaagttttggaagggggctgacatcttggtattcaacacctacctatggtggatgactggacaaaagatgaagattttgcggaactccttcgaagataaaagcaaggatatcatagagatggaaacggaggaagcctatgagatggtacttaatgctgtgctgaaatgggtggagagcaacatgaaccccaggacatcaagaacattctttgtcactatgtcacccacccacacaaggagcagagactggggcgatgatactgacgggaactgctacaaccagacagcccccatcgaggacctgtcctactgggggccagacaccagcaagggcctgatgcgcgtgatcggagaagtgttcagcgcgtctaagtccaggatccccgtgggggttgtgaacatcacccagctctccgagtacaggaaggacgcgcacacccagatatacaagaagcagtggaacccgctgaccccggagcaggtcgcggaccctaagagctacgcggactgcacgcactggtgcctgccggggctccaggacacgtggaacgagctgctctactccaagctctttttcccctgagttaaagggtttgagttgcgaggtgcacggtgaagttggggtctctctctggcattattggcacgctgcacaatactagttagcttggcataggcccagcagtctgaagatggatgctctgcctctgctgcggtagtttctcgggggcaaaccttccacgcggcatggcatggtattgttgatgtacgattcattcgttggaaaacctggacgtgagtgctggaattgcaccatctggccttttctgtacatgcctgatgtaacggtggtgttgtgtttccccaccaccacctctcttttcacgatgatgacgcagtgcatgtataattgtatgggttaatgacgcagtgcatgccttgcggagtgggccggtagacaaacatttcggcggctggtcacttggtcagtgacccgttgatattattattattattggatctaatgcaacaaccagttctggtgttggtgtccaaaaaaaaaaaaaaaaaaaaaaaaaaaaaaaaaaaaaaaaaaa

SEQ ID NO: 563 - DNA, 1499 bp, Zea mays
  CDS (202)..(1419)
cccacgcgtccgcccacgcgtccggcggtgagcccggccaccagcgccggaggccgtcgtcgtcttactagccgacgctcgacttgggcatgaattgctagccgcgcgggtgagagattgctaggtagccagctaggtacggtgtggggagttgaatcggaggtctgccgctcgaggcggcggcggcagaaggccggtaggatgaagaagctccactggctggtgcggttcctgttcgggccggtgccggtctacttctcggcgctggccatcctcatcgtgctcaccaacgcgcagtacttcgggctggtgggcgtcggcgtggcgccgcgcaccgcgaagctggcctcctcggcgcccgtggtcagcgtcatgaagtactgcgacatcttccgcggcgagtgggtgccggacgcggaggcgccctactacaaccacaagacgtgccacatgatccaggagcaccagaactgcctcaagtacggccgccccgacctgggcttcctcaagtggcggtggcggccctccggatgcgagctgccgcgcttcgacccgctgcagttcctgcagttcgcccgcgggaagtcgctggccttcgtcggggactcgctggcgcggaaccacatgcagtcgctgctctgcctcctgtcccaggtggcgtatcccaaggacctgtcggcgaacccgtcggaccagaacaaggtgtaccactaccgggcgtacaacttcaccatcagcatgttctggtcgccgttcctggtgcgcgcccgggagcccgaccacgacggccccgcgcacacgggccactggagcctctacctggacgagcccgacgacaagtgggtgtcccagatgccccgcttcgactacgtgctggtgtcggcggccaactggttctcccgcccctccctcttctacgagcggcggcgcctcgtcgggtgcagcttctgcagccgccagtacggcgtgcccgacctgacgctctactactcgcagcgccgcgcgtggcgcgtggcgctgcgcgccatcaacgacctggagcgcctgcgagggcgcgtcatcgtgcgcatgctctccccgatgtcgcacttcgagaacgggacctgggaccacggcggcgactgcaggcgcacgcagccgctgcgggcgaaccagaccgccatggagggccgcgacctgcacttctacaccgcgcagatggaggagttccgcgccgcggagaaggccgccgccgagaaggggcggcgcctgatgctcatggacgccacggcggcgatgctgatgcggcccgacggccaccccagccgctacgggcactggcccaacgagaaggtgcagctctacaacgactgcatccactggtgcctcccgggacccatcgacatctggaacgacatgctcttccagatgctcctcgcctagcagcaagcagcaaagattaaaaaaaaaactcagcaattcggtcgccaaaaaaaaaaaaaaaaaaaaaaaaaaaaaaa

SEQ ID NO: 564 - DNA, 2492 bp, Zea mays
  CDS (316)..(1980)
  unsure (1)..(2492): unsure at all n locations
cacgcatccgcagccgccggaagcaagcaagagctgcgactgcgagcaggctgtattaagcgaagcgacgacctccgttccattgcgaacaggctacatacagatcagagtgaggaagaagaggaagccgaatttcttttcactcttccgactgacctttcgcgggtgcgcacgccacctcgggtcgggagcgcgtcgatcgagtccgtggcggtggcggcgtgggacggtgaccggtaagtttgtacaatataaagcgcggcggccacacagtcacacacactgacacacacacaccagctgggagctscggagatgcancagcggcgcaagtcggtgttcgcgtccgcgccgttcgcgatgaagcaggcggcgctgggagccggcgtggcggcgcgcaagaacggcgcgccgctgtcgctggccgcggtggtgttcgcgctcttcgtcttcgcgacgttcctctacaacgaggacatcaagtccatcaccgacttccagttcagctccggcgccatccgcgccaagtcccccgacctgcacctcctgcaggaggccgaggccgcggcgcacgccgccgtgaacaccctggccaagcgcggggaggaggtgatcgtgcgcgtcctcgaggtcgaggcgccgcccgtcgtcaacactagcagcgtgctggcggccgccgcgaaggccagcgccaaggccaacgcggtggacgtggggcaggagaaggagcgggacgtgacgctcccgacggtgacggggggccgaggcggggccgacgaggcccggcggcgcgctgacgaggaggtcgctgagaaggccgcgtcggcgaaggcggcggcggccaccgccgctctgcgcggcgtggtgagcgtgccgcagacgtgcgacctgtaccggggcagctgggtgtacgacgaggtgagcgcgccggtgtacaaggagggcgagtgcgagttcctgacggagcaggtgacctgcatgcgcaacgggcggcgcgacgactcgtaccagaagtggcggtggcagccggcgggctgcgacctgccgcggttcgacgcgcggctgctgctggagcggctgcggaacaagcggctgatgttcgtgggggactcgctgaaccggaaccagtgggagtcgatggtgtgcctggtgcagtcggtgatccccgacagggggcagaagacgctgacaaagttcgtcaacggcgggtccagcaacgtgttctacgcgcacgagtacaacgcgacggtggagttctactgggcgcccttcctggtggagtccaactccgacaaccccaaggtgcacagcgtccccgaccgggtcatccagtggcacgccatcgccaagcacgcgcgcaactggatcggcgtcgactacctcgtcttcaacacgtacatctggtggctcaacacgctcgacatcaaagtcctgaagcaggggtcgtccttcgatgaccagggctccaccgactacgtggaggtggaccggcccgtggcgtacaaggaggtgctgacgacgtgggcgaaatgggtggaccgcaacatcgaccccaacaggacgaccgtcttcttcatgggcatgtctcccaaccacatcacgcctgaggcttggggcaacaagggcgggatcaagtgcgccatggagacgctgccgatcgcgagcaaccgcagcgcggcgctggacgtgggcacggactggcgcctctacgcgggggcgcgggaggtgctgcccacgctgcgccgggtgcccgtccacttcgtcgacatcaccgcgctgtcggagctgcgcaaggacgcgcacacctcggtgcacacgctgcgccaggggaagctgctcaccccggagcagcaggccgaccccaagacctacgccgactgcatccactggtgcctcccgggcctgcccgacacctggaaccagttcctctacgcccgcatcgcatccagcccatggcccaacgacgcccaggcccagcagtagggaccctgcacctgctcctccttctatcttcctcattcgccgcgggccggcgcctcacgacacaaaagggaggcctgggctgcaacggcccgcccatcgacgagagctctggcgtttctgcttcaagctagctgatcagccaaaagggggcgaaagacggcgtttctgctcgccgtctttgttttctttccttttttttaaacgatttttctttctcttttcgttgcataaaaggaaactggtccgtgttgttcaccttcgattctttggtccaaacacaagtggatggtctggggtaaatgagggtgtgacgagcttagttgctcgctcatttggtttcttctcctaccaacgatgcctagggggaaagcaagagttgagcatgaagatgtgatgggggagaagcaaagctggggggagtacatgtaaagaagaatttttgcgttgtatttttatatgctgctgcagtgcacccaaggttaagagaggtataaagagcatttgttctt

SEQ ID NO: 565 - DNA, 1876 bp, Arabidopsis thaliana
  CDS (75)..(1688)
tgaaatatcgtagtgttcataacgaaacgagcacacaactcactaaacactcaaacaaaaatacaaacattaagatgatgatgaagattagctttaacacatgctttcaaatcttactaggatttatcgtcttcatcgcatcaatcactttactaggtcgaatattctcaaggccttccaaaaccaaagaccggtgtcgccagcttcctcctggccgaccaggatggcccatcctcggcaatctacccgaactaatcatgactcgtcctaggtccaaatatttccaccttgccatgaaagagctaaaaacggatatcgcatgtttcaactttgccggaacccacaccatcaccataaactccgacgagatcgctagagaagcttttagagagcgagacgcagatttggcagaccggcctcaactttccatcgtagagtccattggagacaattacaaaacaatgggaacctcatcgtacggtgaacatttcatgaagatgaaaaaagtgatcacaacggaaattatgtccgttaaaacgttgaatatgttggaagctgcgagaaccatcgaagcggataatctcattgcttacattcactcgatgtatcaacggtcggagacggtcgacgttagagaactttcgagagtttatggttacgcagtgaccatgagaatgttgtttggaaggagacatgtcacgaaagaaaacatgttttcggatgatgggagactaggaaaagccgaaaaacatcatcttgaggtgattttcaacactctaaactgtttgccaggttttagtcccgtggattacgtggaccgatggttaggtggttggaatattgatggtgaagaggagagagcgaaagtgaatgttaatcttgttcgtagttacaacaatcccataatagacgagagggtcgaaatttggagggaaaaaggtggtaaggctgctgtggaagattggcttgatacgttcattacgctaaaagatcaaaacggaaactacttggttacgccagacgaaatcaaagctcaatgcgtcgaattttgtatagcagcgatcgataatccggcaaataacatggagtggacacttggggaaatgttaaagaacccggagattcttagaaaagctctgaaggagttggatgaagtagttggaaaagacaggcttgtgcaagaatcagacatacgaaatctaaactacttaaaagcttgttgcagagaaacattcaggattcacccaagcgctcattatgtcccacctcatgttgcccgtcaagataccacccttgggggttattttattcccaaaggtagccacattcatgtatgccgccctgggctaggccggaaccctaaaatatggaaagatccattagcatacgaaccggagcgtcacctccaaggagacggaatcacaaaagaggttactctggtcgaaacagagatgcgttttgtctcatttagcactggtagacgtggctgcgtcggtgtcaaagtcgggacaattatgatggctatgatgttggctaggtttcttcaaggttttaactggaaactccatcgagatttcggaccgttaagcctcgaggaagatgatgcatcattgcttatggctaagcctcttcttttgtctgttgagccacgcttggcatcaaacctttatccaaaattccgtccttaaaaacaagacgccttgttttttctctgtgatgtgtttcgacgctttgtcgtttctgtattacttgacgtactgttgtttttagactatccattgcccgaaaacgctatattgttaaaatcgtgtgtcttgtttattcttttgtatctccgtaacttaatcatgaatatcaatcaataccatatgaggtt

SEQ ID NO: 566 - DNA, 661 bp, Oryza sativa
  CDS (67)..(315)
tgctcctcaaacgagaccaagaaatcaatcgttccagcgaagaagaagaagaagaaggaggaatccatggcggcgaggacggtggcggtggcggcggcgctcgccgtgctgctgattttcgccgcctcgtcggcgaccgtggccatggccggccggccaacgcctacgacgtctctcgacgaggaagcggctcaggcggcggcgcagtcggagatcggcggcgggtgcaaggaaggggaaggggaggaggagtgcctcgcgaggaggacgctgacggcgcacaccgattacatctacacccagcagcatcacaactaattaatcttatcgatcaatcaataatcaatcaatcaatcagtcgcttcctcttcgatctaccaatactagtattggtatataattaaaactgcaaatccgtcatgcatgcatggtatgcccatcgatccatccatgattatctctagttagatgtagtaacaaactgcatgcgcgtgttgtgctcatcagtgttaattttggccgcccccctgttgataaacagttcttgatcgatgagagctagctttcgttttgttttgatttgttggttggttggttgatttgagagttgagacagatcgatctctgcttgaatggtacctgtcccaaaaaaaaaaaaaaa

SEQ ID NO: 567 - DNA, 795 bp, Oryza sativa
  CDS (107)..(463)
  unsure (1)..(795): unsure at all n locations
agcaaaatctcttctcctcctcctcctcctcctcatcatcatcctcctctcgcccttcgacaacgcaccatagtttaacccaagctagaagaagaagacgatagatatgagcactactcgcggcgtctcctcctcttctgctgctgctgctcttgcgctgcttctcctcttcgccctctgcttcttctccttccacttcgccgcagctgctcgcgccgttcctcgtgatgaacaccaagagaatggcggtgtcaaggcagtagcagcagttgcagctgatcagcttgtgctccagctggaaggtgacaccggcaatggcgacgaggtctccgagttgatgggagcagctgaggaggaagcagcagcatgcgaggaggggaagaacaacgacgagtgcgtgcagaggaggctgctcagcgacgcccacctcgactacatctacacgcagcacaagaacaagccttgatcgatcgatccatccatccatccatccaactacacgctgaaatccaaagctaatacaaggaagatcgagatcgagataaattaaccaactctatatgcatatctatctatccatctacctctgcatgctgtttttactgcatcgatcgctactgttctgcagtgccaatcactgtccgtttctgtacaatctgtgatactactagctagtagcagtacatggcatcgttttccttcaagtgttcgttgggcttttacttaggtccggtgagtgcttgtggggttatttctgacgaggggagtgtgatcagtaccgcgtactaannggat

SEQ ID NO: 568 - DNA, 708 bp, Oryza sativa
  CDS (102)..(368)
gaagaagcagcagcaaaaaagttgatcagttaattagcaagtgtgttcttctttcttttggtgagagagagagagagagagagagagagagagatctcagaatggtgaatccaggaagaacagctagggcactctgcctcctatgccttgctctcctcctgctaggtcaagatacccattccaggaagctcctgttgcaggagaagcacagccatggcgtcggcaacggcacaaccaccacccaggaaccaagcagagagaatggaggaagtacaggttccaataacaatgggcagctgcagtttgattcagccaaatgggaagaattccacacggattatatctacacccaagatgtcaaaaacccataatggctgttcatttatgatttgaactagtactagtagcttataccttctgcgcgtcttttgttcgtttggagaggggattttcttgggatttagcatatgaactaattaaattaaatcccaggcaaatcccactcagcccattttgtgcagaagttgtcagtgtgcactgtataattatttagtcatacacaactactcctggtaactactcctatcttcgatgaattttctggttttgccagacgtgacaatagtccagtagcatgcagtaccctctcagaatccctgtaatttttagcaaaaaaaaaaggaagaaaagaaaagaagcttccctact

SEQ ID NO: 569 - DNA, 681 bp, Oryza sativa
  CDS (9)..(314)
cgatagatatgaggccgactggtcgtcgttcttctccgccggtggctgctgctcttgccctgcttctcctcctcgtcctcttcttcttctcccactgcgcctcagctgctcgcccactgccagcatcagcagcagcagagctagtgcttcaggatggcgccaccggcaatggcgacgaggtttccgagttgatgggagcagctgaggaggaagcagcaggattatgcgaggaggggaacgaggagtgcgttgagaggaggatgcttcgcgacgcccacctcgactacatctacacgcagaagaggaacaggccttgaaatcttgaatcataatctccaagtcgatacaaggaggaattaatcagtagtaaacctacataaattaatctactatctgcagcctgttttcaactgcatgtatcagtgtattagtcgatctaggataatattttgcatgtgtactcaagtaaactgtcgtctgtataaccccgttatgtacatggttgtatttctttctccaaagtgttatcgaactctctgttgatctctgatacatctgtatgtgtagcatcagagaaaagatcgagcacttgtgggttatgatctgacgatcgagtgtatgaacagtgctaatggtgtagtaagtttttgcttaaaaaaaaaaaaaaaaaaaaaaaaaaaa

SEQ ID NO: 570 - DNA, 2709 bp, Zea mays
  CDS (417)..(2147)
ggagctggccgcgtcgtatcgactcctgccgccgaaaggccgagcccgagcccgtgtcccggtgcccgttcccgcaaccctaatcccctaccaccgtcggctctcgccggcgaagaagagggagccgcgcggcgtcgccagggagcacgcgccccctcccttcccggctccctccgcgccgtggggaggcgcgtccacccggatccgccctcaccgcgaggcagaggggaggagagggagccaggtccggcgcacccgctgtcgtccgcgccgaagagcgttaagagtctccccacaggcttggctgagggaaacttgtgctctgcgcatcttggacactacttcaccatttaccaagtcttgagttattgctccggtgccagacaaaaaaccaaactctctggccgaacacagtgatggcgcaagcctgtaagaagaggagaggagtttatataagcagtgaatcaggagactctgatacagattctgatgttgagggaagcaaacactctcaaaagtctggggtgacatcaatttctacatgcgagcaccagtcatcttataacctcaaggctgcaagtatgaaaagtagcaggatgataaggctgtgtggaaatatcgtaaggaagctcatcgatcacaaatgtggctggcttttcaaagaacctgttgatccagatctatatgggattccagactactttgatgttatccgcagtccaatggatttgggcactattaagaataaactcacaaaaaagaaatatgtaagcattgaggagtttgcagcagatgtgaggctaacattttcaaatgctatgaagtataatcctccaggcaatgatgtgcatatttttgctaaagaattgaatgaaatgtttgattcagaatgggaatcagtagaaaggaaatttagaggccgaaaccttggtcaagaccagcagacaatgaaggccataaaagttcgagctatgatggattcaaagtctacagttgctagagggccggttgcatgctcaaaccctaaaactttggttactagaggtccagtagcttgctcaaattcgattgcaaagaagacactgacagatgcattatcctccaaagtaaaaatcaaattttccgtgcgcagctctgcgcatacctcttccaaagatatactcgttcaagcagctggtagcaaagaggggtccttaaatcactctgtccctactggcaacaaagaggcatcttcaaattgtactattcctatcgctaaggaggctaaaatatcaagggcacgagaaattgagcgctgctctggttcaattggaaaacaatcatggtcttgcaatgacacttctacttcacctctcgcttcctctgtgcaaggtgaggaaagttaccttcatgatgaacctttgtcaccaagcagggctcttcgtgcagcaatgctcaggagtcgttttgctgggactatagtgaaggctcaacagaaggcacttctagatcatgggaagaatatagaccctgtgaaattgcaattggaaaaggagaggctggaaaagaggcagcaagaagagaaagcaaggatcgaggcccaggtgaaggctgctgaagcagctgcacaacaaaagtttgaggaagaaatgaggatgaagagaaagcaggaaagggaggcagcacgcctggcactacgcatgatgaagaagactgttgatattgacaacagtgacttcctaaaggagctggagaacttcagcaaaacatggcaggcaaatccacctggcaaattaatcgtggattttatcagtggggacttgccaccggggttagggagtccgctggagaggctcggcctcttcatgaaggaagatttcgaggatgaggtagaacaggaaatggaggacagagtgtcaccctcaatggatgttgacatcaggaaagatttccaggaagacttaggacatgaaatgcaggacagtgcatcacccgtgactgtcattggcacaaagaatgacgtacagggagtggcaggacatgaaatggaggacagcggatcaccagccacagtcattgacacgaagaaagaagagacagaacatgagatggtggacagcgtatcacctttgatggatgttgacacggaggaaggggagatcagctgctgacggtagctacacctctcttcacccgcataatttattgaggcagacatccttgcttggttgttagattaggcaatttcataagcagagtgatgcagaaacattagttttatctgctttcatcgtagaaccatgtggtgtggagaacatgtctcagacgaaatgacgagtggttttggatttgctgcggattttaattttcgtggtcttgtcagtctggcaagagtatgatgactctgtatgttgaatttgacctcccccgctggatgacatgtataaaaggatgagaaaaaaaggatagtttggagctagtgtatgttgttggagtttatggtggagccagatttggtgagcgtgtcgtggacgtaaatgtaggtatagctatatacttgaaatattgataagagtgtttggttcaaaggatcaattcattccagttaaacatcatgagcttgttaatgggtgtttggttcgagagttcgttaatgggtgtttggtttgaggaataagctagtctactattttttttatttggttgttgaatgtaattttttgacctgtc

SEQ ID NO: 571 - DNA, 1508 bp, Zea mays
  CDS (292)..(1269)
ctccctcccccgtccgccctgcactctccagctcaacaaggaagaagagggggccttcaccacaccactcgattcctctttagagcacgacttacgaagtgtgcccaggccgtcgccgccgaccagcaaaagggctggaaagcccccctcttttgtgctgtgcgtgcaactcggctcctgccctgccatcttgctttccaagacccctgcgcccccagtcccataattagttaggattaggatcaccaccatttccaaatccttgcagagctgccgaagcgcggatcacagatgaagaggcaatccaagaggcccaccgccagccgcgaatccccagaaacaggggagaagcagaagctggcgttcgcggaggaagaggccccgccggcgcggaaggtggagcccgacgacgaggccgagatggacgaggacgaggacgagctgggcccgggcctgggcggcgggcgcgcggcgcggtcgccgtgcgggctcggggagaagaagcggcgcctggcgctggagcaggtgcgcgcgctggagcgctgcttcgagacggacaacaagctggacccggaccgcaaggcccgcatcgcgcgcgacctcgcgctgcagccgcgccaggtcgccgtctggttccagaaccgccgcgcccgctggaagaccaagacgctcgagcgcgacttcgcggcgctgcgcgcgcgccacgacgccctccgcgccgactgcgacgcgctccgccgcgacaaggacgccctcgccgccgagataagggagctgaggcagaagctgctgcccaagccggaagccacggtgaagctggaggcgacgacgggcaatgacacggcggaggagcgccgccaggcgacggccggcgcgccgcccgcgggggcctgcaaggacggctcctcggacagcgactccagcgtggtcttcagcgacgtcgaggcgtcgccctactccggcggcgcggcgttcgagccgccggccttggccgggctcggcgcgccgttcctggacacgtcggtggcgccgacgggctgctcgtctccccccgttttcgtcgagaccaagtggcagcagcacgggccgacacagtacccgttcccattcgactcgtacaaggcctgcgccggctatggcttcacggaggaatggctcgccagctcggacctcatcggcagcgacggcggcgcggcggggttcttctccgaggatcacgcctccagcctcaacttcaactggtgcccgagtggcatccagggctgggagtgaagaggggtttttgatctgcacggctagtgtaaaaaaaccgatgttacggtggcatttgtacatgcatggaactggagtctagtgacctggcctggcgagtgtggtgtggccaaagctagaggacatccagcgcaaaaggcgggaacaggagcagtagtagcctgtaacaataacggaataacttgagccaggctagtaaaaaaagaggatgtaaatgtaaaaagaggtgtcgcacc

SEQ ID NO: 572 - DNA, 1434 bp, Zea mays
  CDS (63)..(908)
cacgccgggacgggaggcacaggtgcggtctgcgtcgagagttggtccactggcaggccggaatgaagaagtgcgcgtcggagctggagctggaggcgttcatccgggagagcggcgaggacgcccgcgccgccgccggaggtagcagtccggggtgcggtggatcaagcgatcccggagggagcggcgtcttctcacccggcttcggtttcgccgactcggacaccatggatggaggcagttggtggtacgggaacgtccgcacgccgaacccagtcatgtcgcaggcggcgtccatatccgctagccccgggctaaccacctcagccaatcatgctcttgaaagcgagtcagactccgacagcgaatcactgtatgaggtagagggagttccatacgagcgaggtaacagatccattgagacgaagcgaataagaaggatggtgtccaatagggagtctgcgcggcggtctaggaggaggaaacaggcacagttgtctgaccttgagtcacaggttgaacgactcaaaggtgaaaacgcaacactgttccagcaactttcagatgccaaccaacagttcagtactgcagtcacagacaacagaatcctcaaatccgatgtagaagcgttaagaattaaggtaaagatggcagaggatatggtagcgagaagtgctgtatcgtgtggcctaggcgaccttggcctggcaccatacgtgaactcaaggaagatgtgccaagctttgaatgtgctcacagggttggatttactagggagtgatgcgttcaggggtccaaccgcaggtacacgagtacagaactcaccagtacagagcactgcaagcctagagagtctggataaccgaaagtccaacgaggtgaccagttgcgcggcggacatttggccttgagcttcaagccattgatctgattcaaagcttgctccaccctcaaaaaaaggaccagagtttgtcaactcaaatagctggtggcttgagcagagcttctggcacgagttctcttgaaccatatttccacataagctttataggatgcatcactcttttgatgtcacttagtttcaagtataaaatgaagctgtctttgtacaaagctgcaaatgagaagtaaatgaaacgtcctggacaaacttgtgaagtaggaatgatacataggctctatttccaggtcagatgagacagttatgtttacaacaaaaagcaatacatgttgtttagaaaccgctattaattcacaggaatgttcaatccagtacaagtcatctagtagatttgcacccctaccttctagtagattcaaccatgttttcactactacttgctgggactacaactgtacatcatgatggtaaaatgcataactagtgaggttcttgactcgaaaaaaaaaaaaaaaaaaaaaaaaaaaaaaaaa

SEQ ID NO: 573 - DNA, 1583 bp, Zea mays
  CDS (95)..(1225)
atttctatgttattttactatactattgaaaaaatgagtaaattgtatgttgtgataatctgaacttttacatgacagactagcagatactgtcatggctcaggatgaagctgtggctacccaaaagactggaaatacaacatctccttctaaggattacccaactccttctccatatcctgattggtcaaccatgcaggcatattatggccctggtgtcttgccaccaacatattttactcctgcaatagctccaggtcatccaccgccatatatgtggggtcctcagcctataatgccaccccctttcgggacaccatatgctgcagtatacccacatggtggagcttacccacacccccttgtgcccatgatgtcaactccaatgagcgtggagccagccaaatctacaaatagcaaggagaaaaattccaataagaaacttaaggaaatagatcggactgcagtgtctgctggcagtggtaacagtaaaagaacagtgtcatccattgaagattacagtgcagaaggctcaagcgatgtaaacgatcagaatgtgaacgaaacgtccaggaagcggagctcagatggtggacctggcgcagaaaccaccacaggtggaaacacggaatgtgttttagctcctaaccatacgctggggaatgctaccattttgccacaacactgcttttcagctccagtaattaagcccagtgctacaaatgtcgcgaactcgagggcgataggcacagcattatctccaccacctggtgtgatggttccagttcataatgcagtaccatctgacttatcagttaaggatgagagggaattgaagcgcgaaaagaggaagcagtcaaatagggagtctgctagacgatcaaggctgagaaaacaggctgagacagaggagttggctacacaagtggagtctcttgcagcagagaacacgtcccttagatctgaaatcggccagctaacagagagctcagagaagctcagactagagaattcagctctaatggtgaagctgaaggacaccgcagaaccgtctccgattaaagcatccgcatccccgtcctctccccgtgcctccgcggagaacttcctttccatgatcgacagcgccaacgcgccgagcgtcagcaggcacacggagcacggcggtcccaggctccggcagctcctggactccagtccggcgacagacgtcgccgccgtaagctgatgatgaagccggtccggcaaatacgccacagcacatgcatgtgtcctggggattccgcaggctcatgctgctcgagtgctcgtcagcgttacggactcggactctgtactccagtttaggcactgattccagtgaagtaaccgagggtaccggtaattttatctgctctcgcgccagagtgccgggctgccttgcctgcgaccactcctgtcctgtgtacccagagttgtaacgtagtagggtgttgtgctgcatgccgaccttttgaaactttcgagaccgtcatttggaccatttttttcgtcgcagtaacacaatacagatcggagtttgtacaaaaaaaaaaaaaaaaaaa

SEQ ID NO: 574 - DNA, 1870 bp, Zea mays
  CDS (84)..(1637)
tctctctctctgtcgccaggagggcgccgccgccaccaacgcaacgcgcgccgccgcagatctccgccaccgacgcgccggccatggagtacgagcgcattgagaagccgttccccgtccagggcggcgggttctcgcccaagcggctgcgcgcgatgctgctgggggtggacaagcgccgcaaggggcaggacggcgccgccgaggaggacgaggacggcggcggcggcggcgactacggcgccctgcccaaggcccacgccagatccggcgccggcgacggtggtggcgccacgtgcgaagaatacaaggacgtggacgtggtgagcaccacctcagagttctcgtcctcgctggagacagcgggtgggcaccggccccgggacgcccaccccgtcgccacgggttctaggaccagggtgccgcccgaggaggactcgtgcgactcggagagcgtggcatccaacttcgagttccacaaggagcggcgggcagcggcggcggcgtcggtcgtccctccattctcaaagcccgccccgtcaaagtgggacgacgcacagaagtggatcgccagcccgacggcgaactgccctggcaggggtggcgcggctcctgcgccgaagaagacagagaaacctggctccggcatcgggaggctgccgctgccggcgaccaaggtcgtggtagaggccaccgaggagatagataccaagaggatggatccgagccaggagaagcgtgagattgggtggcagaaagcggcgaggtgggcgccgcccgacccctgtccggaggtggagccctgcccaacaaagaccacactactcgctgtagaaactacagtggctgctgcttcagcagcagctgttaatttcaaccgccatgatgcatccaccacgcttcagagcgcagcaacatgcatacctcctccaacaacggtccggtcagtgtcgatgagggacatgggcacagagatgacgcccatcgcaagccaagagccgtcccggaccgggacgccggtgagggcgacgagcccaaactgctcccagccaacgactccacggaggacgctcggtggccccagcgcagtcggctccttcatcagccacggaggagaatgcagcagctcggagctgagcgagcaggagctgcagaccaaaaccaggagggagatcatgctccttggcacgcagctaggcaagaccagcatcgcggcatgggcgagcaagaaggaggaggagaaggacgcctcgctctcgctgaaaccggtgcccatggaccagtcgacgcagaacataaccgcgatccgtgcggctgcgtgggaggaggcggagaaggccaagtatttagcgagattcaagcgagaagagatcaagatccaggcttgggaggaccatcagaaagcccagatagaagctgagatgaggaaaatcgaggtcgaggtggagcggatgcgtgcccgcgcgcaagacaagctgatgaccaagctcgcgtcggcgaggcacagcgcagacgagaagcgtgccacggcggagctgaaacggaaccgcgcagccgcgaggaccgctgagcaggcagagcacatcaggaggaccggccgggtgccgccgtcgtttggctgctggaactggtgctcatgaagtgcccatggaagatgagtcgcccgttgagaatgagtcgcttgtaagctgttgtaactatatatatatatatatacacacgtatgtaaggtgtgagatccatgcgtcctgtgctgtggtggttactgtgtaagtgtcacagatgtaccgaattcaaggccgagcttggattcctagtgcacatatgtgataaacttcacaccaagagacctccatgctagttgtgactg

SEQ ID NO: 575 - DNA, 854 bp, Zea mays
  CDS (43)..(639)
cactcaacagcaacagctaagcctctcccacaagacagcaacatggctgaggaggaggccaagaaggtggaggtggaggtcaccaaggagcccgaggcggcggcgaaggaggacgtagccgatgacaaggccgtcatccccgcgtccgacccgccgccgccgccgccgccggccgacgactccaaggccctggccatcgtcgagaaagttgcagatgaacctgctcccgagaagcctgcccctgcgaagcaagggggctccaatgacagggatctcgctcttgcaagggtggaaacagagaagaggaactctttgatcaaagcttgggaagagaatgagaagacaaaagctgagaacaaggctgctaagaaagtatccgctattctttcatgggaaaacacaaagaaagcaaacatagaagctgaactgaagaagattgaggaacaactggaaaagaagaaggctgaatatgcagagaagatgaagaacaaggttgcaatgatacacaaggaagccgaagagaagcgagcgatggtggaggcaaaacgcggtgaggaggtcctgaaggccgaggagatggctgccaagtaccgggccaccggccacgctcctaagaagctcatcggttgcttcggagcctaagaaaccttccaagtcagaccgagcagaaagtgaaaaacgtcagccagtgattgcttggtcctctcgctctatcaagtgtgtagtgtgtcttcgaaagtttgtaaagcctactgctgctgctgtatatactgatatcgcttccaaggcaggcgtttggtggtgtacatgttgaatgcttgacgagaaacattcttgtgtgtagttaagaggtc

SEQ ID NO: 576 - DNA, 1035 bp, Zea mays
  CDS (47)..(811)
ggagaaggaccctctctgtcctcgcggggggcggcaggaggagcagatgttcccgcctggcctgatccaccaccgccctgacgccaccgctcccggcgatgggccaccgcgctccggccccggtgggccgagccttgtactgacggcggaccccaagcccaggctacggtggacggccgacctccacgagcgtttcgtcgacgccgtggcccagctcggcggacccgagaaagcaacaccaaaaactatcttaaggacgatgggtgtcaagggtcttactcttttccacttgaagagtcatcttcagaaatataggttaggtaaacaatctggtaaagaggggtcagagcaatctaaagatgcttcctatcttctagatgctcaaagtggaatgagtgtgtcccctagagttgctgcccaggatatgaaagaaagccaagaagttaaagaagctctgagagcgcagatggaagtgcaacgaaggctgcatgaacaagtggaggtccaaaagcgcgtgcagatcagaatggaagcacttgagaagtacatcgacagtatcctagagagcgcatgcaagatggttactgaacaatttgcttcgagtggcttcagtatctccaaccctgatctcccggagatatcccctggaggggtcatgtgtggctccacggacacgttgggctcgtcggtgttgaaccagctttctgtgagctccatcgactcgcacagtccaggaggcaaaccttctccatcaggcatggaaggtccgacactgctccagaaatcgcctgagctcaagcggaggtcctcttgaactgtgacatcgaattctgaggttggtgatgatggctgtctctgtggagtgtctgaatatggtggtgacaagggaaatggtggcccagtcttgtggtagctgactctctctccaggtagcaggacgtgctgtgtttgttgatcaatccaagtatcaaacggacctactatgttcatgtgaacttcctcaagtgctagttaaaaagttttcatgcttctgtc

SEQ ID NO: 577 - DNA, 1560 bp, Zea mays
  CDS (370)..(1179)
tcagtgtcaacccccttctcaaaacttgtatttgcacctcagtccctgccggtctgcccggtcgccgcctcgccggaggaagcccctcgtctccttgccctgcggcgggttcatggggttctcgctgtaccccatgaagacgtccacgcggatgctctggagcactagcttcttccgccataagctcagctcctcctcctgcttcctctgaggacgccccacccgcctcgatcgcttcggcggcgggccgctgctgctgcgctgtcctagcatccgttcaagtgtgtgtttgcgttcttaggtttcaagattggcttttgttgcgttcttggcgagacgaagggactagggcgcggacaaagaatcagcatgcatccgagcgcggtcagtttcgactccggcgacgggcggcggcgcggtggcgcgcagatgctgctcttcggcggcggaggcagcgccaacagcaacggcttcttccgaggtgttccgatggcggtcctggccatggacgacgcgacgcgcgtgggcaagcggcccttcttcacgacacacgaggagctcctggaggaggagtactacgacgagcaggcgccggagaagaagcgccgtctgacggcggagcaggtgcagctgctggagcggagcttcgaggaagagaacaagctggagcctgagcgcaagaccgagctggctcgccgcctggggatggcgccccgccaggtggccgtgtggttccagaaccgccgcgcgcgttggaagacaaagcagctcgagaccgactatgaccgcctcaaggctgcctacaacgcgctcgccgctgaccaccagggcctcctggccgacaacgatagcctccgggcacaggtgatctgcctaacagagaagctgcaaggcaaggagacatccctgtcggcaaccatcgctgcccaagaggtcgaccagccaaacgaacacaccacaggcactgagaaattgctggcgcagcagctcaaggacgacctgcacagcagctgcggttgcactggacatggtgccctgtcttcggaggaagaggatggtggcgtggtcagcgatgagggctgcaactttgatctccccgacgccatgtttgctgttggggtcaccaaccatggtgctgaggaggcgcagctggccaactggacatcttggttctggaactgatcggttgatggatggatgcatcaagtgcaaagagcaaatcctctcctggtttcgactcttttctgcaacatataattactgtgttgattatgtgccgtcagatgttttcaagtaatgaaacagaactgatgttgtaagtttatgtttctgaagatttgtatgttcatatatataataatatgctttgaacatgagactccaaaagttgaaataagtggatgtggagacctgttgtgcactagcagccagcatgcgtttttatgctgctttagacatgaaaatgtatatccaacacaggcctgtgaataagatgatgaaagtatatccaatcgctgcacttcatttggttgtgtgccaaaaaaaaaaaaaaaaaaaaaa

SEQ ID NO: 578 - DNA, 1627 bp, Zea mays
  CDS (485)..(1300)
tccaaaagaaactcctgataaatataaaaaggaggggaaaaagaaaaacacttgcagcggcatccaccaccggagctcccatcatcggtctatccctccgtgtcaaccccctcctcagaagttctaattgcagttcagcccctggccggtccgccgggccaccggaaggagccgctcgccggaggaagccccccatctccttgccctgcggcgggtttatggggttctcgctgtaccccatgaagacgtccacgcggttgctctggagcactagcttcttccgccataagctcagctcctcctcctgcttcctctgagcccgccccacccgcgtcgatcacctcggcggcggcccgctgttgctgcgcggtcctagcacccgttcgagtgtgtgtgtttgtgttctttgagtttcaagattgggttttgttgcgttattggggagacgaagggactaaggcgcagtgagcggacaagaatcagcatggatccgagcgcggtcagtttcgactctggcggcacgcggcggggcggcggcgcgcagatgctgctcttcggcggcggaggcagcgccaacagcaacggcttcttccgaggtgttccgatggcggtcctgggcatggacgacgcgacgcgcgtgggcaagcgggccttcttcacgacacacgaggagctcctagaggaggagtactacgacgagcaggcgccggagaagaagcgccgactgacggcggagcaggtgcagctgctggagcggagcttcgaagaagagaacaagctggagccggagcgcaagaccgagctggctcgccgcctggggatggcgccccgccaggtagctgtttggttccagaaccgccgcgcgcgctggaagaccaagcaactcgagaccgactatgaccgcctcaaggctgcttacgacgcactcgccgccgaccaccagggcctcctggccgacaacgataacctccgggcacaggtgatctccctgacggagaagctgcaaggcaaggagacatacccgtcggcaaccactgctgcccaagaggtcgaccagccagacgaacacaccgctgtgtcaggcacggaagaactgctggcgcagcagctcaaggacaacctccacagcagcggcgactgcactggccatggcaccctctcttcggaagaagacgacggtggcgtggtcagtgacgagggctgcagcttcgctctcccggatgccatgttcgctgccgggttcacccaccatggcgccgaggaggtgcagctggccaactggacatccatgttctggaactgatcagcggatggatgcatccaagtgcaaagatcggatcctctcctcgtctcgacccttttctgcagcatataattaccgtgttaattatgtgccgtccgatgtttttaagtgctcatgttttaagtttgtgtttttttgaagattttgtatgttcatatatataataatgtgcttcgaacatgacactcgaaaagttgaataattggacatgtcgacctgctgtgcactagcagctggcatgttttgtttagggctggtttgggaagttcatttttcaaagaattcatatttttcaaagggaaatgaactaattttacttaggaa

SEQ ID NO: 579 - DNA, 1269 bp, Zea mays
  CDS (75)..(875)
gtgtttcctcagtggactagtgtgaagctgtgcttagcgtagcggaagggaggaaggacaaggcaaggcaactgatggcggcgggcggcggaggcggctcggcggcgccgttcgtgtggaagacgtacacgatggtggaggaccccgggacggcaggggtgatcggctggggcagcggcaacaacagtttcgtcgtcgccgaccccttcgtcttctcgcagacgctgctccccgcgcacttcaagcacaacaacttctccagcttcgtccgccagctcaacacctatggcttccgcaaggttcatccggaccggtgggagttcgcccacgcgtcgttcctgcgcggccagacgcacctcctgcgcaacatcgtccgccgcggcagcagcgccgccggtgccggaggcggaaagaggaaggacgccagccccacggagctggcctccggggacgacatgaccatggtggccacggaggtggtgcgcctcaagcaagagcagcgcgccatcgacgaccgcgtcgcctccatgtggcgccgcgtgcaggagacggagcgcaggcccaagcagatgctcgcgttcctcctcaaggtcgtcggcgaccgcgacaggctgcaccgcctcgtcggcgacgcccccgtgccagataacgggttcgcctccggcggtgccgccgagccgcccgctgcggaggtcggcgagaagcgggccaggctgctgctcgacggtgacagcatggtggcgctcggtcccgaggccgtcgacttcgccgggttctacagcggcggcggtgcgttcggcgatgttgccgtggatgctgccgctgggtcccgcggaggcgggttctcgtttgcgttcggcgtggacgcggggtactgaatgacgagcaggcgccgccattgtcagcagcttggcccgcttatgctgctgtcgagcttcctgccaatgccattgcgctgagcggcggcagccgtcacatggaagcatggcaggggatggatgataatgatgttaagttctatccctggctccctgctacatggataggatgtgtgtctgatgctgcttttcgtggatctatatgggcggggagcgactactgcgtcgagatctaaaaataaggggatatactgtcatggagtgtgaccttcgaagttcccaatatgagtaggtttgatgttgtacatgaccagtgcagcagcactaatatttcaatctcctgcggatacgcagctggaaaattggcatcgctattatttagcccttttct

SEQ ID NO: 580 - DNA, 2264 bp, Zea mays
  CDS (895)..(1575)
cgcgagcggcagccctttgccttgtttggatactctagtattccccctaattcacatgtgttgagatatattggggtgtaaattagtttaatttatactctaataaacctcaacacacgtggattgcggtgaatactagagtatccaaataaggcctaaggggtattaaccccctcccccccaaaaaaagtcctgggaatctatttactgatttcacttatataggtgtagtgttaggaaacattttagcgtcggaaaacaagattttgaagcaattaagtgattttgtattttgtgctctttgaggttgtggaaaacaagactcgaagtggttgaagtgattctgaccagacctactgcattatgttttgagcatatctggtcgtgtagtgggtttatggcagtagggattcagtgctatcgttttcactcattagcgcatttgattgtaaacaaatacatccttgaaagtgtttatgatacattctccggtgaacctcatcttcaggtgaggcaaagagaggggagattaactctcccagcaaatttataatcctgacatggtttcttgaacttttttattgtagctagatggaacaagatactggatgaagtaccaagaatcagattgttttgttctagaagactctactgaccaccttcacatgctatagtatattgctggcctatcattatccctgttattgcagatataaatatacaaaagctgaaatttacagagaacctcatccaagcgaacataatgccttatgactgacctgctgatgaccatttctggtctattgcaacctgcagggcttcagaaaggttgatcctgacaggtgggagtttgcaaatgaaggtttcctcagaggtcaaaggcacctgctgaagatgataaagagaaggaagccaccatcagctgtggcaccattgcgacagcaacgtgcccctgcttcttgcctggaggttggtgagtttggatttgaggaggagattgataggctgaagcgtgacaagaacattttaatcacagaagtagtaaaactaaggcaggagcagcaaagtactaaagatcatgtgagagccatggaggaaaggctacgagtggctgaacagaagcaggtacagatgatggggttcttggcaagagcaatgcggaacccagagttcttccagcagttggcccagcagcaagacaagaggaaggagctcgaggataccatctcaaagaaaagaaggcggcccattgacaacacaccattctacagtgatggggaaagcgaacagcttgattcacagttgaaaatgttcgagtcaggtgttctcaatgggctcaatgaacctgagctggagaatttagcagtgaacattcaggagcttgggaagggaagcatagatgatgggaacttgactcaagttagtgaccagtcagagctgaacgacgacttctgggcagagcttttggtcgaagattttggagacaaggcaggacagccagagttggagggaagaactgaagacgtgaatgaccttgctcaacaactggggtatctgagttcttctagcccaaaatagagccagttcctaatggttgcccccacaatcactggtgctttccctaccctactgttgcagaccatcctgatcaaaccggtacttttcaaattcaattcaatgacacaaacctgttaaaatctggtaacattttcattccatttcttttatattgctggattagccaggaatgatgatggatctggcagacaaggtttgacgacccatccttctaaccatatccattatgtttgcgcagttgcatcttcagatttgccctcatcttttcttcttcttcttctgaaacattctaaattgctccttatccagttgactggtggtggagaggtgttcatactgaaggcgtgctgtggagaggtcactgccttgacgttgaaggcttagcgctgtactctgctgtgggagttacgtgtggggtgttggctaaatgtctcttccggcgtcttctggcaaaatgatctcgtggacggtgactggcaaagatgcctaggggccaacgtatacgtacacagctgttatcagatcttgttcaaagtcattgcgcggttttgacggtgctatgtatcgatcagggttctggccttctggggttgggttgtagaattgactggctgatctagtgttctccatgtatgactggtgtaaccttaaaacaccctcagcttgttgttgaactgtgacaagcc

SEQ ID NO: 581 - DNA, 1287 bp, Zea mays
  CDS (195)..(965)
ccggcactcgcctcccttttccctttccgcgccccatcaccattgccacaaatagcaaccaaggcagtaagcctagccaagccaaccgacggcggcgagagtatatatacacacacacctgacgcctctgctgctgctgggatcaacgcggcagcttagtgacgacgacgactcttctgtctctgcgttgattaatggacagtaacagatccatggcgacgagcggcgtggctccgttcgtggccaagacgtaccgcatggtggatgacccggcgaccgacggcgtggtcgcgtggggcagggacaacaacagcttcgtcgtggccgaccccttcgccttctcgcagacgctcctgcccgcgcacttcaagcactccaacttctccagcttcgtgcgccagctcaacacctacggcttccggaaggtcgatccggaccggtgggagttcgcgcacgtgtccttccttcgcggccagacgcatctcctgggccagatcgtccgccggagcagcggcggcaagcgcaaggacgacggcaacggcgccggcgccggctccgccgacgacgaggacgcggtggccatggaggtggtccggctgaggcgggagcagcgggccatcgaggagcaggtggccgcgatgtggcgccgcgtgcaggagacggagcgccggcccaagcagatgctcgcgttcctcgtcaaggtcgcgggcgacccgcaggtgctgcgccgcctcgtctccggcgccgggggcgacgccgtgttcgccgccgcggagccggaggacggcgcgagcatcaagagggcgcggctgcttctcgatgccggaagcggcggcgacggcgccgtcgacttcagcgggctctatagcacaaccgccggaagcgaagacgacggcgtcgggttcggcagcgattacctgcagccgccaccgccgtacgtgttccccgtcaacagcggcggctactgactgatggcggtctggtagtccagcatctatccgagcgatgtggcgtgcttcgtcgtcgttagttgcccctcccgagtgacgtgttggactgaagtggcaacggcgccgacggacggtgagcaaccaacccaagataattagctaggaggtggtacaaagtgtaaagcctttggtttaggcaggtctgcggtgatctttaatttgcttgttgcaatgttttccttccctaccttgtcaagtgaatgctacggatcagcggcggcaaaagccgttagctgcagctagtttgccgctgctcttcatacagctgcacgccgtt

SEQ ID NO: 582 - DNA, 1623 bp, Zea mays
  CDS (383)..(1276)
attcggctcgaggcggcgacacgccagggcggagagcacacaccgaagcgggccgcggcggcggcgcaggcgcaggcgcttacatgggagtagaggcgggcgggtgcgggcggagggcggtcgtgaccgggttctacgtctggggctgggagttcctcaccgccctcctgctcttctcggccgccgccgccgccgcagactcttactagctagctagccaccttcttcctcctcctccttgtaggtagtagtagtagtaggctacacaacaacgaccacatatatatatacatactaggtactactagcaggcgagcgagattcgtgcagtaattaaggccgcagccagttaataataattagtcgtcggcgagcgagagagatggtggaggaaggcgccaccgcggcggcgtcgaggagcgggccggcgccgttcctgagcaagacgcaccagatggtggaggagccgggcacggacgaggtgatctcgtgggcggagcagggccgctccttcgtggtgtggaagcccgtggagctggcgcgcgacctcctcccgctccacttcaagcactgcaacttctcatccttcgtccgccagctcaacacctacggtttccggaaggtggtgccggaccggtgggagttcgcgaacgagaatttccggcgaggcgagcaaggcctcctgtccggcatccgtcgccgcaagtcaacgacgccgcagccatccaagtacggcggcggcagcgtcgtgaacaccgcgttccctccgccgttgccctttccgcctcccgcgtcggtcaccacgtctggcggtggcggtggtgctggcgctggcaacgagcgcagctcctcgtcggcatcgtcgccgccacggaccgacgacctgaccagcgagaacgagcagctcaagaaggacaaccgcacgctgtccaccgagctggcgcaggcgcgtcggcactgcgaggagctcctgggcttcctctcgcgcttcctcgacgtccggcagctcgaccttgggctgctcatgcaggaagacgtgcgagcgggtgccggtgacgacgccgcgccgcgccgcgcaatggtcagccagctggagcgcggcggcgaggaggggaagagcgtgaagctgttcggcgtactcctcaaggacgccgcaaggaagagggccaggtgcgaggaggcggcggccagcgagcggcccattaagatgatcagaatcggcgagccgtggatcggcgtcccgtcgtcgggcccggggcggtgcggcggcgggaattaagtaaggtatggttggaactgatgcgccacggccggccgtgtgacagctttattacagcgagcgcatgttcgagtcgtggatgctttttgtgcgtgtttgtatttgtcatccaaggtgaggttgatggcaaggataattccagtgctgtggtaaaactgtgaaggcagaacacagggcacaggagataaccgtaacgcatgttaaaagttaattatgggatgctttggaggtagcaagattgaaagtagggaactagggatgaccggatgagtagacggtctagaaagacaagcccatatgtttggaatggaatattatcgtttttataaaaaaaaaaaaaaacg

SEQ ID NO: 583 - DNA, 1127 bp, Zea mays
  CDS (65)..(724)
tttccttcccccgctttctccttccttcctcctcctcccggctcccctcacccagccaccggccatgtcggtggagacggagcggagctccaccgagtcctccggggcttccgggctcgacttcgaggacaccgcgctcacgctcaccctccgcctcccgggctccgcgccttccgccgccgccgccgccgcggcttccctgtccctctcctcctcgtcgtcctccgccttccccgaccccgaccgcaagcgcgcctcctccgacgccgaccccggccgctcctccccgctcgccgcgtcctccgacgctgcaccggcacccaaggctcgtgtggtgggctggccgccggtgaggtcgtaccgcaagaacgcgctcgccgacgccgcgggctccggcaaggccgccaagttcgtcaaggtggccgtcgacggcgcgccctacctgcggaaggtggacctgcaggcgtacgccggctacgaccagctgctccgcgcgctccaggacaagttcttctcccacttcaccatcaggaagttcgccgacgacgagaggaagctggtggacgcggtgaacgggacggagtacgtgcccacgtacgaggacaaggatggcgactggatgctcgtcggcgacgtcccctggaagatgttcgtggaaacctgccagcgccttcgtctgatgaaaggttcagaggccgtgaacttggcaccaagagccgcccgatgaggcacactccgttgggcgttggcacgcacgcacgcactggcgtcttgaaggaaagcgggaactctgctggtcttgatgaggatcttcacgtgagataggaacgtgtgtacagttgtcgccttatggtattgagttgaggaaacttggaagttccattacttgtctgtagtctctactttatatagatgcgaagaagcttgagatacacattgcctacaatgtcttttgatgaataagaccagacagcaccgaaaccgaactcgtcctccacacggttgctttgccatctcggtggttttgtggtggtggtcgtgcttcctataggtgtgaggctgatggcgtggctgccatttatacaatctttaatcgtgttctgttgagcttaaaaaaaaaaaaaaaa

SEQ ID NO: 584 - DNA, 1831 bp, Zea mays
  CDS (762)..(1448)
acctggcaacctccctagacctggagcgcacgagagagagatagaagagagacggaccgacgaccgacggcgatctcgatcggtaggcagccgttgcttcttcttgcttggcgggcggggcggccaccatagccctctgtagctcttgccggctttccttgtgctccttggaatctcgccctgcatatcttgtactacagtagctagctcctctgctactgtagagctacaggcaagagggaagcaggcagcgaccgagctctagctgccggctgtgcgactgcgagctagagagagagagagagggtgcgggcgacggacggaacggaacagaggagcctagtacttgttgtccgctgtctttcgtccgtgcgactggaccttattccctcacacctgcagctttgaggctcggccgtcacgtagtagtacgtgtacgtttcagggagggagccttctgacctcttgttcccttgccgccttttggtcacctcgggcaccgcgaggcgcagcacctgtgcttccttccgtcgtcttcctgcctcctcttctgttcaccgctctggcgctctcctatactcttctctctctctcgctgaggcaggcgggggcagcctttcctccccggtcgccatcctcgtttatatacacacaccctctcttgccgaaccactgctcgcttctctgcctgcttctgcttgagtcgtgccagtgacccgtgaccgtgaccgcgagcttcagggacgcgggcggcggcgatcatggcgtggcgcggcccgctcggagccggagaggaggccctggacagcggcctcgagctcagcctcggcctcccggcctacttcgcccggccttcaggtttggacgccgccagggaggagcccgccgaggcctctgcctacgctatccaggccgccagtgggagcaatgtctccaaggcaagggtcaggccagcgggcgcggcgccggtggtggggtggccgccggtgcggtcgttccggaggaacctggccgcctcctcctccaggccgtcgtcggggaaacacacccgccaggagggcagcgccaaggacggcctgttcgtgaagatcaacatggacggcgtgccgatcgggcgcaaggtggacctcacggcgtacggcggctacgccgacctctccgccgccgtcggcaagctcttccgcggcctgcttgccgctcagagggaccgagcggccacggcgggtggcgaggaggaggaggagggggagggccccgtgatcggcggcgactacacgctggtgtacgaggacgacgagggcgacagggtccttgccggcgacgtcccctgggagatgttcgtggccaccgccaagaggctgcgcgtgctcaagagctccgacgtgccggcctcgtcggtgacgctgggagctgggggcccggagaggtctgcagccgactgctgctgctgaaacgtgctctgcttcgtcagctgcttgtaaaaagtcccgagtggaggagacgaggagtggccctatccctggcctcttttttgtgtgttgctcttgctgcctttctgctagtggtactagtattgggtgccagtaaaaagtaggagaacaaagtcatgacggtattaaggatgtaatgtgcaagattagcagtggtagtagtcgtaaggtgtttaatgaatctacggtctctgttttggggcatattcgaccgtttaaagctgtatgcacgcgtcgaatttcggtgtggtttctgcatgccggccttaatgtttttcagcttttgtttgcacacgaacgctttagagcaagtttaataaaagatggctctaactaaaaaa

SEQ ID NO: 585 - DNA, 1078 bp, Zea mays
  CDS (114)..(286), (383)..(818)
gcttggttccatcgggccggagaggagaagctagctaactagcagcagctctgttggtgtgtgtgtgtgtggagggtagctgcagctggggctagctggaaaggtcgggagccatggggaggggccgggtggagctgaagcggatcgagaacaagatcaaccgccaggtcaccttcgccaagcgccgcaacggcctgctcaagaaggcgtacgagctctccgtgctctgcgacgccgaagtcgcgctcatcgtcttctccaaccgcggcaagctatacgaagttctgtagcggaccgagcatcacgagaacacttgagaggtacgaaaaaaacagttatgcaggcccagatactgctgtacagaacaaagagaacgagttagtcagaacagccgcaatgagtaccttaaactgaaagcaaaggtggataatttacagaggactcagaggaatttgcttggtgaagatctgggttcacttggtgtcaaagagcttgatcagcttgagaagcaaattgattcatccttaagtcacataagatccacaaggacacagcatatgcttgatcagctcactgatcttcagaggagggagcaaatgatgtgtgaagcaaataagtgccttagaagaaagctggaggagaccagcaaccaggtgcatggccaagtgtgggagcacggtgccaacttattactcggctacgagcggcactcttcaccacagcaagccccatcacatgttggcaatggattattctttcatcccctggaagctgcagcagagccaaccctgcagatcgggttcgctcccgagcatatgaataatttcatgccggcatggctaccctgaagatggatctttgaggcaaagggaataaataaagatgcgatgcatgtcagaatcatattgtactgcaagagtgacaattgtgtgttccactcacatatatgacctagttttgtgtgtctatatgtcgaaaccatatgtctgtgattttattatatgtaatgtaagcacagatgaaacatgcagggctagttgcttttgcttgtctatgtatctgtatctggctgtgcgcc

SEQ ID NO: 586 - DNA, 1228 bp, Zea mays
  CDS (293)..(1027)
ccacgcgtccgcggacgcgtgggcggacgcgtgggcggacgcgtgggccctccccctatctctccaccgccgcagctagctgcgacgtcatgcactcgccggcgccaccgccaccgcatactatctacaattagccagccgtaggcttacctatcctgtgtcaagcaagcctctcgcaagcaacaaggaaggaagctagctagttttatagctgctgtcggcggcggcggctgaagcgacgtgcctgagctaggatttaggttgagatcaggagagggagaaggcggcggcgatggggcgcgggaaggtgcagctgaagcggatcgagaacaagatcaaccgccaggtgacattctccaagcgccgctcggggctactcaagaaggcgcacgagatctccgtgctctgcgacgccgaggtcgcgctcatcatcttctccaccaagggcaagctctacgagtactctaccgattcatgtatggacaaaattcttgaacggtatgagcgctactcctatgcagaaaaggttctcatttccgcagaatatgaaactcagggcaattggtgccatgaatatagaaaactaaaggcgaaggtcgagacaatacagaaatgtcaaaagcacctcatgggagaggatcttgaaactttgaatctcaaagagcttcagcaactagagcagcagctggagagttcactgaaacatatcagaacaaggaagagccagcttatggtcgagtcaatttcagcgctccaacggaaggagaagtcactgcaggaggagaacaaggttctgcagaaggagctcgcggagaagcagaaagaccagcggcagcaagtgcaacgggaccaaactcaacagcagaccagttcgtcttccacgtccttcatgttaagggaagctgccccaacaacaaatgtcagcatcttccctgtggcagcaggcgggagggtggtggaaggggcagcagcgcagccgcaggctcgcgttggactgccaccatggatgcttagccatctgagctgctgaaggtttgccctcaccgtcgcgatgtgatagcccaaaatccagcaagtcttccccggaccccggactgtccccgcttctccgcctggtgcagtatcgtcgtgatcgcgagaagcagcagcagcggtttgccgtattttttaccactgtgtataagtagcatatctgcaatgtgtatattttgttcaccgttcctgctgg

SEQ ID NO: 587 - DNA, 1026 bp, Zea mays
  CDS (63)..(731)
ccacgcgtccgggattggggacgcttccgtttcgggaagccgtgaagggatcggccacgacgatggtgcgggggaagacggagctgaagcggatagagaacgcgacgagccggcaggtgaccttctcgaagcgccgcaacgggctgctcaagaaggccttcgagctctccgtgctctgcgatgctgaggtcgggctcgtcgtcttctccccgcgcggcaagctctacgagttcgccagcgccgccagcctccagaaaacaattgaccgctacaggacatacacaagggaaaatgtcaataacaagactgttcaacaagatatacagcaagtcaaagcagatgccgtaagcttggcaagtagactcgaagccctagaaaagaccaaacgaatgtttctgggtgaaaatttagaagaatgctccattgaagaactgcataatctggaggttaaactggcgaagagccttcacgtcatcagagggaagaagacacaactgctggagcagcagatatccaagctgaaggagaaggagaggaccctgctccaagacaacaaagagttgcgggataagcgcaacctccagtctccaccggaggcgccaccggacctgaaccgctgtgtccctccttggccgcgtagcctgccggcaccgagcaatgacatggacgtggagacggagctgtacataggattacccggcagggagcgctcctccaaccgggactctgattgaaccacggattttcagttcgatcggctaaaaggaataagctccctgaaattaaagcatcgaagggcacacgtcaatggttttatttgcaacttttgtatgcaaacttgtacttgaaaagtaaaaaaaataaaaataaatctgtagtatgtggatgcaagaaacggctggttagctagctgcaagccttctggggcctgaaaatgaaatccacccatggatacacccaaccaagcttgatgcgctacttttcttaaaaaaaaaaaaaaaaaaaaaaaaaaaaaaaaaaaaaaag

SEQ ID NO: 588 - DNA, 1290 bp, Zea mays
  CDS (213)..(890)
gtggcaccaccgcctcccctcctctccttattaccaccacctagctagcagcggcagcggcagcgccggcctgttgtgctgctcgctcagacagctctgctagctgcatcctcctaattctccaggtctctctctcctctcccaactcccaagtcccatccggatccgagacgctggaggcggagcgcccccccgggacggcggcggcgacgatggggcgcggcaagatcgagatcaagcggatcgagaacgccaccaaccgccaggtgacctactccaagcgccggacggggatcatgaagaaggcgcgcgagctcaccgtgctctgcgacgcccaggtcgccatcatcatgttctcctccaccggcaagtaccacgagttctgcagccccggaaccgacatcaagaccatctttgaccggtaccagcaggccatcgggaccagcctatggatcgagcagtatgagaatatgcagcgcacgctgagccatctcaaggacatcaatcgtggtctgcgcacagagattaggcaaaggatgggcgaggatctggacagtctggacttcgacgagctgcgcggcctcgagcaaaacgtcgacgcggctctcaaggaggttcgccataggaagtaccatgtgatcagcacgcagactgatacctacaagaaaaaggtgaagcactcgcacgaggcgtacaagaacctgcagcaggagctaggcatgcgggaggacccggcgttcgggtacgtggacaacacgggcgccggcgtcgcctgggacggcgcggcggcgctgggcggcgccccgccggacatgtacgccttccgcgtggtgcccagccagcccaacctgcacggcatggcctacggcttccacgacctccgcctgggctagcgcatccatcaccatgctgggtggtgctgctcgatcatcctactgcatggcaatgcaagctctggttggttggttcgctcatgcatcgtccgtcaacaaagcaagtaagcaatgcaatgcaaccgaggtactgtaatagccaataaaatctactgcatactgcaaacccaattactggtagcttagctaccgcgtgtgtacgaatcaaccgattaattaccgcgccctagcttgcatgtcgtcgtctgtgcttttggcgttcgtagacatgtatgtattgtatgcatgggtcctgttcatctgcatccatatgcatgttgtttatgattgtaattgttgtgtgaaatggctgtactttgctatgatcacgtgaaattatatctacattcgtgagact

SEQ ID NO: 589 - DNA, 1236 bp, Zea mays
  CDS (101)..(853)
gaggcacctgatctttccttcccgtcttcctcccacacgtccccatcaccattgctgcgacgagagtgagcgggagagggtaggtggcgaggcggcggagatggggcgggggccggtgcagctgcgccggatcgagaacaagatcaaccgccaggtgaccttctccaagcgccggaacgggctgctgaagaaggcccacgagatctccgtgctctgcgacgcagaggtcgcgctcatcgtcttctccactaaggggaagctctacgagtactctagccattccagcatggaaggcattcttgagcgttaccagcgttactcatttgaagaaagggcagtacttaacccaagtattgaagaccaggcaaattggggagatgaatatgtccggttaaaatccaaacttgatgcacttcagaagagtcaaaggcagctgttaggagaacaattgagttcactgaccataaaagaactccagcaactggagcaacaactggacagttctttgaagcatattaggtcaagaaagaatcagctcatgttcgattcaatttccgcgcttcagaaaaaggagaaagcacttacagatcaaaacggtgtcctgcaaaagttcatggaggcagagaaggagaaaaacaaggctttgatgaacgcgcagctccgggagcagcaaaatggagcatcaacaagctccccatcactttcaccaccaatagttccagattccatgccaactctaaatatagggccatgtcaacatagaggggcagcagaatctgagtctgaaccgtctcctgctcctgcacaagcaaacaggggcaacctgccaccatggatgctccgcactgtcaagtaacaggtgaggtcttcccagtgtagttttgcagctgatctcgacagcaacacacctgtcaccgaaatgcttcggtgaccctagatatcaaccgatgcacgatccatctcgatcctgtgatcgaataccggcgtaggtactaccaataaagtcaggccccgtcaaatgctttacatggtgattgaagtctggagcttctcagcaccaccatatattgtgttcagttcctgtgtttattgccatagctaccctttttttctctgatctacgagctagacgtagctttgtgcttggagattccactactatgtttcctctgtcctgtgtatgctttaacggagatgcacgttgtacccgtggtaatatatataaatttgcgttgt

SEQ ID NO: 590 - DNA, 1069 bp, Zea mays
  CDS (115)..(741)
caccacaccgcaccggcaccaccaccaaccgagcggctccaggctcctgctcaggaaggggagaagaggcgagccttccttgggaagtcgcaggaggagagaaggggaacaaagatggggcgcggcaagatcgagatcaagcggatcgagaactccaccaaccgccaggtgaccttctccaagcgccgcaacgggatcctcaagaaggcgcgggagatcagcgtgctctgcgacgccgaggtcggcgtcgtcgtcttctccagcgccggcaagctttacgactactgctccccgaagacatcgctatcaaaaatcctggagaagtaccagaccaactctggaaagatactgtggggtgagaagcacaagagccttagtgcagagattgaccgtataaagaaagagaacgacaccatgcagatcgagctcaggcacctgaaaggtgaagatctaaactcgctgcaacccaaagacctgatcatgatcgaggaggcacttgataatggactgacgaacctgaatgagaaactgatggagcactgggaaaggcgtgtgacaaacactaagatgatggaagacgagaacaaattgctggccttcaaactccaccagcaagatatcgcgctgagcggcagcatgagagagcttgagctgggttaccatcctgaccgggacctggcggcccagatgccaatcaccttccgcgtgcagcccagccatcccaacttgcaggagaacaattagactgctggatgccctcgttccactcgccgaggatttcacccagccaccaccgctggcttgtatgccctcgtgcgctggcaactgtatctttatctttccggtatgtttggatgaacgtataatgtgtgtcagtgtcggtcgcatgacgtgccgatgtcgtgcatctctctctctctctgccagagcagcggaactctgcaccgtgagtaacttaattggtaccgtatgatctgccggacagtgaatagtttatgtgagtgggtcaaaccataatgtgtagtatttgtgtcgaactgtcaatggcacgtatttggattttcactac

SEQ ID NO: 591 - DNA, 1181 bp, Zea mays
  CDS (246)..(980)
ccctccccctatctctccaccgccgcagctagctgcgacgtcatgcactcgccggcgccaccgccaccgcatactatctacaattagccagccgtaggcttacctatcctgtgtcaagcaagcctctcgcaagcaacaaggaaggaagctagctagttttatagctgctgtcggcggcggcggctgaagcgacgtgcctgagctaggatttaggttgagatcaggagagggagaaggcggcggcgatggggcgcgggaaggtgcagctgaagcggatcgagaacaagatcaaccgccaggtgacattctccaagcgccgctcggggctactcaagaaggcgcacgagatctccgtgctctgcgacgccgaggtcgcgctcatcatcttctccaccaagggcaagctctacgagtactctaccgattcatgtatggacaaaattcttgaacggtatgagcgctactcctatgcagaaaaggttctcatttccgcagaatatgaaactcagggcaattggtgccatgaatatagaaaactaaaggcgaaggtcgagacaatacagaaatgtcaaaagcacctcatgggagaggatcttgaaactttgaatctcaaagagcttcagcaactagagcagcagctggagagttcactgaaacatatcagaacaaggaagagccagcttatggtcgagtcaatttcagcgctccaacggaaggagaagtcactgcaggaggagaacaaggttctgcagaaggagctcgcggagaagcagaaagaccagcggcagcaagtgcaacgggaccaaactcaacagcagaccagttcgtcttccacgtccttcatgttaagggaagctgccccaacaacaaatgtcagcatcttccctgtggcagcaggcgggagggtggtggaaggggcagcagcgcagccgcaggctcgcgttggactgccaccatggatgcttagccatctgagctgctgaaggtttgccctcaccgtcgcgatgtgatagcccaaaatccagcaagtcttccccggaccccggactgtccccgcttctccgcctggtgcagtatcgtcgtgatcgcgagaagcagcagcagcggtttgccgtattttttaccactgtgtataagtagcatatctgcaatgtgtatattttgttcaccgttcctgctgg

SEQ ID NO: 592 - DNA, 1545 bp, Zea mays
  CDS (99)..(1160)
gcgcgacctctcggcgaaaccctaacctaccttagaccccgccgccgccgccgccgccgcccaagggagagagagacttgcacatcaaagggcgtccgatggggaagaagaagaagcgcgtcgataaggtcttctgctactactgcgaccgcgagttcgacgacgagaagatcctcgtccagcaccagaaggccaagcacttcaagtgccacgtatgccacaagaagctctccaccgcctctggcatggccatacacgtcctccaggtccacaaggagtccgtgaccaaggttcctaatgcaaagcctgatagggagtcaacggagatagagatatttggaatgcagggaattcctgcgcatgtattggctgctcattatggagaagaggaagacccttcaacaaaggtacccaaagtagaagtgcctcaggtaaggcctgttattatgcctaattcgctaggcatggcatttcctccgcgaccagcttatggtgtggcacctccaatctataatcctgcactcaatcctttgatggcccggcctccaatttggcctgctgcaccagcgcaagcttggtatccgcaacaagcagcatatccacaacaatcagctgtttcagttcctcccatagttgctgggctcccaccacaacagccactattcccaattcagaatgtgcctactcctatgacatcagcagctgctaatgtacttcaaacatcgtttcctatggcccctccaggagtaccttcacctgttgcccctcatgtttcccagcctttgtttcctgttaacacttcagctgtcaatggagctgtaaattccccatttttagcatctgttgcacctggaaccattccagcaagctcttcagcagcagtcggtgttgcaggaattggatatggaaccaataaccaaggcactagagatccagcagttggatcttcacctgcagtatccaataataaggcgtctggtgcccaaccagctacgaatgaggtatatctggtgtgggatgatgaagcaatgtcaatggaggaaagaaggttgtcgctgccaaagtatcaggtgcatgatgaaactagccagatgaactctgttgacgcagcaattgatcgaagaatatcagaaagtcggctggcaggacgcatggccctatgaagaagctgggctttgctcggtagattatcccccttgcatttcaccgaaggactctgcctgcgcttgtatctcgctgtgcagcagtctgccctcttcatttagttagcgaatggagttgctgcagttaagaggaatgtgttgtttctgacttgtttgagtgtcgagcctttgttcttctatgtttccagcatcgacaagaaaatgaattagtagcacttaggagttattttggtccaactgtcgcctcattgggaatatattgatgaacacctcaatccctgcccgattgtaacctggtcatgtgctattgccaattgaagcctaatgctgtgcattggcttgaaagcaacttaaaaatgttacggattataaaaaaaaaaaa

SEQ ID NO: 593 - DNA, 1024 bp, Zea mays
  CDS (171)..(782)
cctccccctaatcgcgaacgagcgtctttctcctccgtccgcgcccgtttgctcatcggttttgcctgccggtgggggaccgcctgcacgagcagcggctagccagacgtacgggcttcgtttgaggctggagtcctgattggcaggtgcaagcacagagctcgatcgccatgtctttcaccggcacgcaggacaagtgcaaagcctgcgacaagacggtccacatcatcgacctcctcaccgccgacggcgtctcgtaccacaagacatgcttcaagtgcagccactgcaagggcgtcctctcgattagcagctactcttccatggacggcgtcctgtactgcaagacgcactttgaacagctcttcaaggagacagggaccttctcaaagaactttcaaggtggagcatcttcaaacaagaacgaccaggcaaaggctccaagcaagctatcatctgcattctctggaactcaagataaatgcgcggcctgccagaaaacagtgtatccattggagaagatgactctggaaggcgaatcctaccacaagagctgcttcaaatgctcgcacgggggctgcatcctcaccacgtcctcctacgccgcgctcaacggggtcctctactgcaagatccatttctcgcagctgttcaaggagaagggcagctacaaccacctcatcgagacggcgcagaccaagaagaacgaggccgcggaggccggaccggagccaccggcggacgcaggcgcggctgagccggaagcacccgcgcaatcggcgtagaacgtacaaagattagcagcaacgcaaagagaaatagagccgtacgtgtctatctcctctatatatacgaaccctgcatcagtaagtagtcgtcacaagtatatgttcttattttgtaaccttggcagcttggttcagtctgggattgtaacaagtgcatgttgaattgcttgttatgtattatgaggctttggattcatgacgatgaaatgagtatatgggtgtaaacatttggcttc

SEQ ID NO: 594 - DNA, 1261 bp, Zea mays
  CDS (248)..(1105)
gatcgggcgtaccccggtgcccgttcaccgccgttcacgccgcgtgtgcgctctggctctgccgctctctctctctctcctgcgcgtggcgcagctgccgtcctataccaggcgcccaggtctagcctcgtcggtgccttcgccaggtctttctcgggcccttcgccaacgacgagcgcccgctaggttagaaggtatgcattcgtgttcataatattgtatttgactaaaaagactgggcctacgcatgggggctccaaaacagaggtggacttctgaggaagaggctgctcttagagctggagtagccagacatggagttggaaattggcgcatgatattgaatgatccagaacttagctccacattgcgctaccgctcgaatgttgacctaaaggacaaatggcgcaacatgaatgtaattgtcacttcatcgagtactcgtgacagggggagaacttccacgaggagaacccgagctgctcctaagaataatgaccaattgttggcaatgagcacaatcacttctgaggttgatgatgagattgttgatgtaaagcccatagtatcaatgtctgttgaaggatggaatacttcaaattcaaagaaatctcactcaaggctagacaatattataatggaggctataaagaacttgaatgagcctacagggtcccacagaactactattgctaattacatagaggagcaatattggccacctagtgattttgatcacttattgtctgcaaaactgaagtatttagctaccagtgggaaattgttgaaggtgaatcggaagtacaggatagcacctagtttgctggaagacgtgcaaagagaacccttgaaattagggagtgatgctagtagaacccttacaagatcccaagtcgatgctgaattggtccgtatggcaactatgactgttgaggcggcggcggcagctgctgctcatgcagttgcagaggcagaggctatcatggcagaagctgaagcagctgctagggaagcagaagctgcggaagcagaggcccgagctgcacaggcctttgctgaagcagcagttttgacactgaagaacagaaatgctgcgaaattggtatagctcgagtccatgaatcttagatatgccctcttgtccttccacacgtagaatccagttccgtagctctgtatgcaactaattggttactaaaagaacctgaaatcagaagttttcacaaacacaccgacttattcaccgaagattatgatttcc

SEQ ID NO: 595 - DNA, 1161 bp, Zea mays
  CDS (112)..(945)
attcggctcgagggcaggcagcaggccttcatcgcagagaggacagcagcacctgagattgacggcggggcagcgcgcgggcccttcccttcggagcactcagcgtgagagatggggaggcagccgtgctgcgacaaggttggcgtgaagaagggcccgtggacggcggaggaggaccagaagctcgtcggcttcctcctcacccacggtcactgctgctggcgcgtcgtccccaagctcgcagggttgctgaggtgcgggaagagctgcaggctgcggtggaccaactacctgaggccggacctcaagaggggcctgctctccgacgacgaggagaggctcgtcatcgacctgcacgcgcagctcgggaacaggtggtccaagatcgcggcgcagctaccgggcaggacggacaacgagatcaagaaccactggaacacacacatccgcaagaagctcgtccggatggggatcgaccccgtcacccacctgccgttgcaggaaccgccggctcctgctcctgctcccgccgagcagcaggagcagagccacaggcagcaagaagaactgcaactgcaagagctgcagaacggccgcgagcttatcatgcaggagggcgcgggggaagacgatatcacgccgatgatccagccgcacgagatcatgccgacggcggcagcggcaagcaactgcggctctgtttcctctgcccacgccggctccgcgtccgtggtctcgccgtcctgctcctcctcggcggtgtccggcgtggagtggccggagcccatgtacctgctcggcatggatggcatcatggacgccgactggggcagcctcttccccgacactggcgctggcggcggcggcggcggcttcgacttgggcgtcgatccgttcgaccagtacccgggcggtggcttcgaccaagaagacgaccacagaatatgacatcggcctagcaatgcacatagattcgccgcttctccttccatctcgctcagcacatcagcgccgtagcctccatgttttcttaatagctctccagggtccagtgctgataaacaagaactgacaaattcgggtgcggaaaaaaaaaaaaaaaaaaaaaaaaaaaaaaaaaaaaaaaaaaaaaaaaaaaaaaaaaaaaaaaaaaaaaggggg

SEQ ID NO: 596 - DNA, 1383 bp, Zea mays
  CDS (125)..(1030)
cttccggtcttctcttctccactaccacccgcccgcccgccttctcctccaccactgccccgtcgtggaataggggcaagttcaggcatctcgcttctgtcctggtcgaggggatcggagaagaatgggctcggaggcggactgcgacaggatcaggggcccgtggagccccgaggaggacgacgcgctgcggcggctcgtggagcggcacggcgcgcgcaactggacggcgatcgggcgcgagatcccggggcggtcgggcaagtcgtgccgcctgcggtggtgcaaccagctgtcgccgcaggtggagcgccggcccttcacggcggaggaggacgcggccatcgtccgcgcccacgcgcgcctcggcaaccgctgggccgccatcgcgcgcctcctccccggccgcaccgacaacgccgtcaagaaccactggaactgctccctcaagcgcaagctcgccgccgcgtccgccccggcgggttcctccgacgtcgacgcgcgcccgaccaagcgcgtcagcctctcgcccgacagcccgtcggggtcggggtcagggtccgggtccgggtccgggtccgaccgtagcgacctgagccacggcgccggccaggtttaccgccccgtggcgcggtccggtgggttcgagccggcggactgcgcgatgagccgtccgctggaggaagaggaggaggaaaaggaggacccgctcacctccctcagcctctcgcttcccggcacggaccagcggttccaccacgaccgcgcccacagccagttccaggagctcccggcgtcgccgccctcgccctccccgcctccgccgccggcgggtccgacctcggcgtacccgttcagccccgtgttcatggaggcgatgcaggagctgatccgcacggaggtgcagcggtacatggcgagcgtgggcgtgcgcgccgggtgcggcgccgccggcggggccgacctctgcatgccgcagctcgtcgacggcgtcatgcgcgccgccgccgagcgggtcggccggatgcagtagctcctgggcgtgcatgagccatcaaatactctcccaaaccgtcaatcgatcttctaggacgaacgcgcagcagctgttcttatcagtagcaaacttccaagttattattttcctttttttaaaactttattctctcgaaccgctgtgaaaccgaaacagcagtgaaaagagtcagcaactgaaaaaaaaaaatatgtgggaactgaaaggtggagaaaaatgtagtaaaggcttgctgaaagccgtgtaaagcgctgcctgcctcctctctctctctctctctctacaggaatgaatcggatcggaacggaatgaaacgagaagagggggacgacgcacattctggtttc

SEQ ID NO: 597 - DNA, 1286 bp, Zea mays
  CDS (34)..(1101)
ccagcgtccgaattaacaaatcacactgctttaatggggcgatcgccatgctgtgagaagattggactgaagaaaggcccgtggacaccggaggaggatcagaagctgcttgcctacattcaggagcacggacatgggagttggcgagcattgcctgtgaaggcgggcttgcagaggtgtgggaagagctgcagactgaggtggacaaactacctgagaccggacatcaagaggggcaagttcagcttgcaagaagagcagaccatcatccagcttcatgctcttttaggcaacaggtggtcggccattgcaacccatctaccaaatcgcacggacaatgagatcaagaactactggaacacacacctcaagaaaaggctggccaagatggggatcgatcctgtcacccacaaatctatcagtggcactcgcattggcaccacaaacgacaaatcaaccaaggccgccgcaagcctcagccacatggcacaatgggagagcgcccgcctcgaggctgaggcacggctggctcgagaatcgaagatacggacagcaacgccaacaccaactgctctccatgcgcagccaacgatactacctgcctctgctgcttctccatgccttgacgtgcttcatgcatggcagggtgcaaagatagacctggagtctccaacctccacgctgacgtttacagggagtaatagtggaacgctgccaacccccaggaccaatagactagacgtatcagaaagcaactgtgcagtgtggcatcagaggagtgatgacttggaggatgaagaaaacgattggcagatcttcagcaagcaccaattgctggaactcgacagcaaggagagggaagaggacttcattggttgtgaggagccgtggttctcagagatggctggggttggagctggcttcactggcatgctgcttggtgtatccaatgagcatgatgcatcagaatgctggggtgagtccaataatggccaaactgagcgcagcaaccaagcatcagatgaggaggacaagaattattggaatggtgtccttgacatggtaaactcagagctgacacccaagtcgcctccatttgtctagactctagaatacagtcccctccgttttatttcaagtactcctgagcaaaatctattggatcatctcaagtcaaaagagaaacagaacaagcactacaaataaatgctgcatgtgctacaacaatatgttttttttgtccatgcatgtgaaagtgaaataattaactattgtgtggatggagt

SEQ ID NO: 598 - DNA, 1744 bp, Zea mays
  CDS (139)..(1563)
ctagatctttcaagctatccttgcttcctagctccctttggcgtgctgtaccggacgacaggggtaggtaggtaggtaggtgtagctagctcggcgagcgagggagcaatccggccaacagcacacgcgtcgatcgccatgccgagaagcggcggcggcggcaatggcggtggcattagtagtagtagtagggtgatgcccaacctcccggccgggttccgcttccaccccacggacgaggagctcatggtgcactacctcatgaggcaggccgcctccatgccgtgccccgtccccatcatcgccgaggtcaacatctaccagtgcaacccctgggatctccctgccaaggcattgttcggcgacaaggagtggtttttcttcagcccccgggaccgcaagtaccccaacggcgcccgccccaaccgcgccgccgggtccgggtactggaaggccaccggcaccgacaaggccatcctgtcgtcgtccacgcccacgagccacggcggcgccaacatcgtcgtcggcgtcaagaaggcgctcgtcttctacggcggcaggccgcccaagggcaccaagacggactggatcatgcacgagtaccgcctctcgggcgcggcggacgacgactgcaagggcagcaccaggcgcagagtgtcttcctcctcgtcgtcctccatgaggctggacgactgggtgctgtgcaggatccacaagaagagcaacgatttccagttgtcgtcgtcgtcggagcatgagcacgagcaggaggagccggcggcgggcggctcagcgacgactgtggaggaactagacgctctcgtcgtcgtcgacaacagcagcagcagcgacaccaccaccaccaccatcaccaccaacgacaacaactctactgaaacagctgcgactcatcacgatcctcagacgatgatgatgctgagcaagtcgtgctcgctcaccgacctcctcgacagcatcgactacgcggcgctctcctcgcagatgctcctcctcgacgcgccccacccccacgctgatgacccgccgccacacatggtctactacccaccggcggcgtcggcgacgcaccagcaagcaataatagctaataacaccaacagtaatgacgactactatgacgacgacaacttgttgccgactgctgctgctactgcggtagacgcggcggcggcggcggtgctactcagctcgtcgcctgcagacaccaacggtgtgaacaagaggaagcgagtgacggccgtggactactacggcgccgctgaaccgccgaccttcttccaccaccacctcgatgatggcggcaacagcttcttcagtacgaccaagaagctcaagccgccgccgccaagtgattcgaggcatggcggccatttcggcaccgccacagcgagcagctaccgcgacagccagcagctcgtggacagcgcgagcagcagcggcgtcttcttccatcagtatgggtacggctacagcagcagcaacccgttcttgaacttgaaccagcagcagcagctgctactcaacagccacatcgggatgcagtagagctcgagagatcgagagagagagagagagagagatgatatatcattggaaggatcagcacgcgtacgtgcagattaattgcagcgagttctatcttgtttgctttcattattatatactccgtatgtgtcgttcatgtaaaattagtttaaattgtaaattagtgtgctgaaattcc

SEQ ID NO: 599 - DNA, 979 bp, Zea mays
  CDS (165)..(686)
aaacggacgaccgagaccgcctgggcggatccgagttcggacggcccatcagagcatcagacgaccaccttcctgcccccattcgttttcgcatcggcgtatctcccggcggccggcaaaggcgctctcgacctccctgcggtgccggtacgacagtcgacaggatggcaatggccacatcagcatcgtaccctccacctcctccattttaccgattgtacaaaaattttgagcaagatccctcatctgcaccagaacctccaccaccaattgacgaaccattcaaagccttgggtgttgattacacaggagatgttgtgattccaagcttggagagtcataatgtccgtcagctttatccaaagggtcccaatattgacttcaagaaggagcttaggaccctcaacagagagcttcaattgcatattttggagctggcagatatattagttgagagaccatctcaatatgctcgtagggtagaagatattacgctcatattcaagaacttacatcatcttctcaattccttacgacctcatcaggcaagggccacattgattcacatgcttgagagccaaattcggcaccgcaaggaagcaattgaagatataaagcagaggagggaggaagcgcaaaaggtgcttggggaatcactgcttatcttggatggaagtcaaactaactaggctgacgccgtcaaggtagttggttcaagaccgattcttctatgagttagtgtgttagtagaatagaagacaagatgtgtctggattgttgtggtatcatctgttgtggcttgtggtatttccagctttgataactgaattttcttacttctatggtctatgttagcaaagttggattactttcttacttccattggtactcaactgcatcatgggttactttcttgtggaagtgtatattgtgagattgatgcctcgtggccagcttaattgaaaggttgttatatgct

SEQ ID NO: 600 - DNA, 964 bp, Zea mays
  CDS (222)..(650)
agatagacaggagagagagagagaggggaagagagagagagagagagagagagatagatgtggtaactcaagaactgttcttatgcatgcagcagccataagcattgctactagggtttcatgcggggcgaagcagctggtctctgccgcctgaacgccgccggaatctgcgaggcctccccgagctgcgtgcgtcgtcggataaggcagccggcacggcaatgccggttccgcttgctccgtacccagctcctccggcgccattcacgccgcccaatggggcccagagccagctcgtctgcaccgggtgccggaacctcctcatgtacccagctggtgcgacgtcggtctgctgcgccgtctgcagcaccgtcaccgccgtgccggctccaggaactgagatggcgcagctagtgtgcggaggatgccacaccctcctcatgtacatacgcggcgcgacgagcgtgcagtgttcttgctgccacactgtgaacctggctatggaagcaaatcaagtcgcgcatgtgaactgcgggaactgccgcatgctgctcatgtaccagtacggggctcggtccgtgaagtgcgcggtctgcagttttgtgacatcggttggaacctcacctggtgcagagcagaagcccagcagctgagctgatagtgtccctgaaagtgctgtgagaccacctatgaaaaggatgctttgagtgcacatgtatagagttcttccctgaagcgattctttcactttcttttcttttgttttcttttgttttcttttcttttttggttcctcctcaccatctccaccccacccgtccacttctgcgttccttcgatggatctcgcgagcccgcggaataaatgagagttttggatatatagctagggcttaacctcgtcgacttgtctgtaaaatcgaatgagacatatatataaacctatgttgttttccttgtttctg

SEQ ID NO: 601 - DNA, 1023 bp, Zea mays
  CDS (84)..(806)
caaagattccgttctcccagtcgcctctcccagtcccagatctcgttcactcgcactcgcgcaaccccgcggccccgcgcctaatggcatcctgtggcgccggcgacgccgcgtcagcgcagccgagggccagtatctcgcacgtcatcttcgatatggacggccttctcctcgacacggagggcttctacacggaggtgcaggagaagatcctagcgaggtacgacaaggtgttcgactggtcgctcaaggccaagatgatgggcaagaaggcggccgagtctgcccgcatcttcgtcgacgagtgcggcctcaacggcctcctcacccccgagcagttcctcgaggagcgcgagagcatgctccaagcgctcttcccatcctgtaccaagctgccaggagtactacgtttggtgcatcatcttcatgccaacggagtaccaatggctgttgcgacaggatcccataaacgccattttgcactgaagacccagaatcaccaggaaatgttttccctgatgcatcacgttgtcatgggtgatgatccagaggtgaaggctggcaaaccatcccctgatatttttcttgctgctatgaggaggtttgagggcggcgtagaacctagcaagtgcttggtttttgaagacgctccttcgggtgtagctgcagcgaaaaatgccggaatgtctgtagtgatggtcccggatccaaggctggatgtttcgtatcacaaaggagctgaccaagttctcagttcattgctggacttcaaacctgccgaatggggcttgccggcatttaaagagtagacattccatacaagataacaagattataagagtctagtgaagaagaatgtgagatactccctaagatgcaaattaaagagtacaattctttaagatgctgctcaaggaaaattccataaaatgttggtcaaacatacaattgaacattcttgtcgcctcctaactatgtgtcaccaaattactctgaataagttcgttccgattccgatataat

SEQ ID NO: 602 - DNA, 1828 bp, Zea mays
  CDS (268)..(1470)
ccacgcgtccgcccacgcgtccggctctggacacatcagtctgttaatcctgaatgggagcaaagacatgtccaagttcaaccaggaagttcctattatgcaggcactgcaagtgatccatccaacctgggtgtgcaagttgctgtgggagttccaggaaatactgctaatgttggtatatgtgatttgcggaatcatgagtgcccgcatgttcataattcatacccacatgccggtgttacatcaagatttgtcttcccaactactatgtacagccctagcatgtcagcagcagctgtcaacatatatattcctcagactcaaagctttggactgggcagtgtgctaccaccatctttacataatcaagtttccacaggaattattgatgagagtagcagcagtgtcaattttggtgatagtgctattggattcatgaaaaggaaaaatgcagtagttgctggaagccataattttcttcatggatttgctgggtcaagttcatctgtccatgtgcctcagaatcctgtgcatggggcatggaatccttcatctcaatcaaattgtttacccagttctgcagcttcaaacctaccagaataccacaatagtaatgggtggccatacttagaagaatcttctgcagatgcttcaaacagtttcagttctgtggctgcttgcccggagctggcacctcatggtaactatttatatccagcttgtcacataagccagtccaatacatgggttccacagcctgcaggttacggagtaccacagtggggatatagtaatgcagtggtcaatcctccagacatgtcaaatgggccactgcctcatttctgccagaatagtatgcaggcacctcaaatacaagtgccccatcaacagtccatcggtaacaatgtggtgcatggtttaaatccttctgccacaggtcttcctttacatccaagaatgctggctctcccattcaatgctgagcacacttttgggcatccaatgcacccacctctgataaaccaagctaacaatggggctttaagaattctgccatatcagaacgctacagtgatggatcattcaaggatttatgaagcaggacatgttatcgatgaacatagcgatatgcgtttagatgtggataacatgacttatgaggaacttgtagcattgcaagagcagataggcgatgtcaatactggtttgacagaaagctatatccaggaaaacttgaggtccagttttcatgttccaggagcagctagcatgtctgatcagttttctgagctttctttggagaatgatgcttgcataatatgccaggaggagtataaagctaaagaacttataggaacccttgaatgcggtcacaagtaccatgtgaattgcataaagcaatggttgatgatgaaaaacctgtgccccatatgcaagacgacagctttgtcatcagatagaaggaacggatgaccgtcgccaataatgttgttggttgtttaccgcgtggcaaattagcgtggattttgtatatagacatggttgcctttatttgcccgtcccctttgctgtggacataaactgagcttcgaaacactgtacagatattttgtaggatgttttagacgttaaatggcacaatggtgtgtaaagctcccatgactgccttggtagatgccctcttcctttacattgtacattgtatttatctttactcttcaaaaaaagaagcttgaaaaccgtaagttctgtacattctggaattgaaagaaccggaaattttcttcaaaaaaaaaaaaaaaaaaagggcggcagttctagatcgcga

SEQ ID NO: 603 - DNA, 1244 bp, Zea mays
  CDS (187)..(1158)
gcgcgcggcgccagcctccggcgaccggcacccgcctttcttttatacctccgccgcggcgacccacgccaaccttcgacccccctaaccctaccaaagcccgaactctcgagatcacaggacgcggatccaaaccagaggcccctgcctgccctctactcccccaccacaccacagcctaccgccatgtcggcgaccgctacggacgaggccgcggtggaggcgcgcctccaggagctgcgggggaggctcgggaagaagcagcacttcgaggaggccgtaaacgagctcgccgccgccgtccgggaccgctacgccggcgcctcccccgccctccgcaaagcgatgtattcaacggtttgccgcgttgcaacagtgcttcaaaccagatatacagctccaggattctggcatgttggtctgaacctcttcgttggaatagagaagctggtaagtaatcctgctgaaaaggagcacctgaagacctgcatttcgagggcccgtgagcatcttgatgaaaaggaaaatgaggattctgtgccaagcaacagagaagcagacaccagatttctttttgaagggcaccttactgtgggacaggaacctccacctccagcatggcttgttgcccagaatttaacgagggaattgagcatactaactgaatcctctggtgatcaagatgggagcaacaacagaacagtgcctagagccgaggagattacacctgctataatgaacctcctagaaaccatatcaggcgacagggatctagaaactgctttggaagaatcactgcagggaatcattgagtatccacagagggcacccccggcttcaaaggaagttgtcgccaatcttcctgtcattgctgttaccgaggaagtcatgtctagattgggtagtgagacggagtgtgctgtctgccgcgaaaacttggttgtggatgacaagatgcaggagcttccctgcaagcatctcttccatcctctttgtctgaagccatggctggacgagaacaactcctgccctatctgccggcatgagctgaggacggacgaccatgtgtatgagagcaggaaggagcgtgaaagggaagaggaagaagatagaaggggtgcggcaaatgctgttaggggtggagaattcatttatatctgaactcaacagttccagaatgtaatccctttgatgaacttcgttattaccatgttgacatctatatatacctagttacttaaaaa

SEQ ID NO: 604 - DNA, 1485 bp, Zea mays
  CDS (107)..(985)
ctcttccgggatggaccaataacattttatatctggacgccccttatcgccctcgttatttacatcgctgccaccctcctctccgccgtcgccgccgccgccggggatggggggagcgcaattccccggcgacaacgacgtcgcggaagtagacgcggcccgcgacggagaggtggaccgccgtgacgtgggcaagatgaagcacgggtgcgagcattaccggcggaggtgcaagatcgtggcaccgtgctgcaaccaggtgttcccctgccgccactgccacaacgaggctacggcttccggagatcggcatacaatatgtcgtcaggatgttgaaaaagtagtttgcctactctgtgaaacaaaacagccggtgtcacaagtgtgcataagctgtggagtcaatatgggagagtacttttgtgatatatgcaaattttatgatgatgatacagacaaagggcagtaccattgcatcgattgtggcatatgcagggttggtggcaaggaaaacttcttccactgtgtgaagtgtggatcctgctattctgttatactccgtgataaccatcagtgtgtggagaactcaatgaggcagaattgcccaatctgttatgagtatctatttgactcattacaaggaacaagagttcttaactgtggacacacaatgcacttgacatgttttgaagaaatggtggcgcataacaaatacacttgtccaatatgctctaaaacagctcttgatttgacacatcattgggaaatgttggatcaagagatcgaagccacgatcatgcctcttgtgtatcgctacaagatttgggtgctttgcaacgattgcaacaaggtctcagaggtgaactttcacgtgattggccacaagtgcagccactgcagatcgtacaacacccgaacgacatcgcgccctgcagatttatcgggaagcagctcaccttcaacagactcatccgacaacaacatatagagaagaaaccattgacagagccaatatgattgaagaaccgaaggaggaaatattgtttcggggcgtgcgtgcttgccaaacttgaagactcccagccgtttattggccctcatcttgtctagattcagttcattccatgagtctttgctgttgtggcaacttccagcttgcgcatcgctgggtcaacaacccacatggccggcgtagctgtccctttgaatcttgttcgcagccgtgattttatcactgtgggtgaaacgtaatcacatacttactgtaatctactatggctgaagatgtgtgcccccctgactcatgccttgtgtgcttgtgctgaactgtttatgaattcccgtgctgttccgtaacactatattgccatttgtgtttccttatctgtcaagtaccgccaagtgtgcggtgaaattgtaatttatttgcaatgaatagaatcttatatctatacctaataataaagactcaacatttctaaaaaa

SEQ ID NO: 605 - DNA, 2086 bp, Zea mays
  CDS (440)..(1891)
ggcgcggcagcgggcaggcagtccatccccatgtgtttgtgactttgtgctcgtcctcatacccccaccccccagctcccgtctcctcgtgctctccactgctgcatgcgcctcttgtcctgtccccctccccaccttgttcctcccatcccgcgccgtctctgcacgaagcagagcgccggtccaccgacaaggacagctacaactacgacgcgcaggcagagccatcgctcatctggggctgccctcggttactcctcccctccgccgctgcccctgccttgtccacagctgttgttaattccttcatgagttggcgtcggcgccagcggggcggaggggaaggaggcggggcttcagcttccccggcgccggccgccgcctgaagatcccttcttctcctgtagtcctgtcgtcgggcgggcgaggtccaagcatcatggggctcttaggtatgatgggcgactcttttggttgctcggcgactggggagcgacttgtgtctgctgcaagagatggagacatccaggaggccagggctctcttagaactcaatccccgccttgctcggtactccacgttcgggatccggaattcgcctctccattactcggcagcaaagggccaccatgagattgtctccctcctaatcgagtccggtgttaatattaaccttagaaattgcagagggcagactgctctgatgcaagcttgtctatatggtcactggaaagttgtacagattctagttctttttaaagctaatattcacaggagagattgttttagcggcgcgaccgctattcattttgccgcgctaaaaggtcatactcgctgcattcggcttcttgtggctgattatgtgcctagcttgtcagagttttggaccattatgcgtggaaagtccacagatgaaatgaaaaagggtgcctttgatgccgcgtctctccagagactagttaatggaaagtctgatggtggtgtcaccccgcttcacttggcagcccttcatggacatgctgagagtgtacagttgctgctagaccttggagcctctgtctctgaggtgactgtcaatgatggttcaacaattgacctcattggttcggggagcacacccctccattacgcggcgtgtggtggaagtgctgtttgctgccaacttctcattgcagcaggagcaaacatgggagctcaaaatgttaacgggttgactcctttattggtggctcgttcgtggcacaagactagcatcgaaggtattctaagcaagcaaccagaaaaccgaatgcgtattcttccttcaccatacctttgcttaccactgatgagcattgtcaaaattgccagggaatgtggatggaggaaaacttccgcctcatccacttgtcaggatccatgtgtcatatgtttggaggtggaatgcactgtagctgcagaaggttgcggccatgagttctgcaccaaatgtgcactctacttgtgctccaccactagcagctcaacatccacccgtggagttcctggctccatatcatgccctctgtgtcgccatgccatcgtctccttcatgaggctcaccagcactaccccgataaaggagcttccatggacaagcgcgtcactagctctatgtgcagcgggctcaaacactggccgccctgaacatggcgggtccttgcatcgaaggcctgacctgcgtcgactgcgctccatctcagttcagctgggatgctcttcttttagatccattggctctgggaagctgtcgtccatgaagctgaactgcacaggagctgaagaggcggtgccttgcctcgtcagctgcctcaggcccgatgtgcagcgttcatcgtcgtacaggggaagaattaggagatattcagagttttgaaaggatggttttgtggcgtccttcctgcgagtttttagggtttgggaatttaaacctgtgtcgtcatgttcctcttcgtttgtttccctgttgtttaatatgcatgcagtcctcgttgtgaagatctatttgtgtacatggcccgtttgtcttcattacttttacttatatgtgaattatataccaaaaaaa

SEQ ID NO: 606 - DNA, 2325 bp, Zea mays
  CDS (424)..(1644)
gccttccacttcgcctcctcttctctctctcccccgtctcctgtctccacctgttccatcgcattctcctcccaccaccaccacaccacgcctcgcttatccccccccgagacccgacccctgctcgacgacgtgctggcaaaacctcctcctagtcctctcgcagaaggaggctgtgttctttccttcatcggtgcggcaacagcgaaagcttctcggtcgatctctcccaccgctgctccgccgtttgggtggttccgcgccttggccgcgcgggttggatccgagctccgtgcagcagctccgccgcgatacgtatcgcataggattccactggattcagctgctgagcagggtactggaaggtggatttgatactagctctgaacagccagtagaatttctcaaatactgtccaggatcatggcttctctctgtgatttctgtgggaaacaaaggtcaatgatctactgcagatcagatgcggcatcattgtgcttatcatgcgaccgtaatgttcattcagctaatgcactgtctcgacgtcatacaaggacccttctttgtgatcgttgtggttcacagcctgcatcagtccgatgtcttgaggacaacgcatcactttgccaaaactgtgactggaatgggcatgatgcagaatcaggggcttctggacataaaaggcaagccataaactgctactcagggtgcccatcatctgcagagctttcgagaatctggtcatttattactgatatcccgactgtagcagctgagcccgactatgaggatggactaagcatgatgacaattgatggcagtgatgttactaatcgtcacgatacttcagatgataaaagattgttggaaatagctaacacaacactcatgagcgatccaccttcagccgacaagcttaaatctccgacaggctcttcttctggagatgggtttgatgttatgactctagccacagatcagcctgctggaccagtttcagcaacgcctaaggtacctaatgccagagatgatgataagttcaatgatggcatgtacgaagacttgtgtgtagatgatgctgaccttacattcgaggattatgaagagctatttggtacctctcacattcgaacagaggaactctttgatgacgctggaattgacggttacttcgaattgaaagagacaccacctttttatttcaacgagcagcccaaagctatgcagatagaatgtggcaacgtggtatcagctgattgtgcgatgtcaaacccaggggcaagggctgattccagcctttgtattcccgtcaggcaggtcagatctagtatatcccactccttatctggtctgactggtgagagcagcgctggagatcaccacgactgtggggtgtcaccgatgctcctcatgggtgagccaccctggcattctcctggtggtccagaaggctcagtcgctggaggcagcagagatagcgctctcacacggtacaaggagaagaagaagaggagaaagtttgacaagaagatcagatatgcttctcgcaaggctagggcggacgtgaggaagcgggtcaagggacggttcataaaggccggtgaagcgtacgactatgatccgctaagccagactagaagctactgagccttgggagtgtgactgttgttgtcgtccagtgtcagcctcgcaatctccagccgctcgtcggttgcaggctgcgctacaggcaagatcactggagagcacaacgatcgcattgcatcagagcctgcaactgaaaaacgttaagaagagataccaagtgttaggatgaatgaaaaaaaaatacaaaaaagaaagatgcagacttgccggactcatatccattattcagtttctctgcggatgagtggcttggatcgcactgtgccatctgcgcgtcgaacagatgcagtgatggatgggcgctcgtcgtcctccagctgtaccgctgtgcgctaggacctgcgtcggctatatacggctgttcggcagtgagctgccaggttgtacagtctgggtaacagcctaacagggtatgcttatacctctcggttttcgttctgtaatacgtacgtattatttgcgcttgccaggagactgttcttcggccgtgtgtatgtttgtagatggttgcaacattggtaaaaaaaaaagtagccgtcgtgaatgtaaatttgtattcttgttaggtcgcatatagcgttggcgatgagcaggagaatcacacgtatctggacactgaacgtctgaacccttgtaactatttttgcgccagaataaccttcttgtgccttgtcgttt

SEQ ID NO: 607 - DNA, 2155 bp, Zea mays
  CDS (242)..(1903)
cctagctacctggccgtcccctctccgattacggtcggaagcctcagctgaaggatctggacgacgggacaggttctgtttggtcttcataaagtagagcactagctagaagacatattcacacgcatcagctatcaaattgcaagcttagaattgacctcaaagttgggacatgcttgtcttaccagaagcaactgatagcttggagttgtagtccgtccggactgtctgctggaccagtatggctgacactccaacttcccgcatggtgcacccctttggcgacgtcccaaggcagactcccaagcaattcctgtattctggtaacccgcagcacctctgccatccgtaccagtcagctccggacacccatgtcgtgccgcagcgccgttacaccgtgaggtctcagtctcactcgccaaataatgctggttctcaagaccatgagactcacaagcagtacacgctggagtcctcggcggcttccggttgttcaaggcatggttctccctccagccaaagcgtccatgccgggagtggcagccctgtgtctcacgacgacagccactccggctccacgaacggccatggatcacctgtgagcgcgtcgtgtgtcaccggcgaggaccctactgatctcaagcagaaactgaaggatcttgaggctgtaatgctggggacgtctgagactgaccccgagatagtcaacagtctcgagatctccgcggcaaaccaactctcgttggagcccgaggagtgggagcacatggtgagcatgcccagagggaacctgaaggagctgctgattgcctgcgctagggcagtggaacgtaacaacagctacgccattgatctgatgatcccagagctgaggaagatggtttcggtgtccggcgagccgcttgagaggctgggagcctacatggtggaaggtcttgttgccaggctcgcggcctccggcagctcaatctacaaggctttgaagtgtaaggagcccaggagctctgatctcctctcctacatgcacttcctgtatgaggcctgcccctacttcaagttcggctacatgtcagccaacggcgcgatcgcggaggccatcaagggagaggacaggatccatatcatcgacttccacatcgcgcaaggggctcagtgggtctctctcctccaagcccttgcagccaggcctggcgggccaccgttcgtgagggtcaccggcattgatgattcagtctcagcttacgctcgaggcggcggtctggagttggttggcaggaggttgacacatattgctggcctctacaaggtgccctttcagttcgacgcagtcgctatctcaggcagtgaggtggaggaggagcatctaggcgtcgtcccaggcgaagccgtcgccgtcaacttcacccttgagctgcaccacatccccgacgagaccgtgagcacggcgaaccaccgggaccggatcctgaggctggtgaagggcctgtcgcccaaggtgctcacgctggtggagcaggagtccaacaccaacacggcccccttcgcgcagcggttcgcagagacgctggactactacacggccatcttcgagtccatcgacctggcgctgccgagggacgacagggagcggatcaacatcgagcagcactgcctggcccgggagatcgtgaacctggtggcctgcgagggcgaggagcgggtggagcggcacgaggtgttcggcaagtggaaggcgcggctgatgatggccgggttcagcccgtccccgctcagcgcgctggtgaacgccaccatcaagacgctgctgcagagctactcgccggactacaagctcgccgagagggacggcgtgctctacctcggctggaagaacaggcccctgatcgtctcatcggcatggcactagtgttgacttcagagaatgttgacctgatggagaatgtttcttgtaaccttcgaagtacctcttagtggtttagatatgtttggctggtcactggaactatctataggaagcctatggtgatagatactgagttgtagtagaacacatatagcctaaatgcctaatgctgtgatggcagtcactaccagcctagcctagaacaggttgatgatgtgtagtagtaagtttgggtatatgtttcagttaatc

SEQ ID NO: 608 - DNA, 1555 bp, Zea mays
  CDS (131)..(1234)
cgtctgcctccccctccacaccaggccacgccacacacaggatagcgagcgggagcgacggcggcggcggaggagctagggttttgatccggcctcgccggctaggctgcgccgccccgacgccgaagccatggacagggagcttctagagacgtttgacgcggccaagaaggcggccgacgcggcggcaggggacggcaactcgccggaggctggccgctgcctcgacgcgctgcggcggctgcgcgacattcgcgtcaacaccgacatcctcgtctcgacgcaggttggcaaacgccttcgaccccttactaagcatcctcactcaggcattcaagcagttgctgcagacctttttgggtactggaaaaaggttgtccttgaagagtcaggaaagaaaaatggcggctcagagaatgaaagatcaagtgactcttcaggaaaggttgagaaggcgaggcccgtgaagattgaaaagaactctgcatcagcaagcatgaagcttgagaaaagagatgtggatgttactggtcagaagcctaacaatgccaaagttgagaagactactagtaatggttccaaagctcaatctgtgaaggtggaaaggatatccaaagaagtcataaggactcctgacgcaaagaggccagcatccgtccccaatggccacccaaagcttacatctcttgtcaaatgcaatgatcctacccgagataaaatccgggaactacttgctgaagcctttgtaagggtttcgagagagactagtgatgatgacagagacgaagtgagaaacatcttggatgaagtcgaggcatgcgacccatacagggttgccgtgacagtagagtctgcactattcgagaggcttggaccttccactgggactcacagggcgaaatacaggtcaatcatgttcaacctgagggctgaaaacaataccgatttccggaggagggtcctcatcggtctagtggcgccggagaggcttccaggcataccccccgatgagatggctagcgacgcaaggaagcaagagaacatgcagatcaaggagaaggctctgttcgactgtgagcgtggagcggcaccaaaggcgacgacggaccagttcaagtgtgccagatgtgggcagcggaagacgacctactaccagctgcagactcggagtgctgatgaaccgatgacgacgttcgtcacatgcgtgaactgcaacaatcactggaagttctgctgagtgttcagccttgctaaagtgtttacttagttgtgctgagcacactatcctgctgtgatgtgtgtgctctgttagttgtgactggaagttcgacagggcaggctgaacaactcaccttttttccccttttttaccccccgtaaactaggagcagttatcctcttcggctcttcctctgtcaggcagcctcctgattcattcagattgtactagtcgaacgcgtgaatgttgttgacttgatcgcatcgtcaccagctgtgaatgttcttgggtggagttagaatagaatggtgccaagtcagacgatgctgatggatt

SEQ ID NO: 609 - DNA, 1216 bp, Zea mays
  CDS (128)..(904)
gtcgacccacgcgtccgcccacgcgtccgcccacgcgtccgcccacgcgtccggatttttttaggcggctgctggcctgcctgtctccactggaagctccggattacgtaggaaaggggcgggcggcatgaggatccagtgcgacgcgtgcgaggccgcggcggccacggtggtgtgctgcgccgacgaggcggcgctgtgcgcgcgctgcgacgtggagatccacgccgccaacaagctcgccagcaagcaccagcggctcccgctcggcgacgccgcggcgctccccgccagcctcccgcgctgcgacgtgtgccaggagaggccggccttcatcttctgcgtcgaggacagggcgctcctctgccgcgactgcgacgagcccatccacgtccccggcacgctctccggcaaccaccagcgctacctcgccaccggcatccgcgtcggcttcagctccgtctgcggcgccagcgccgagggcctcccgccggcgccgcccaagggcagctccaagcccgcggccgtcatcagcgcgccagctgccgggacgaccaccaaaacaaggacggtcaaggacgcgctgccgcaggaggtgccgtcctcgccgttcctgccaccgtccggttgggccgtcgaggacctcctcgagctgtcggactacgaatccagcgacaagaaagactcgtctcttgggctcaaggagctggagtggttcgaggacatcgacctgttccacgcccattcgccagctaaaactgccatggcggagttcttcgcctcgccgcagccagtgagtaacgccgggttctacaaggcgaacggggcgcgcctgttcaagaagtcacggatggaggtgcctgacgacgacgacgaggactacttcatcgttcctgatcttggctgagatgagagatctctgcatgattctccagtcatgtgatgtgtgtatgtatgcaaaatatgtatgtataccatcatggggtgcactgacgcttacattggacatatgtaattatccagtcatgtgatgtgtatgtacgcaaaatatgtatgtatgccatcatgggatgcactgacacttacgttggacacatatgtaattataaagatcaggctgctggccaggaacactcatcgttgaggtgggagggcttaagtgaataaaaagcactaatcgttggattaagaaaaaaaaaaaaaaaagggcggccgc

SEQ ID NO: 610 - DNA, 2033 bp, Zea mays
  CDS (518)..(1861)
ccggcttgagcaataattgacttgacctcacttcccctgtggggaggcttttcttccgatcgatcatagtatccgctgcggtgtgactgcctgccccaccccattgcgcctgcgcctcgcttcatccggtgcgctgcccacctcactcccgtcgtcctcgttctcgtcgcggagcggtgtggaggcgcgcgctcctggaaggcacggggcaagagcggaggtgagtgagcccgagccccgtggattgctggttcggtggtcggaactcgtggagtagcaagagcggcggcggttacgacatctcacgccagcagtttgtcctcatctaccacccacctcccctgatcccctccccagtacccacttctctcatatcccctcccgcatcatctctttttttttctctcctcttagcgaggacgccgaattcgcgattggcttaggcggtgtgtgtggatcaaatcgagtctggaagatcatctgggtgttggagtcatccagaggcacaagctgaggaatggggcaaaaggactccaagccttcacatggatatggctactcttcttatgattacgggagtgcttcatcgggatacacctcgagaaacactgggaattcgtcctccagttatagcgtcaggtacgcgccttcttcggagaacagtgtacagccggagacacatgccaggttgcagaggaagtattctaagatcggtgatgactaccgttctttgagccaggtgactgaagctttggcacaggcaggccttgaatcttcaaatcttattgtaggcattgattttacaaagagcaatgaatggacaggtaaaatttccttcaatcgccgctgcctgcatgatattggaaacactccaaacccatatgagcaagctatatctattattggaaggacactttcagcatttgatgaagataatttaattccctgcttcggatttggtgacgcgtcaactcatgatcaggaggtatttagcttttacccagagaaccgcccatgcaatggatttgaagaggcgctagacagatacagagaaatcgttccaactcttcgattagcaggacctacatcttttgcgccgatgattgagacagcaattggaattgttgacagcactggtggtcaatatcatgttcttctgataatagcagatggacaggttacccgaagtgtcgatacacaatctggacagttgagtccacaggagcgggctactattgatgcaatagtaagagcaagccagttccccctgtcaattgttcttgtcggggttggtgatggaccatgggacatgatgcaccagtttgatgacaatatacctgctcggtcatttgacaatttccagtttgtgaatttcacggaaattatgtcgaagagcatagcagctgacagaaaggaggcagaatttgcattgtcagcgctgatggaaatccctacacagtacaaagcaacaattgatctccaactcttaggccgtcgccaaagaataaccccaagaattgctctgccaccaccaacaaggaccgcgtattcgcggtccagtagctttagccaacagtctggtgtttattcgcgatcaagtagctttgaccaacaaacaagtggcgcctctcagcaacgttctgagagcttgaaacagcagaagaaacctgcagccacgaagagacctgacacttatgcttcagaaagagctttagaggacagaattctgtgccccatctgcatgtataaatccaaggaccttgcatttggatgtggacatcagacttgctacgaatgcgggagaaatttggagcgctgccctctgtgccagcagaacataaccacgaggatcaggctctactgatttgatcaggctatggattagaaagtgttggaacaacagactcccgggcaagatgttcagaaccagctttgttggtaccgtgcttcattttgtaattggtgtcacttttctctgtagttatgccaaaggaaagcgcaccagaaaataatgtacatatttatcttccagt

SEQ ID NO: 611 - DNA, 1830 bp, Zea mays
  CDS (281)..(1513)
cagtaattgacttgacctcacttcccctgtggggaggctttaattttcttccgatcgatcatagtatccgctgcggtgtgattgcctgcccccaccccattgcgcctgcgcctgcgcctcgcttcatccggtgcgctgcccgcctcactcccgtcgtcctcttcctcgtcctcgctctcgtcgcggagcggtgtggaggcgcgcgctccttgaaggcacggggcaagagcggaggaagatcatctgggtgttggagtcatccagaggcacaagctgaggaatggggcaaaaggactccaagccttcacatggatatggctactcttcttatgattacgggagtgcttcatcgggatacacctcgagaaacactgggaattcgtcctccagttatagcgtcaggtacgcgccttcttcggagaacagtgtacagccggagacacatgccaggttgcagaggaagtattccaagatcggtgatgactaccgttctttgagccaggtgactgaagctttggcacaggcaggccttgaatcttcaaatcttattgtaggcattgattttacaaagagcaatgaatggacaggtaaaatttccttcaatcgccgctgcctgcatgatattggaaacactccaaacccatatgagcaagctatatctattattggaaggacactttcagcatttgatgaagataatttgattccctgcttcggatttggtgacgcatcaactcatgatcaggaggtattcagcttttacccagagaaccgcccatgcaatggatttgaagaggcgctagacagatacagagaaatcgttccaactcttcgattagcaggacctacatcctttgcgccgatgattgagacagcaattggaattgttgacagcactggtggtcaatatcatgttcttctgataatcgcagatggacaggttacccgaagtgtcgatacacaatctggacagttgagtccacaggagcgggatactattgatgcaatagtaagagcaagccagttccccctgtcaattgttcttgtcggggttggtgatggaccatgggacatgatgcaccagtttgatgacaatatacctgctcggtcatttgacaatttccagtttgtgaatttcacggagattatgtcgaagagcatagcagctgacagaaaggaggcagaatttgcattgtcagcgctgatggaaatccctacacagtacaaagcaacaattgatctccaactcttaggccgtcgccaaagaataaccccaagaattgctctgccaccaccaacaaggaccgcgtattcgcggtccagtagctttagccaacagtctggtgtttattcgcgatcaagtagctttgaccaacaaacaagtggcgcctctcagcaacgttctgagagcttgaaacagcagaagaaacctgcagccccgaagagacctgacacttatgcttcagaaagagctttagaggacagaattgtatctgtgccccatctgcatgtataaatccaaggaccttgcatttggatgtggacatcagacttgctacgaatgcgggagaaatttggagcgctgccctctgtgccagcagaacataaccacgaggatcaggctctactgatttgatcaggctatgaattagaaaaatgttggaacaacagactcccgggcaagatgttcagaaccagctttgtttgtaccgtgcttcattttgtaattggtgtcacttttctctgtagttatgccaaaggaaagcgcaccagaaaaaaataatgtacatatttatcttccagtagtactgtacattgcgagctgcacat

SEQ ID NO: 612 - DNA, 2508 bp, Zea mays
  CDS (311)..(1579)
agccaccccagtccgctgcttccattccatctcccttctctcgccttctgcggcactgcagtgctctgctgcctcggcgtctccacctcctcccggcgacggcagggcatccgatacgacgccgcgcttccttccgaatcccaagccgcaccccgcaccctcccggtcgccattcccgatgctggtgttctcgagcgacgacgactgctgcggctcctcgtactaggggggcaggatcgatcggcagactcgcagaactataggatatcacagaacagttcttgaggtacttattgcagcctaatagtacatggagcgatattcagatatgagaccaaaggcagaagtttcatatctcggaaggggttccagattctcttctagaaatcaaagttcagaagagaggactaaccatagcagcgataaaccgggaagcagcacaagattcaatcctacgaaagcgagaattggcggtaatcaagggaggccaagatatgtatgcgattcatttaaatctccaagctcaaaggtgtcgcctgcaggctcttccaaatttccacttagcaagtttgaggagaggcgaagacagccttttgtgccagggtttgacattgctgaaagtagtagaagaaaggctgatgccaagcagctacagggtagtaagaaaattgctgcagagaacgacagttcagacaatctgcgaggtgaatcagaaggttttactactgaacaagtagtaaaaccagaaggctctcatgttgtcggtcattcaggtgtttctgcgtatacagtcgggtccctggtccaaactgcttcactaggttctaggacacacagacagaaacacaaagaagtgaatttgggtactccaggagcatcgtcttcaactctgactaacaggtctactatacctggaaattctaccatgggtgtgaggccagcttatggtcatgttaatggagggcagatacatggtcttaaaaaccttggttgttcttcggtacctgatgctcagccatcaggttgcccatctgagtctgttattagtaggaggaggtttgagttcatgagaaagagggcctttgaccaggaaagctcttccagatcagtgaacttaagcttaggtcattcaactcctacagatattcgcagaatcagaatgaatgaacaatcactttgtcaacaaataccacgaagcagcagcagaagccatcaggaatcggcaggttcagttaggacaagacgaccttctcctcatgccactaggatgagtgttcctgatggaagagcagatggcgtgctttctctgcacgagtcatccacaaaggatgtacagccagctcaggaacatctttcattggaagaagtctccactgagagttcaataaggccattctttgtggaatttgataataacattttctcgtctagtcatcttcgtcgctcgagtactcgagctgaaaggggaagaccaagctccctttttgaagaaagtcctcgacaaatgttccatagtctcatgggggagagggacagacatagacacataaccatggaaggaattacagaggttgctttctaaaatgtttcctatactggttccagttgttctgttttcgttgttagatcttatgccattataatccagttaaatatatagtgatactggtcttgattttgataaatatccataactttgactacgatggtggtttaagtgtaacattttggaatgaaataggtttattttctgtaggttttggctgcattggagaggattgaacagcaagcagagctgacctatgatcaattgctaatgctggaggctaatctattttttggcgcctttgcctcctatgatcggcatagagacatgcggatggatattgatgatatgtcctatgaggaattattggccctggaggagagaataggctctgtgagcacagctctttcagaggagcagttcacaaaatgcctcaaaagaagcatatatagtcaggtcgctctagaagtgaacaaatcaaccgttgatgacatgaaatgcagcatctgtcaggaagagtacgcggagggcgaagaggttgggaggctgccatgcgagcaccggtaccatgtgtgctgcataggccagtggcttgggcagaagaactggtgtccagtatgcaaagcgtctgccgtgccttccaagggctgaagcattggggatgctggaaaccccgttccggattacaaaccatccttgcttttgtctacgtacattgttcttttccctatatgcattagatatagatcatgtctagatgtatgacgctagaacagcttgcgatttgggaggaagctaagagagtaatagttagctggttaataatagttcatagctaatatttgctagataactattacttggctacctattagctgtgcctttcacattgtggtacaggacaaatgcttgtcagatcgtgaacaaccttataacttgatgaatggcctaagtcaaagagg

SEQ ID NO: 613 - DNA, 1384 bp, Zea mays
  CDS (65)..(1138)
gccgctgttcgcaacccaagcagtagccgagccaacgaaggcgtgcgagcggaggcaatcatacatggacggcagccgcaagagggtggacgcggaagacgtcaaaggggattccaccggcgggaagcgattgcgagcatcggagtcatttcaaagtggcgtaggaagcaaagtgaagctatgcaccaattttttcagtacttatggttgtccctttggtgagggctgccattttgtccattacttccctggtgactaccgggccgtttcagaaatgaccaacctgggtggcgcaacaatcgcacctcctggaggaatgatgatggatgggccacctacacccatcgtgaagactcgcttgtgcaacaagtacaacactgcagagggatgcaaatggggggacagatgccactttgcacatggtgaaagtgagcttggcaagtctatgatggacaactatatgccaccccccatcggaccaccaccaaccggttattttgcacctccacctatggcacctccacctatggcgcctccacccatggcacctccacctatggcacctctacctatggcgcctccacccatggcacctccacctatggcgcctccacccatggcacctccacctatggcgcctctacctatggcgcctccacctatggcacctccacctatggcacctccacccatggcgcctccacccatggcacctctacctatggcgcctccacccatggcacctccacctatggccaaccctggtttggccactccagctagcttcggcgcttatgccacggccaagatcagtgtcgatgcgtcccttgcaggtggcatcattgggaagggtggagctaacataaagcaaatatcttccgtcacaggggccaaggtggtcattcaggaggaccgccatgaatcagacaccagcttgaaaaacattgagtttgagggcacctttgatcagatcaggaacgctagtgctatggtcatcgagctgattgttagcatcagtggcataggaagcaacttcaagaccaagatgtgtgagaacttcgcaaaagggtcatgctcttatggcggcaaatgccactttgcccatggtgagagtgagctgcgcaagcctgccgctgcttgagatccatgccctgtttcttacctcatagtcattagtcaatgtaactcaaaacttggcctctgatgatggatttgttggcttctttaggtctacgctaatgaattgctggcttcaggcctactactaaatttgctgacttctttagtccttcgctgttggccaactaaaaaaaaaaaaaaaaaaaaaaaaaaaaaaaaaaaaaaaaaaaaaaaaaaaaaaaaaaaaaaaaaaaaaaaaaaaaaa

SEQ ID NO: 614 - DNA, 1197 bp, Zea mays
  CDS (146)..(823)
cggacgcgtgggcagctcatcatcacattcgcatacatctcttctagcacgcaaagatcgagctatagctagctctgcaacaagagagaaggaggactacccttcgccggccggcctaaggaggagtacgtacagaacttgggacatggaaaccgtcgtgggcgacctcatggcgaccgagctgaggcttggcctgccgggcaccgtcgacgactgcagccagccccaactggtgaaggccacgccgccgtcgacgccaaggggcaagaggcgcgccaccgccgatgccgtggaggaagccgccggcgccgaggaggcaagcaagcgtgacgccgagacggcgcccccggcagccaaggcgcccgtggtgggttggccgccggtgaggtcgtaccggaagagctgcttccagcaggccagcagcaagcaggcggcagcggccaaacaggaggcggcggcggcggcgcccggctgcacggcatcgtcagcagccgccacaaacaccaccagcagcagcagcgccgccgtcgtcgttggctccttcgtcaaagtgagcatggacggcgccccgtacctgaggaaggtggacctgaggatgtacaggggctacagggagctccgggaggccctggaggccttgttcgtctcctccagcagcgccaacaacctgtcggagttcgccgtcacctacgaggacaaggacggcgacctcatgctcgtcggagacgtgccgttcgagatgttcgctagcacctgcaagaagctgaggatcatgaagagatctgaagccacaggcctggggtcgtcgtcagcgaggcaacaatgaagatctcatctgatctatcgagaggacctgcatgcccggcaacaacacgtcgatcgatcgtcatggccttattaattgtttctttctttcttttcttttctgtttaattatttttgttgttctggttggcgccgccgtggattggagggatccccaagccgaaggatgagcttggctggcgcatcgaagcgcatgcaacggatgtgtgcggctttggttctgtaataagacaaccaggggtcctttttttcgatctgttattagcggcacaaaaggagctagatgcatgctgaggttgtttcagttcactctccatgtgtgtctgtacaaacgaaacaatacagttatattgatcgttgatcccttaaaaa

SEQ ID NO: 615 - DNA, 1161 bp, Zea mays
  CDS (215)..(829)
cttctctcctcgtccaaagactccaagcttctgtgacctctgttctgctgccgcctctggtccacatctctctacgccgccgccccgccgtccaccgataccgcagcgctgggaaggatcacgggggagcggagcgaggcggggggcccgcggttttgtcgcccggatggcggcgcagcgatgacactggcggcgggagcggcgcggcgttgggatgcggacgatctgcgatgtgtgcgagagcgcaccggcggtgctcttctgtgcggccgacgaggctgcgctttgccggccttgcgacgagaaggtacacatgtgcaacaagcttgctagtcggcatgtgagagttgggcttgcagaccctaataaactggcacgttgtgatatatgcgagaattcacctgctttcttctactgtgagatagatggcacctcactttgcctgagctgtgatatgactgttcatgttggtggcaaaagaacccatggtagatacctgctcctaaggcaaagggttgaatttccaggagataaaccgggccatatggatgacgtgcctatggagatcaaagatcctgaaaaccagagagagcaaaacacgcccaaggagcaaatggcaaaccaccataacgtcaatgatccagtctctgatggcaattgcgatggccagggtaacattgattcgaaaatgatcgatcttaatatgcgcccggctcgtactcatgggcaaggatcaaattcccagactcagggggtggatcttagtgtgaacaaccatgactctccaggggtggtgccaacaagtaattccgaaagagacgccatcaagtaaacattggaagattggaatgtacatttcaactacatatactgttctataggagctcctggggcagaaatggggttattcagtggtctctctgttattactagtaagcgtatttctggcagagttggagctaataactgcatctcaattcggcttgtcgtgccctagacggtattgctgtccaattgcattctctttgcgattgttagaactctgtatagaagcgcagcggctgccgcctgtgctctggagccggagtatcgtgtgccattagaaactgtacaaaagattaatagaccgctcatttttctctggtcgcacaagttcaattc

SEQ ID NO: 616 - DNA, 1027 bp, Glycine max
  CDS (32)..(802)
ggttaagcggtgagatttgcgaatctgagaaatggcggattcttctcgggaggagaacgtttacatggcgaaattggcggagcaggccgagcgttacgaggagatggttgagttcatggagaaggttgcaaagactgtggaggttgaggagttgacggtggaggagaggaatctcctctctgtggcttacaagaacgtgattggtgcgaggagggcttcgtggaggatcatatcctccattgagcagaaggaggagagcaggggcaatgaggaccacgtggccattataaaggagtacaggggcaaaattgaggctgaactcagcaagatctgtgatgggattttgaacctccttgagtccaacctcattccttccgctgcatctcccgagagcaaagtcttttaccttaaaatgaagggtgattaccacaggtaccttgctgagttcaagaccggggcagagaggaaagaggctgcagagagtactttgcttgcttacaaatccgctcaggatattgctcttgctgacttggcccccactcaccccattaggttgggacttgctctcaacttttctgtgttctattatgaaatccttaactcgccagatcgtgcttgtaatcttgccaagcaggcatttgatgaggcaatttccgagcttgacacattgggtgaagagtcatacaaagatagtacattgatcatgcaacttctccgtgacaatctgactttgtggacatcagacatcacggacgatgctggagatgagatcaaggaaacatctaagcaacaaccaggcgaataggcgatggcagttgcgatgtggtagttgattggatatgtattaccgataatatggatccaatgtggcttgccatagtgggattattgtattaatgaattttatgatttcaagtgcgcgttgcgcttgggatttacaatgtttcagtggattgtctaatgtgttttatggatgagaagaatgtggtttagtgatttataaattttttattgttgctagtaaaaa

SEQ ID NO: 617 - DNA, 1027 bp, Glycine max
  CDS (32)..(382)
ggttaagcggtgagatttgcgaatctgagaaatggcggattcttctcgggaggagaacgtttacatggcgaaattggcggagcaggccgagcgttacgaggagatggttgagttcatggagaaggttgcaaagactgtggaggttgaggagttgacggtggaggagaggaatctcctctctgtggcttacaagaacgtgattggtgcgaggagggcttcgtggaggatcatatcctccattgagcagaaggaggagagcaggggcaatgaggaccacgtggccattataaaggagtacaggggcaaaattgaggctgaactcagcaagatctgtgatgggattttgaacctccttgagtccaacctcattccttccgctgcatagcccgagagcaaagtcttttaccttaaaatgaagggtgattaccacaggtaccttgctgagttcaagaccggggcagagaggaaagaggctgcagagagtactttgcttgcttacaaatccgctcaggatattgctcttgctgacttggcccccactcaccccattaggttgggacttgctctcaacttttctgtgttctattatgaaatccttaactcgccagatcgtgcttgtaatcttgccaagcaggcatttgatgaggcaatttccgagcttgacacattgggtgaagagtcatacaaagatagtacattgatcatgcaacttctccgtgacaatctgactttgtggacatcagacatcacggacgatgctggagatgagatcaaggaaacatctaagcaacaaccaggcgaataggcgatggcagttgcgatgtggtagttgattggatatgtattaccgataatatggatccaatgtggcttgccatagtgggattattgtattaatgaattttatgatttcaagtgcgcgttgcgcttgggatttacaatgtttcagtggattgtctaatgtgttttatggatgagaagaatgtggtttagtgatttataaattttttattgttgctagtaaaaa

SEQ ID NO: 618 - DNA, 1004 bp, Oryza sativa
  CDS (6)..(365)
gaaaaatgtcgcctgctgaggcatcgcgtgaggagaatgtgtacatggcaaagcttgccgagcaggctgagcgttacgaggaaatggtcgaattcatggagaaggtggcaaagaccactgatgttggtgagctcaccgttgaggagcggaacctgctttctgtggcttacaagaacgtgattggtgctcggagggcatcgtggaggatcatctcttctattgagcagaaggaggagagccgtgggaatgaggcatatgttgcatcaattaaggagtaccgtagcaggattgaaactgagctcagcaagatctgtgatggtatccttaagcttctggattcccaccttgtcccatctgccactgcttaggagtccaaggtgttctacctgaaaatgaagggtgactaccacaggtaccttgctgagtttaagtcaggagctgagaggaaggaagcagctgagaacactcttgtggcatacaagtctgcccaggatattgcactcgctgacctgcctacaactcacccgataaggcttggacttgcactgaacttctcagtgttctactatgagatactgaactcaccagaccgtgcttgcaaccttgcaaagcaggcgttcgacgatgctattgctgaactggacactcttggcgaggagtcttacaaggacagcaccttgatcatgcaacttcttcgtgacaatctgactctctggacctctgacaatgcggaggatggtggtgacgagatcaaggaagcagcgaagcctgaaggagagggccactaatctgtcctgaagtctatttctgagtccatttactcagctacctgctgtattactggatcataagatgtactaggatcaattgctatgtggaatcataagattagggctgcgtatgtcaaaatgtgtcgagctgaagtacccagtggacacagtttatgtgcactacattgcttccgtgacttatttactagttaattagcaactttcaaccaaaaa

SEQ ID NO: 619 - DNA, 1158 bp, Sorghum bicolor
  CDS (116)..(874)
cggacgcgtgggcgctccagcgccactcgcatcgagatcgagacgacccgcgtccgccgctcccgtgcaccgccgcgactcgcacccccggaagtaactctattccttgatcaacatgtcgcgggaggagaatgtctacatggccaagctggctgagcaagcagaacggtatgaggaaatggttgagtacatggagaaggtggctaagaccgttgatgtggaagagctcaccgttgaggagcgtaacctcctatctgttgcctacaagaatgtgattggggcccgccgtgcctcatggcggattgtctcctccatcgagcagaaggaggagtcccgcaagaacgaggaacatgttgctcagattaaggagtaccgtggcaagattgaggctgaattgagcaacatttgtgatggtatcctgaagctgcttgactcgcaccttgtgccttcctccactgctgcagagtcgaaggtgttttacctcaagatgaagggtgattatcacaggtaccttgctgagtttaagactggtgctgagaggaaggaatctgcagagagcacaatggtagcttataaggcagcccaggatattgcattggctgaactggcacctactcatcccataaggcttggacttgcacttaacttctcggtgttctattatgagattctgaactctccggacaaagcttgcaaccttgcaaagcaggcatttgatgaggctatttctgagttggacacgcttggtgaggaatcttacaaagatagcaccttgattatgcagctcctaagggacaacttgaccctctggacctctgacatcacggaggagggcactgaggagggcaaagaagcctcgaagggtgatgctgagtagcctggtaaaccttgatggatggttcggcatgtttttctagcccatcttgttggacgccctgtgctgatagaaggtgtttgctgctccatgcattccaagattctgtcttctcgttccctccctgctgtagctggtggtagtagtcaaattagccccattgctttagttggctctgggtccatttggactgatgtattgttactgctgttgaagtcattcgttctcgttttgctcttgcagtagattgctgttgggttgtgctttaaaaaaaaaaaaaaaaa

SEQ ID NO: 620 - DNA, 1158 bp, Sorghum bicolor
  CDS (116)..(460)
cggacgcgtgggcgctccagcgccactcgcatcgagatcgagacgacccgcgtccgccgctcccgtgcaccgccgcgactcgcacccccggaagtaactctattccttgatcaacatgtcgcgggaggagaatgtctacatggccaagctggctgagcaagcagaacggtatgaggaaatggttgagtacatggagaaggtggctaagaccgttgatgtggaagagctcaccgttgaggagcgtaacctcctatctgttgcctacaagaatgtgattggggcccgccgtgcctcatggcggattgtctcctccatcgagcagaaggaggagtcccgcaagaacgaggaacatgttgctcagattaaggagtaccgtggcaagattgaggctgaattgagcaacatttgtgatggtatcctgaagctgcttgactcgcaccttgtgccttcctccactgcttaggagtcgaaggtgttttacctcaagatgaagggtgattatcacaggtaccttgctgagtttaagactggtgctgagaggaaggaatctgcagagagcacaatggtagcttataaggcagcccaggatattgcattggctgaactggcacctactcatcccataaggcttggacttgcacttaacttctcggtgttctattatgagattctgaactctccggacaaagcttgcaaccttgcaaagcaggcatttgatgaggctatttctgagttggacacgcttggtgaggaatcttacaaagatagcaccttgattatgcagctcctaagggacaacttgaccctctggacctctgacatcacggaggagggcactgaggagggcaaagaagcctcgaagggtgatgctgagtagcctggtaaaccttgatggatggttcggcatgtttttctagcccatcttgttggacgccctgtgctgatagaaggtgtttgctgctccatgcattccaagattctgtcttctcgttccctccctgctgtagctggtggtagtagtcaaattagccccattgctttagttggctctgggtccatttggactgatgtattgttactgctgttgaagtcattcgttctcgttttgctcttgcagtagattgctgttgggttgtgctttaaaaaaaaaaaaaaaaa

SEQ ID NO: 621 - DNA, 1132 bp, Oryza sativa
  CDS (70)..(855)
gccagagcgcgaggagacgcacacagagacttggcatttgtagagtttttagatttatagatagcaaagatgtcggcacaggcggagctttcccgtgaggagaatgtgtacatggccaagctcgctgagcaagccgagaggtacgaggagatggtcgaattcatggagaaggtggccaagacggttgactctgaggagctcaccgtggaggagcgcaacctcctgtctgttgcatacaagaatgtgattggagcccgccgtgcgtcatggcgcattatctcctccattgagcagaaggaggaaagccgtggtaacgaggaccgtgtcacactcatcaaggactaccgtggcaagatcgagactgagctcaccaagatttgcgacggcattctcaagctgcttgaatcccaccttgtcccctcttccactgcccctgagtccaaggtcttctacctcaaaatgaagggtgactactacaggtaccttgccgaatttaagaccggggctgagaggaaggatgctgctgagaataccatggtggcatacaaggctgctcaggacattgctttggctgagctgcctcctactcatccaattaggcttgggctagctcttaacttctcagtgttctactatgagatcctcaactcgcctgatcgtgcttgcaacctcgcaaagcaggcttttgatgaggccatctcggagctggacaccctgagcgaggagtcctacaaggacagcactttgatcatgcaactcctccgtgataacctgaccctgtggacttcagacatctcggaggacaccgcggaagagatcagggaagctccgaagcgcgactccagcgaggggcagtaaagccggctttatgtgccctagaagcttgtagctagtgctttgctactgtgtaatgacacctatgtggctgtgattgttgtcgggaaatctggggctcccccgtatgtgaggttgctagcgatggttttgcagtctcgcctttaagctactcgtagcagagcaggtgggggtctgtggagccaggcctggttgggggtgggggagcctcttgaactgcttggtggcacttcctgtttttctgtttgcctttttattggtgtttattgttatggtc

SEQ ID NO: 622 - DNA, 1132 bp, Oryza sativa
  CDS (70)..(429)
gccagagcgcgaggagacgcacacagagacttggcatttgtagagtttttagatttatagatagcaaagatgtcggcacaggcggagctttcccgtgaggagaatgtgtacatggccaagctcgctgagcaagccgagaggtacgaggagatggtcgaattcatggagaaggtggccaagacggttgactctgaggagctcaccgtggaggagcgcaacctcctgtctgttgcatacaagaatgtgattggagcccgccgtgcgtcatggcgcattatctcctccattgagcagaaggaggaaagccgtggtaacgaggaccgtgtcacactcatcaaggactaccgtggcaagatcgagactgagctcaccaagatttgcgacggcattctcaagctgcttgaatcccaccttgtcccctcttccacttagcctgagtccaaggtcttctacctcaaaatgaagggtgactactacaggtaccttgccgaatttaagaccggggctgagaggaaggatgctgctgagaataccatggtggcatacaaggctgctcaggacattgctttggctgagctgcctcctactcatccaattaggcttgggctagctcttaacttctcagtgttctactatgagatcctcaactcgcctgatcgtgcttgcaacctcgcaaagcaggcttttgatgaggccatctcggagctggacaccctgagcgaggagtcctacaaggacagcactttgatcatgcaactcctccgtgataacctgaccctgtggacttcagacatctcggaggacaccgcggaagagatcagggaagctccgaagcgcgactccagcgaggggcagtaaagccggctttatgtgccctagaagcttgtagctagtgctttgctactgtgtaatgacacctatgtggctgtgattgttgtcgggaaatctggggctcccccgtatgtgaggttgctagcgatggttttgcagtctcgcctttaagctactcgtagcagagcaggtgggggtctgtggagccaggcctggttgggggtgggggagcctcttgaactgcttggtggcacttcctgtttttctgtttgcctttttattggtgtttattgttatggtc

SEQ ID NO: 623 - DNA, 865 bp, Zea mays
  CDS (62)..(808)
gtccacacttcgcaacaacagaaaaaaatcctttttttaattgaattttttatcaatcaaaatgactgaaacaagagagatcaacgttttcatggccaagctcgctgagcaggctgaacgttacgatgagatggttgaagccatgaagaacgttgctgatttgggacaagaactcaccgttgaagagcgtaaccttctctccgttgcctacaagaacgtcattggtgcccgtagagcttcatggagaatcatcacctctattgagcaaaaggaagaatccaagggaaacaccgctcacgttgagagaatcaaggagtacagaaagaaggtcgagaacgaagtctccaagatctgcgctgatgtcctcggaaccctcgacaacaagttgattccaaacgctcaaaccaccgagtccaaggtcttctactacaagatgaagggagattaccaccgttacctcgccgagttcgccaccagcgaagctagaaaggaagccgccgacaactccttggctgcctacaagtccgccaccgacattgctaactccgagttggccccaacacacccaatccgtttgggacttgccctcaacgcctccgttttctactacgaaatcatgggatcaccaaagcaagcttgcgagttggctcgtaaggccttcgacgacgccattgccgagttggatcaactcaacgaggagagctacaaggactccactttgattatgcaattgttgagagataacctcaccctctggacctctgacttggagggagacaaggccgacgctgaaccagaagccgccaactaagaatcttcctttcctcacacaacactttgtataaatacttctatctttatttat

SEQ ID NO: 624 - DNA, 865 bp, Zea mays
  CDS (62)..(409)
gtccacacttcgcaacaacagaaaaaaatcctttttttaattgaattttttatcaatcaaaatgactgaaacaagagagatcaacgttttcatggccaagctcgctgagcaggctgaacgttacgatgagatggttgaagccatgaagaacgttgctgatttgggacaagaactcaccgttgaagagcgtaaccttctctccgttgcctacaagaacgtcattggtgcccgtagagcttcatggagaatcatcacctctattgagcaaaaggaagaatccaagggaaacaccgctcacgttgagagaatcaaggagtacagaaagaaggtcgagaacgaagtctccaagatctgcgctgatgtcctcggaaccctcgacaacaagttgattccaaacgctcaaaccacctagtccaaggtcttctactacaagatgaagggagattaccaccgttacctcgccgagttcgccaccagcgaagctagaaaggaagccgccgacaactccttggctgcctacaagtccgccaccgacattgctaactccgagttggccccaacacacccaatccgtttgggacttgccctcaacgcctccgttttctactacgaaatcatgggatcaccaaagcaagcttgcgagttggctcgtaaggccttcgacgacgccattgccgagttggatcaactcaacgaggagagctacaaggactccactttgattatgcaattgttgagagataacctcaccctctggacctctgacttggagggagacaaggccgacgctgaaccagaagccgccaactaagaatcttcctttcctcacacaacactttgtataaatacttctatctttatttat

SEQ ID NO: 625 - DNA, 1179 bp, Glycine max
  CDS (42)..(389)
attcggctcgagcgtaaaccctaatttcggaaagatcggcgatgactgcctccaaggatcgcgagaacttcgtctacatcgccaaactcgccgagcaggccgagcgttacgaagagatggtggaatcaatgaagaacgttgcgaatctcgacgttgaactgacggtggaggagcggaatttgctttctgttgggtacaagaatgtgattggtgctcgcagagcgtcctggaggatcctgtcttccattgagcagaaggaagaaacaaaagggaacgagttgaatgcgaagcggattaaggagtacagacagaaggttgaattggagctatcgaacatctgtaatgatgttatgagagtgattgatgagcaccttatcccttcggctgcatagggtgaatccactgtgttttactataagatgaaaggagattattatcgttatcttgctgaatttaagtcaggcaatgagaagaaggaagctgctgatcagtctatgaaagcatatgagtctgctaccgctgcagcagaggctgatttacctcccacacatcccatccgattgggtctagctttaaatttctctgttttctattatgagatcttgaactcccctgaaagagcctgtcatcttgcgaagcaagcttttgatgaagctatttctgagcttgacaccttgaatgaggagtcatacaaagatagcaccttaatcatgcaacttctcagggacaacctaactttgtggacttctgacatcccagaagatggagaagatgcccagaaagtgaatggcactgccaagcttggtggaggtgaggatgcagagtgagtccgatggatgatggaatcttccataggattcgatgcatgcgtttgggaatgaaacatgagggccgattacttatctgtgtattagctagagatagggattctattgtttcctctttgtttcctgttggattgcccaatacttcccgataggggaaagagatactccatttgtgctatatttatggtatgtttttatttgtgtggtgtctggaaatggcctatttcattcccaatccgtttcctccagtctctgggggatttgattgatgagaattgcttatggtgggtgtatttccttttccaatgaaatgctacaacatttactgcaaaaaaaaaaaaaaaaaaaaagg

SEQ ID NO: 626 - DNA, 1149 bp, Oryza sativa
  CDS (105)..(875)
gccttccccccccccattcgtcgcctcctgtcccgggggccgcgagcaaaacccccacccccaaatcgcagcctcgctcagctcgatctctctctcgtctcgccatggcccccagcgacgacctcgtctacatggccaagctcgccgagcaggccgagcgatacgacgagatggtggaggcaatgaatagtgtggcaaagttagacgaggggctgacaaaggaggagaggaacctcctctcagttggctacaagaatttgattggtgcaaagcgtgcggcaatgcgtatcattggatccattgagctaaaggaggagacaaagggcaaggagagtcatgtaaggcagactgctgagtatcgtcgcaaggtggaggctgagatggataaaatctgctgtgatgtcataaacattattgacaagtaccttatcccacattcctctggagctgagagctcagtcttctactacaaaatgaagggagattactaccggtaccttgcagagttcaagactgggactgagaagattgaagtgtctgaactgtcactcaatgcttatgagactgcttccaaaactgcgcagacagatctcactccaactgaccctatcagacttggtttagctctgaatatatctgtcttctactgtgagatcatgaactcacctgacaaagcttgccaacttgctaagaacgcctttgatgaagctgttgcggagcttccctccctcagtgaggagaattacaaagatagtacactgatcatgcaacttctgagggataatctagcactgtggaattctgatatggctgatgatgcagacgatattagggaacgaacagatacaactggtgctaaaggtgaccctgcagcgtgatggaggtgctaatagctggtagagtcgaagcataacaacaacaacaacaagggtgtggtggggtgcggaaggactaccatttactcactgttagtgttaggttctgtagtgtaggagttgagctgctgagtaaccctcgcttgtagtctgggcctgattcttcgacttcttgagcaacatcgtgtactaagcactcgctgatcgctcttttgcaagcattgtttttttttgggttactcttgatgatgattaggcaaaagttatctggttc

SEQ ID NO: 627 - DNA, 1149 bp, Oryza sativa
  CDS (105)..(449)
gccttccccccccccattcgtcgcctcctgtcccgggggccgcgagcaaaacccccacccccaaatcgcagcctcgctcagctcgatctctctctcgtctcgccatggcccccagcgacgacctcgtctacatggccaagctcgccgagcaggccgagcgatacgacgagatggtggaggcaatgaatagtgtggcaaagttagacgaggggctgacaaaggaggagaggaacctcctctcagttggctacaagaatttgattggtgcaaagcgtgcggcaatgcgtatcattggatccattgagctaaaggaggagacaaagggcaaggagagtcatgtaaggcagactgctgagtatcgtcgcaaggtggaggctgagatggataaaatctgctgtgatgtcataaacattattgacaagtaccttatcccacattcctctggagcttagagctcagtcttctactacaaaatgaagggagattactaccggtaccttgcagagttcaagactgggactgagaagattgaagtgtctgaactgtcactcaatgcttatgagactgcttccaaaactgcgcagacagatctcactccaactgaccctatcagacttggtttagctctgaatatatctgtcttctactgtgagatcatgaactcacctgacaaagcttgccaacttgctaagaacgcctttgatgaagctgttgcggagcttccctccctcagtgaggagaattacaaagatagtacactgatcatgcaacttctgagggataatctagcactgtggaattctgatatggctgatgatgcagacgatattagggaacgaacagatacaactggtgctaaaggtgaccctgcagcgtgatggaggtgctaatagctggtagagtcgaagcataacaacaacaacaacaagggtgtggtggggtgcggaaggactaccatttactcactgttagtgttaggttctgtagtgtaggagttgagctgctgagtaaccctcgcttgtagtctgggcctgattcttcgacttcttgagcaacatcgtgtactaagcactcgctgatcgctcttttgcaagcattgtttttttttgggttactcttgatgatgattaggcaaaagttatctggttc

SEQ ID NO: 628 - DNA, 1093 bp, Glycine max
  CDS (84)..(860)
ggtctccctcatttgttcactttctctctctaaatccctaaaccagatctcgcactcgcgctttctctctctaggattcgacaatggcggccgctccctcgcctcgcgaagagaacgtgtacatggcgaagctcgccgagcaggccgagcgctacgaagagatggtggagttcatggagaaggtctccgccgccgccgacaacgaggagctcaccgtcgaggagaggaacctcctctccgtcgcgtacaagaacgtgatcggagcgcgccgcgcctcgtggcgcatcatctcctcgatcgagcagaaggaggagagccgcggcaacgaggaccacgtctccgtcatccgcgactaccgatccaagatcgagtccgagctctccaacatctgcgacggtattctcaagctcctcgactctcgcctcattccctccgcttcctccggcgattccaaggtcttctacctcaagatgaagggagattaccacaggtacctcgccgagttcaagaccggcgccgagcgtaaggaggctgccgagagcactctctctgcatacaaagccgctcaggacattgcaaatgccgaactgcctccaactcatccaattaggcttggccttgcacttaacttctctgtattttactacgaaatccttaactctcccgatcgtgcctgcaaccttgcaaaacaggcttttgatgaagctattgctgaattggatacactgggagaggagtcatacaaggatagcactctgatcatgcaactccttcgtgataacctcaccctttggacctctgacatgcaggatgatggagcagatgaaattaaagaagcagcaccgaaacaggatgaccagtaaaaatattttactgctaattagaattgaacttctcctccatatctttttgaagggagaaggtgtttgttgctaatatctctttggtactgagattttaggcattcatgtttgttatgattgtggatgtactgggccgtttttagtttgtccttccattttcaagtgttttccaaattgcctattttattaaggacgctgaagtttttattatatggaattggaattttaag

SEQ ID NO: 629 - DNA, 1093 bp, Glycine max
  CDS (84)..(443)
ggtctccctcatttgttcactttctctctctaaatccctaaaccagatctcgcactcgcgctttctctctctaggattcgacaatggcggccgctccctcgcctcgcgaagagaacgtgtacatggcgaagctcgccgagcaggccgagcgctacgaagagatggtggagttcatggagaaggtctccgccgccgccgacaacgaggagctcaccgtcgaggagaggaacctcctctccgtcgcgtacaagaacgtgatcggagcgcgccgcgcctcgtggcgcatcatctcctcgatcgagcagaaggaggagagccgcggcaacgaggaccacgtctccgtcatccgcgactaccgatccaagatcgagtccgagctctccaacatctgcgacggtattctcaagctcctcgactctcgcctcattccctccgcttcctcctaggattccaaggtcttctacctcaagatgaagggagattaccacaggtacctcgccgagttcaagaccggcgccgagcgtaaggaggctgccgagagcactctctctgcatacaaagccgctcaggacattgcaaatgccgaactgcctccaactcatccaattaggcttggccttgcacttaacttctctgtattttactacgaaatccttaactctcccgatcgtgcctgcaaccttgcaaaacaggcttttgatgaagctattgctgaattggatacactgggagaggagtcatacaaggatagcactctgatcatgcaactccttcgtgataacctcaccctttggacctctgacatgcaggatgatggagcagatgaaattaaagaagcagcaccgaaacaggatgaccagtaaaaatattttactgctaattagaattgaacttctcctccatatctttttgaagggagaaggtgtttgttgctaatatctctttggtactgagattttaggcattcatgtttgttatgattgtggatgtactgggccgtttttagtttgtccttccattttcaagtgttttccaaattgcctattttattaaggacgctgaagtttttattatatggaattggaattttaag

SEQ ID NO: 630 - DNA, 999 bp, Triticum aestivum
  CDS (64)..(840)
cgccgagaaacagcaacagccacagccacacgcccacgcgcacacaccagatcgtcgacagcgatggcaaaggcagcggcaacgagggaggagatggtctacttggcgaagctggcggagcaggccgagcggtacgaggagatggtcgagttcatggagaaggtcgtggcggcggcggggaccgtcgagctcaccatcgaggagaggaacctgctctcagtcgcgtacaagaacgtcatcggggcgcgtcgtgcttcctggcgcatcgtgtcctccatcgagcagaaggaggaagggcgtggagcggcggggcacgccgccgcggcgcgcgggtaccgcgcacttgtcgaggccgagctctccaacatctgcgcggggatcctccgtctcctcgacgaacgcctagtccccgccgctgccgccgtcgacgccaaggtattctacctgaagatgaagggagactaccatcgctacctcgcggagttcaagtcggccgccgagcgcaaggatgccgctgactccaccctcggtgcctaccaggccgctcaggacatagccatgaaggagctgccaccgactcaccccatcaggctgggcctcgcgctcaacttctccgtgttctactatgagatcctcaactcgcctgatcgtgcgtgctcgctcgccaaacaggccttcgatgaagccatcgctgagctggattccctcggagaagattcctacaaggacagcaccctgatcatgcaacttctccgtgacaatctcactttgtggacctctgatatgcaggatgacgctggcgatgaaatgagggattcaagcaagcctgaggatgagcagtagtgaagggtcctagctactgccctctttctctcttaaccttcgggtagttatgatgcttgtacaaggaccattttcgtgtgtcctttgttgctgggtcttttatctaccctttctttcgttatattgttatacatcgccgtcctcgtgcattatttt

SEQ ID NO: 631 - DNA, 999 bp, Triticum aestivum
  CDS (64)..(420)
cgccgagaaacagcaacagccacagccacacgcccacgcgcacacaccagatcgtcgacagcgatggcaaaggcagcggcaacgagggaggagatggtctacttggcgaagctggcggagcaggccgagcggtacgaggagatggtcgagttcatggagaaggtcgtggcggcggcggggaccgtcgagctcaccatcgaggagaggaacctgctctcagtcgcgtacaagaacgtcatcggggcgcgtcgtgcttcctggcgcatcgtgtcctccatcgagcagaaggaggaagggcgtggagcggcggggcacgccgccgcggcgcgcgggtaccgcgcacttgtcgaggccgagctctccaacatctgcgcggggatcctccgtctcctcgacgaacgcctagtccccgccgctgcctaggtcgacgccaaggtattctacctgaagatgaagggagactaccatcgctacctcgcggagttcaagtcggccgccgagcgcaaggatgccgctgactccaccctcggtgcctaccaggccgctcaggacatagccatgaaggagctgccaccgactcaccccatcaggctgggcctcgcgctcaacttctccgtgttctactatgagatcctcaactcgcctgatcgtgcgtgctcgctcgccaaacaggccttcgatgaagccatcgctgagctggattccctcggagaagattcctacaaggacagcaccctgatcatgcaacttctccgtgacaatctcactttgtggacctctgatatgcaggatgacgctggcgatgaaatgagggattcaagcaagcctgaggatgagcagtagtgaagggtcctagctactgccctctttctctcttaaccttcgggtagttatgatgcttgtacaaggaccattttcgtgtgtcctttgttgctgggtcttttatctaccctttctttcgttatattgttatacatcgccgtcctcgtgcattatttt

SEQ ID NO: 632 - DNA, 1323 bp, Zea mays
  CDS (132)..(929)
ccgcacaaactcgtcgcttccgctccacaggatcctctgcgccacccacaaccgtgcgaccgtccgtgctgccggcgaccccgatccgccgacccgtcccgtcccaccacaccctaccgccgctcgcagctatgtcgccgtcggagccgacgcgggaggagagcgtgtacatggccaagctggcagagcaggcggagcggtacgaggagatggtcgagttcatggagcgcgtcgcgcgctccgccggcggcgccggcggaggggaggagctctccgtggaggagcgcaacctgctgtccgtcgcctacaagaacgtcatcggcgcccgcagggcctcgtggcggatcatctcctccatcgagcagaaggaggagggccgcgggaacgaggcgcacgccgcctccatccgcacctaccgctccaagatcgagaccgagctcgcccgcatctgcgacggcatcctcgccctgctcgactcccacctcgtcccatccgccggcggcgccgagtccaaggtcttctacctcaagatgaagggtgactaccacaggtaccttgctgagttcaagtctggtgcagagaggaaggatgctgcggagagcaccatgaatgcctacaaagctgctcaggacattgctcttgcagatctggctccaacccaccccatcaggcttggcctcgctctcaacttctcagtgttctactacgagatcctgaactcccctgatcgcgcctgcaaccttgcaaaacaggccttcgatgaggcgatctctgagctagacagcctgggagaggagtcctacaaggacagcactctgatcatgcagctcctgcgcgacaacttgaccctatggacttccgacaccaacgaggatggcggtgacgagatcaaggatgctgctgccccgaaagaatctgcggagggtcagtaagatggattcagtctcacgacctgctgctgctgatgttgaggagtgaccagaaccagaaccgccgtcctcgattctgatagattatcttctagtataccttgtgttgttgctgttgttgtcgtcgtcgcgccggtgtatgcgatgaagctgccattgctgctgttttaattaagcattctagatgttataccgcatgctttgtttcggtttctatgtcgataaatggtggccggatgctggttttcgtgctccgagccggccaccaggaagaagacctgcctgcccttgtgggtgcagcgttgttagaatgacctacggtgtatttgactttgacaggcctgctgcctagtggactgatattctgttatgcgcaaagctatttgccttgaaa

SEQ ID NO: 633 - DNA, 1323 bp, Zea mays
  CDS (132)..(506)
ccgcacaaactcgtcgcttccgctccacaggatcctctgcgccacccacaaccgtgcgaccgtccgtgctgccggcgaccccgatccgccgacccgtcccgtcccaccacaccctaccgccgctcgcagctatgtcgccgtcggagccgacgcgggaggagagcgtgtacatggccaagctggcagagcaggcggagcggtacgaggagatggtcgagttcatggagcgcgtcgcgcgctccgccggcggcgccggcggaggggaggagctctccgtggaggagcgcaacctgctgtccgtcgcctacaagaacgtcatcggcgcccgcagggcctcgtggcggatcatctcctccatcgagcagaaggaggagggccgcgggaacgaggcgcacgccgcctccatccgcacctaccgctccaagatcgagaccgagctcgcccgcatctgcgacggcatcctcgccctgctcgactcccacctcgtcccatccgccggcggcgcctagtccaaggtcttctacctcaagatgaagggtgactaccacaggtaccttgctgagttcaagtctggtgcagagaggaaggatgctgcggagagcaccatgaatgcctacaaagctgctcaggacattgctcttgcagatctggctccaacccaccccatcaggcttggcctcgctctcaacttctcagtgttctactacgagatcctgaactcccctgatcgcgcctgcaaccttgcaaaacaggccttcgatgaggcgatctctgagctagacagcctgggagaggagtcctacaaggacagcactctgatcatgcagctcctgcgcgacaacttgaccctatggacttccgacaccaacgaggatggcggtgacgagatcaaggatgctgctgccccgaaagaatctgcggagggtcagtaagatggattcagtctcacgacctgctgctgctgatgttgaggagtgaccagaaccagaaccgccgtcctcgattctgatagattatcttctagtataccttgtgttgttgctgttgttgtcgtcgtcgcgccggtgtatgcgatgaagctgccattgctgctgttttaattaagcattctagatgttataccgcatgctttgtttcggtttctatgtcgataaatggtggccggatgctggttttcgtgctccgagccggccaccaggaagaagacctgcctgcccttgtgggtgcagcgttgttagaatgacctacggtgtatttgactttgacaggcctgctgcctagtggactgatattctgttatgcgcaaagctatttgccttgaaa

SEQ ID NO: 634 - DNA, 1569 bp, Zea mays
  CDS (7)..(1350)
gtttcgatggcgctgctagtgcggagggcacggagggcggcgaccaaggccgcggtgtccctcgccggcagaaccggcagcgtggagcttgccatcccggcgcacttccggtgcccgatctcgctggacctcatgcgggaccccgtcacggcgccggcgggaatcacgtacgaccgcgagagcatcgaggcgtggctggacacgggccgcgccacctgccccgtcacccacgcgccgctccgccacgaggacctcgtccccaaccacgccatccgtcgcgtcatccaggactggtgcgtcgccaaccgctcccgcggcgtcgagcgcatccccacgcccaagatccccgtcacgcccgtccaggcctccgagctcctcttcgacctcgccgggtccgcgcgccgccgcgatgccgctgcgcggtgcgccgaggtggtcaccaagataaaggtcctcgccagggacagcgagcgaaacaggcgctgcttcgcgtccatcggcacgggccgcgtgctcgccgccgcgttcgagtcgctcgctgctgctgctgctgctgacgccgccgcaccggcggggcgcgtccttgaggacatcctggcggcattggtctgcatgatgccgttggacgaggaggccgccaggacgttggccttgccgacctcgctggggtctctggtcgccattgctgagaacggcagcttggcaggaaggctgaacgccgtgctggcaatcaaggaggtcgtctcatgcgacggggcggtcactgatctgagcgggaaggccgacgagatcgtagacgcgctggcaaagatcatcaagtctccaatctgtcctcaggcaaccaaggccggcatggtcgccacctatcacctggcgctatacgacgagcgtgtcgcggcgcgccttgccgctgccgggctcgtccccgtgctcgttgaggtccttgtagacgccgacaagagcatgtccgagaaggcactggccgtgctcgacgcggtgctcgcctcggaggaaggccgcgcgagcgcgcgggcgcacgcgctcgccgtgcccatgctcatcaagaagatgttccgcgtgtccgacctggctacccagcttgccgtgtcggcgatgtggcggctcggaaaggcgcacagcgacggcgaggatgacggtgcggtgacgcggtgtcttgtcgaggcgctgggggttggggcgttccagaagcttctcctgctcttgcaggtcggctgcagggacgcaaccaaggagaaggccaccgagctgctcaagttgctcaacaagtacaagagcgtaggcgaatgcgtcgacgctgtggatttcagagggctgaataagctgtcatcttaaatcaatgggggctgcgatgtaaaaaatgtgtattttgtaaaacagagagacgatttaacttgtaagtagatgcagataggctagttgcaattttgttgggcgtgcttgcatgctatttcagcagcttagtttcaaacggaaacttagatccgaattccgttttatgaagaacttcagtgtaaatttcttgttttaaaagatgtttttttttctttt

SEQ ID NO: 635 - DNA, 1539 bp, Glycine max
  CDS (63)..(1355)
gcaaaaagaaagaaagaaacaaagatcgttcattgctttgtagtaagatcagatcatcaaaaatggttttgtcttggtcaagaaggaacgttttccgccgtgccaagaaggagaagtcacaaactcaattggaagtggaggttgtgattcccaaccactttcactgcccggtgagtctggagctgatgacagacccagtgactttatcaaccggcatcacctacgaccgtgtgagcattgagaagtggatcgagggagggaacagaacctgccccgtcaccaaccaggtgctgacaaccttcgacatcatccccaaccacgccattcgcaggatgattcaggattggtgtgtcgaaaatagttcttatgggattgatagaatccccacacctcgtattcctatctcggcatacgaggtttccgacacgtgtaccaggatcttgtcggcttgccagcgtggagatgacaagaggtgtcaggagttggtcgggaagattaaggtttggagtagagagagtgagaggaacaagaggtgcatagttggtgctggtgctggtgctgttcttgcatatgcctttgattgtttctcaagtaactctattgaaaaacatgtggtgcttttggaggaggttttggaggtgatgacatggatggtcccacttggggaagagggtgtttctaaattgagttcaggagcttctttgaattcgttggtatggtttctagaggggaaagaccttgcatcaaggcaaagtgctgctttgttgcttaaagaagtgtgtgttcaagaattggccaaggttggagaagttgttgaagctttggttaagatggttagggagcctattgggagcacttccaccaaggcttgtttggcaacaatttttaacttggtgtcgttggctgcgaatagagagggaattgctcaaagatttgtggagttgggtttggtttcacttttgctagaggctattgttgatggagagaaaggggtgtgtgagaaggcacttggggtgttggattgcatttgtgattgcgagaaggggaaggaggttgtgaagagcaatgctctagccttgcctcttgttgttaggaagcttttgagggtgtcaccattggcttcaggttttgctgtgtctattcttaggaagatttgtgacaagagggaggaagggattctgattgaggcacttcaagttgggctttttcagaagctcttggttctgctgcaggttgggtgtgatgagagccccaaggagaatgctaccgggttgttgaaactgttgaatggttacaggaacaaagcggagtgcactgactcatcattgaatttcgagcatcttaagaagccattttaattagtgatgaatggcaactagattcatttattctttttttttttttgtgtaggtcaatttattgatacagaattctttgctgtaaaaagatacacacatcaattgattctttgaattcattctttggaaaattgattcgaagtaattagttagatataataatcatggttgtggcaaatac

SEQ ID NO: 636 - DNA, 3772 bp, Zea mays
  CDS (131)..(3043)
cctctcaccttttcgctgtactcactcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcaggaggggatcggaaggatggcggcgtcggtttccagggccatctgcgttcagaagccgggctcaaaatgcaccagggacagggaagcgacctccttcgcccgccgatcggtcgcagcgccgaggcccccgcacgccaaagccgccggcgtcatccgctccgactccggcgcgggacggggccagcattgctcgccgctgagggccgtcgttgacgccgcgccgatacagacgaccaaaaagagggtgttccacttcggcaagggcaagagcgagggcaacaagaccatgaaggaactgctgggcggcaagggcgcgaacctggcggagatggcgagcatcgggctgtcggtgccgccggggttcacggtgtcgacggaggcgtgccagcagtaccaggacgccgggtgcgccctccccgcggggctctgggccgagatcgtcgacggcctgcagtgggtggaggagtacatgggcgccaccctgggcgatccgcagcgcccgctcctgctctccgtccgctccggcgccgccgtgtccatgcccggcatgatggacacggtgctcaacctggggctcaacgacgaagtggccgccgggctggcggccaagagcggggagcgcttcgcctacgactccttccgccgcttcctcgacatgttcggcaacgtcgtcatggacatcccccgctcactgttcgaagagaagcttgagcacatgaaggaatccaaggggctgaagaacgacaccgacctcacggcctctgacctcaaagagctcgtgggtcagtacaaggaggtctacctctcagccaagggagagccattcccctcagaccccaagaagcagctggagctagcagtgctggctgtgttcaactcgtgggagagccccagggccaagaagtacaggagcatcaaccagatcactggcctcaggggcaccgccgtgaacgtgcagtgcatggtgttcggcaacatggggaacacttctggcaccggcgtgctcttcactaggaaccccaacaccggagagaagaagctgtatggcgagttcctggtgaacgctcagggtgaggatgtggttgccggaataagaaccccagaggaccttgacgccatgaagaacctcatgccacaggcctacgacgagcttgttgagaactgcaacatcctggagagccactataaggaaatgcaggatatcgagttcactgtccaggaaaacaggctgtggatgttgcagtgcaggacagggaaacgtacgggcaaaagtgccgtgaagatcgccgtggacatggttaacgagggccttgttgagccccgctcagcgatcaagatggtagagccaggccacctggaccagcttctccatcctcagtttgagaacccgtcggcgtacaaggatcaagtcattgccactggtctgccagcctcacctggggctgctgtgggccaggttgtgttcactgctgaggatgctgaagcatggcattcccaagggaaagctgctattctggtaagggcggagaccagccctgaggacgttggtggcatgcacgctgctgtggggattcttacagagaggggtggcatgacttcccacgctgctgtggtcgcacgtgggtgggggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttggaaagcagccgctttccccaccagcccttagtggcgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtggggaagttcattcccgtctatcttgctcagggcatcctccaacatgaccccttcgaggtcctggaccagaggggagtgggcgagctggtgaagtttgctacagagaggggccgcaaagctaggcctaacttgaaggtgggcatttgtggagaacacggtggagagccttcctctgtggccttcttcgcgaaggctgggctggattacgtttcttgctcccctttcagggttccgattgctaggctagctgcagctcaggtgcttgtctgaggctgcctcctcattggcaaccggattgcctgctgctggtggatgtggtgatcaacagtattattacagagccatgctatgtgaacattactagtagcagtgctcataaaagctacaatcccatgtcctttttttccccagtcatgtaaaacttccaaactgctccatggttcaaaactctgttcttcaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatgaggggggagttttaaagaggaaaagatattttttaagaggtattataaattagaaagttgtatatgagggggtaataaaaataaagtaaaaggattgaagtatatattagttagaaatttagaaaaatagttagagtgttagtatttttttgtgttgtttgtgtaagtattgtatattttttgtaatggttggtgtagaataaaaatatttttgtaattaagaccggaataatacgagtaggtgtgaagatgttggggggggggatggggatggggtagcattgtgataaagagtgttttataatgaatattaaagatagtatttaattataattcttatggtaggataagtagtgatattaagactaattaaataagtagcgggaacagtatcagtaagcacgatacgcacatacccc

SEQ ID NO: 637 - DNA, 2092 bp, Zea mays
  CDS (219)..(1715)
cgtcagcccctctctctcccggcgtggggtggccatagcttcgctgcctccacttgtcttctttgtttcaccatcagttcaattcagtttctcgccggtcgccgctggcttgctagttgctactgcgcgcacttcagctgcccgctgttgtaccgcggactctacctcatcattcgccttgctgcctccgccgcctaggtcgcgcaggttcggacgccatgaccgcgacgccggcggtgatcgggctgagcgcccgcggcaaccgcctcctggccacctcattcggttccgctgagctcgctcccccggacgcgtacccgtcgcggcagttcgccgccgcagcgcccaagctcaccgtcgtggcgcaccgcgcctccgcctccgcctcctccccggccgacatcgggggcgccggccacgcgcgcgcgcacgccatccgggcgctcaggaaccactccgcgccggcgctggccccgcctcctccggctgacccggctccggagctggactccaagttcgagttcgagttcgagtcctcgctggaggccatcgtgctgctgcagcgctccatgctcgagaagcagtgggagctgcccttcgaggacgacatctcctccacggaggacgaggacgaggacgagaggtccacggtggtggtggcgcggtcgggcgtctcggcgcggcagcggcggatgagcgggcggcggcggggcgctgtcgttggccggaagagcgtcaccgtcagcccggagctgatgcagagccggaaccgcatctacctccggggcaccgtcagcaaggacctcctcacgcacaagcaggtcgtccagctctccaggaagatcaaggacggcatctggcttcagcaccaaagatccaagctgaaggagaaactgggcaacgagccgtcatacaagcagctggcgcaatcgctgcggataccagctcctgagctgcgagcgaggatgcgcgagtcgtttcttgcgagggagatgctggcgatgagcaacacccgtctggtgatatccattgcccagaagtacgacaacctcggcgtcgagctgccagaccttattcagggtggtctgatagggctgctccgtgggatcgagaagtttgatgcctcaagggggtttaggatctccacctacgtgtattggtggatccgtcagggggtttcaagagcattggccgacaactcgagatcgttcaggctccctacttatttgcacgagaggttggtagccattcgcggcgcaaagtacgcgttagaagaccaaggaattgctccgacagtagagaacatagcggagtcgctcaacatatccgagaagaaagtgcacaacgctacagaggctgtgcacaaggttatttcactggatcaacaggcgttcccctccttaaacggcctacctggggatacactccatagttacatagaggatcaaaacgttgcaaatgatccgtggcacggatttgaggaaaggtacctcaaggaggaagttaacagtcttataaattcaactctcaacgagcgcgagagggacattattcgattatatcatggcataggaaagcagtgccatacatgggaggatatcagcagacaattcgggttgtcgagggagcgcgtgaggcaggtagggctcgttgcgatggagaagctgaagcatgctgcaaggagggaacatttggatgcgttgcttgaggaatactgagtgagatgttcttcgcttgagtcggttaattccaccgttgcagtggttgtatatactcggaaacataggggggcaggcacatcatccttgaaaggcttcactgccactcactcactctgcagataactatacatgtacatctgtgacgatcagtaggcatgcatagttaaagcatctgtggctgcaaaatcgtcaaggcgatccaacaaaaggagaaccttttttttggtcttggaagctttacaaagtgtgatgtggtatgtatatgcaaatgtaatgtatcagtaattcagtagagcaataacgtttatgtcctggatttgtattcttgtccagttacatagaaggaaaaaatgcttacaactgcaaaaaaa

SEQ ID NO: 638 - DNA, 2053 bp, Zea mays
  CDS (166)..(1815)
ctcgaggccggccgggagcccagcttgcctgccacctggtcttgaccctctcctggataggaggagcagcagccagagggacatcaaactgtgctgcctgcgtgtgtgtcttctttcttgcctctcccttcttcaacctttgctagcttgccagggagggagtccatgaattccagcagaagcctcctctcttcgcccctctttgctagctcgtctccaaacttcaggagcagtgcttccgtctcctcctccccatccccatcccgcaccacagcagttccaatgatacatgacaccagcagcagcagagcatccacggcgtgccactactcgccgtcgcttgtggcagaggagcagcttcacggctccaaagacaccttgaccttgaagggcgagaaggctttgctcgagttgcttctaggcatggctctggaccagcacgttgacggcaggaagctcattacccaacaggaggctgaggatagtgatttcgagagctatttgagagaagcaacaagccgagtgctttaccagccaacattcatgtacggagcttctgaatttattagcagtgaagaggatgatgatgattctatttcggagagctcttcagcatcattggccaaaccagctggaactttggatcttggcaagctgacagaggaaccacagttggatgtaccacagcctcaccgccgcagtgtggatccaaaccattcgtatgatcaagtgtttattagatccactcggttactggagaggagatccaagaaacgcaacggcggccacagggctttggataatggtgtggcgtgcagtggtgtgaactcaaagagaaaagacaagtttggcagagttcttgatccagacgagccttttaggttgtttctacgggatcgagagacgacagagttcttgacagcgaaagaggagaaacagatgttcagtcaaatacaggatcttatgaagctggaggaggctcagcgtaacctgcaagctcagtgtggtcgtgaaccaacagttgaagagtgggctcaagccgtaggaatgagctgcagggagctgcaatcctgtgtgcgcaccggaagacggtgccgagagaagatggcccgctccaacttccgccttgtgatacatgttgctaggaaatatgaaggatgtggccttgacattcaggacctggttcaggatggatgctgtgggttgatgaaaacctttgagaagttcaacccgagcaagggatgcagattcccgacctacgcgtactggtggatacgccagtcgatcaaaaagtccatcttcaagaattcaagactaatccggttgccggagagtgtgtatgcacttttgaggaaggtgggcaaagcgaggatggaatgcataatggacggggagcagccgacgaacgaggtggtggcaaggcgtgctggcatcacgattgaaaagctggcgaaactgagagcgaaaaccaggaaagtacggtccatgcaggatcgagtctggtcagacgacggtgtgacataccaggagatcaccgaggaccccaacattgaaggtcctgaggtgagcgtggacaggctgatgatgcggcagcaggtgcgcagcttcctggcggggatcctgagcccccgggagaaggagatcatcgagcaccggttcggcatccacgacggccagcccaagaccctgcatgtcatcggcgacatgtacggcctgtccaaggagaggatccgccaggtgcagaacaaggccctggacaagctcagaaacagcatctcagcacagggcttccacgtctactttgatttgctaacttaagactcttcaacacgcaaacattacatgtacaatgacattccattctgccaatgggtatattatgtatagatagaccaagaattcatgtttttttcctttcccttttgccatttgacattcattcatccttgtactcaacaatggatactcatacatggttgtttgaggagcaaagcttactttaaatgtatggatgtacgtttaagtgcaaaaaaaaaaaaaaaaaagcgccctc

SEQ ID NO: 639 - DNA, 1875 bp, Zea mays
  CDS (101)..(1717)
ccccaccgtcgcctcgctcgacctccacctctctttcctcccggcagcaatggaggcggcacccaggtgaggcgagcaagcagccagccctggctccccgatggcgtgcctggcgccgcagttcaagtgggcgccgtcggccgccgcccacatgccttcctcgtcctcgtcctcgtcctactccaggtgctccgcgctccgcgtccactgcgccgtcacctccgccgctgtcgtcgaggaccgcaccaacggcagcgcggcgcagctgaggctcgcttacgcggctccggcgattcagagaaactttgaggcaactctggcatcagaagcacttctaaatgaagaggcggtagtagcagcggcagccgcagaggctgttgctcttgccagagcagctgccgaagctgcccaagaagttgttcagatagtacaaagaaacaaccatcagccggtaattagaccaaaaaagtgtgtggacaactacttggcaaatgaaatccttcgcacagagatgcgatcgagcagtcctgacatgtatgctaataatcctttgatggagtatctggactcttatggtatcatggatgctgaagatgaattagatgcttatgcacagtatactgagaacatagctgtgaaatctgctcgtcaatctgagagaaaagctaggagaactagagcagcaataaaagctagcacaaccctccatgcttcacaaaaggttgcattatcctcaaagaagaagcggtccaagggttcctcgtctagtatgaatcctttaggttcgttgtggaagatgaccggtaggagacttcttacagccaaggaagaggttgaattctcagaaggtattcaggatcttttgaagcttgaggcgatccaagctgagcttatagagtacaatggcggtcagccaaccttctcgcagtgggcaacagcagctggagttgatgagaaaactttgcgcaagcgcttgaattatggtatttattgcaagaacagaatggtaacatctaatgtgagacttgtaatctctattgccagagagtttgaaggccctggaatggacttttatgatcttattcaggaaggaatgcagggccttataaggggagctgaaaaatttgattcatcaaaaggttttaggttctctacgtattctcactggtggatcaaacaagcaatgcgtaaatctgtctcagagcaatcccaaatatttcgcttgcctgctcacatggttgaagcaagctaccgtgtaaaggagtgtacaaaacgacttcgccgtaagcttagaagacgacccaccaatgaagaaattgcagtggacactggtattccaattaaacgagttgaggcagcagtaaacctcccaaaatatagtgtgtcccttgatagcaaaattggttccaccgacatgacatatcaggaggtcacagctgatcccagtgctgagacagctgaagagatgctcaacagaatgtccatgaagaaggacgtacacatggcactagatactctcaccactcgcgagaagcaagttgttgttctgaggtttgggctcgaggatggtcggataagaaccctgcaggagatcggtaacatcatgggtgtgagcagggagagaatccggcagatcgagtctggcgcgttccggaaactaaggagcaagaagaaggtgaaggctttgaaggattatctggtgccagtaggcaattggtgaaccgtttgtttgcagaatttgttttccttttggttcctctttttttttttgaggattctgtacttgtaccattttacgtgggtcctcatgtaaaacacgctatcagaatacttgcatcacaagaggaaagagtagtttagttccgtgggaaaaaa

SEQ ID NO: 640 - DNA, 4337 bp, Emericella nidulans
  CDS (913)..(1107), (1162)..(1217), (1289)..(1459), (1535)..(1705), (1759)..(1884), (1949)..(3059)
ctcgaggttctccgcctagctggtgggttgaaccgcttactcagtgtcgaaaggataaatgagatcaatttctcccgtgaagccattcagcaaggtatccatgcggctctcgtggaacacaatgctaacgccctcaccaccctccttaagctcgacgagtttaccttccgttgccagaacaaccttgtagatgccgtgtataccctaccaccagagcatttccgcaccgctgtccgtgtggcacgacacgactctagcttcttccagcttctgctgcgtgcgagtgctgagtctgttccctacgacgattcggagatcacgcactgggcagttactacgggtggtccttttgaacaatggctactggatttcatgctgcagctgccggagcaaatcagggcgacaaccaagggaagtcaacaaatgttctatcatgggggcttgaatacagcaagtgccatgacagaaaggtatcttcgagatattctgggaacggatgagcttaaggtctggctagaagagtcgtcgtacgattttcccagcgaatggattgttgagagttgatgttgaagatattgaacaaatttctgtggtgatgagcgctggaagaatcagtgtacaacgaaaggagcagacaagactcccttgctatactcaggtgtgacacctgcaaatccagtaggaaaatacggtaattaatcccagggtcttttccctccgccaggcaccacgccccttgccggaaacgtcggccagtcgcgttcagcaccaggtacattccaatcaacaatgcaagaatgtgaaacgcgaagtatatatcagcgaacaacatcaagccgacataatcaaacggtttcagtctctatcgcgttttgcacttgagcgtcattttgattcctccgggatccagccatgtacctctccacggtcctcttcccactactggctctgaaccttggtctctcacacgcgagattcgtccgtgaaactctcgagctgacatgggaatacggatcacccaacggcggtacgccgcgcgagatggtcttcacgaatggggagtatccaggtccggatctgatatttgatgaagatgatgatgtcgaggtacaaccaagttttcaccgtatgtacatccgacaacagagttgacaatcacaggttcttgtcatcaataaccttcccttcaatacaaccgttcactggcatggtttagagtgtgtgccctttccgcgtcccatttctgcatggacctaaaaattcttgcattctcacacactctctctagaatgcgagaaacacctgaagcggacggtgtcccgggccttacgcaaacaccaatagagcccggtgcgacgttcacgtatcggttcagagcgtatccagctggtacgttctggtatcactcgcattacaaggggctcatgcaagatgggcaggtaggagcaatgtatattcggtacgtctgatcagattacaccttatctgcacgatgaagcccattgaggcagtcttattgatcatgtctcaatagccgcaagcctgatgctttgcgaccctacgcggttataacggaagacccgagagagttagcagaaatacagtacgcagaagataatccttatttgatgcttgctacggactggacatatcttacttcggcggagtatcataacatcgaggttgagtctggctataacgtcttgtaagctcgatttttcctttacttcctgttgcgaactaattcaattgcaaaagctgcgtggatagtctcctcatcaatggtcgaggctcagtctactgtcccggataccaataccttgaggaagtgagcgacacggccttactgtccgtcctcgaaggaacacatctgaccgagaaagggtaagtctctgcacgcgtacgcccagtcaagattatataaatactgatattgtatgatacatagctgcctccaaccggacctacataatgtccaaggcgactacggcccctggaacctctctgctgttcccacagaagtcgtctttaattgcaccccgtccagtgtcgagcccccggtgatctacgtcgatcccgaattcaacggttgggtcagccttaatttcattggcggcgctgcgcaaaaggccataactttttctgtcgacaatcacccaatgtgggtatatgaagttgacggacagtttgttgaaccgcgtgaagtcgaaatggttggcgtatactcgggagctcggtacgccgtcatgatcaagctagaccagacaccaggcgactacgcgattcggattgccgtcaatggcgcggatcaggttatgagcgtttacgccatcctctcgtatgtcaatcaggattggatccacagggagaatgtgcccaaggccgctatcggaccgcatacagatacagtgggctacatgaactacggcggtggcaacacatctgcagatgtacgccagcttctcttcacagaaaatctgccggcctttgcggtcccgcctcccccaccttcgagcgaggtctcaacaaccctacgtaccggcatgatccgcgtaaacaactcctactcttggtcattgggaaacaacgtgctgtacgagcccgaaatgacctcctcgacaccgctcctcttcgaaccggatccgctagccgtcatcgcaccaaagtacgccctcacgacagaaaacaacacctgggtcgacattgtcctcgaaatcactgccgacccgcgcgacctcatccacccgccacatccgatccataagcacggtaacagagcatatataattggcaacggggttggcaaattcagatgggagaatgtgagtgctgcagaggcagaagtaccggatttgttttacgtcaacgagactgcggcgttgcgggatacatttgtcacggatttttttgattcgcggctcatggatggggcatggatagttattcggtattttgtgcaggacaagttcccaagtatcttgcattgtcatattgcgtcccatcaaatgggaggaatggcgctggccttgttggacggggttgatgtttgggattcttaggtgagctctcatattcgtacttacaagatgtttgttctaaaattatttaataattattttttaatctctatgaaatggagaagcttttttttctctcttttttggcttctttaaattatatcagcatatttattaaatcattggaactctagatgtacgccccagagaagtagaactacatattcccaatcaacctcagaatacctctgaccctcccagccagcgtgatctgataccccgtctcaacaacccccttgcacatctcaaatgcaccatccccattctctttctccgcttctcccttcataatcggataatccacgcgcggcggaatcctcgtcgccataaggcgcgggaacctgtcaacgcaaatcgctttgatattacttacgccccgcagaccttcttcgcccgcaaaccggccatacccagatcccttgacgccgccgaatggcagctgtactgtgtagtagctgccaaaatcgttaacagagaccatgcctgcctttattcctgagacacaagcattcacgtcgcgcgtgttgtagccaaataccgaggcacctagcgcgtattgggtagaatttgcgatggtgattgcgtcggagacggaagatgcacgcatcatgaggaagacgggggcgaagagctctgtttgggcaatttccatggagggcgtgacgtctgcaaggagggtcggtgtgaaatagtgaccgagcggataggttgggtgttcgaattgtttcccaccagcgacgaggcgagcaccttggctgacggcgcggctgaatgagaaactccaagcgggagaaagaggccggggagatcatggcccccacgtctggggcacctgacttgttgtttgggttgttgggctttgtgtctagtaagactgagaccgaggcggagggctttaatgcgggaggtgacggtgtcaaggagtttgtgtatacgccagggagggcaatgacgcgctccaacccgatgcagttttgaccggcggattggaaaacgccgcgcatgaggacagatgcgacagaggttacttcgctgatagttctgctgtcatcgaggatgacagagggatctttcccaccgagttcgactgttactggtgtcaatgcctttgctgcagactcgcatactttgtgcgccaccggacgcgagccgatgaatgtgatctgggcaattccagggtgcgaggttaaatggtcggcgaccttaggcagacagacaacgctctgaacgagatcacggggatggccacagttttctaga

SEQ ID NO: 641 - DNA, 851 bp, Xylella fastidiosa
  CDS (67)..(843)
cgtcccctgtttctgggaagcgatcgcacttgcgcgtagtgaagtaataacaggcagttgaggacgatgacccaatcccgttggcgtttggatggccgtacggctttgatcacgggggctagtacaggtatcggtctggctgttgctcgtgagttgttgggcctgggtgccgatgtgctgttggtagcgcgtaatgctgatttgctggggcgagtacgcgatgaactggcagaggaattccctgagcgtgagttacatggattggctgctgatgttgctgacgatgtggaccgccgtgcgattctggattgggtcgaagattgcagtaatggtttgcatgtgttgatcaacaatgctggtggtaatgtgacgcgtgcagcgcttgaatatacagaagacgagtggcgtgagattttcgagatcaatctgttctctgcgttcgagttgtgtcgttacacgcagccgttgctggcgtgtcatgcaagtacggcgattgtcaatattggcagtgtatctggcttgacgcatgtgcgcagtggagtgccgtatgggatgagcaaggcggcgttgcaccaaatgacccgcaatttggctgtggaatgggctgaggatgggatccgtgtcaatgcggtagcgccttggtatatccgtacgcgtcgtacgtcggagccgctctctgatgtgtactattacgagcaagtcattgaacgtacgccgatgcgccgcattggagagccggaggaagtagctgcggcagtggcatttctttgtttgccagcgtccagttatgtgaccggcgaatgtattgcggtggatggcggttttatgcgctatggtttctgattaaaggc

SEQ ID NO: 642 - DNA, 1161 bp, Zea mays
  CDS (74)..(862)
ggccggcaccgctgctagcttgctagcatacttcccctacacgcgcgcgcaaccgcaagcagtcgatcgtcgcatggcgccaggaggcagcggcgagcggtggagcctggccggcgcgacagcgctggtcaccggtggcagcaaggggatcgggcaagccgtcgtggaggagctggccaggctcggcgcgcgcgtgcacacgtgcgcccgcagcgcggcggacctggaggagtgccgccggcggtgggccgagaaggggctccgcgtcaccgtctccgtgtgcgacgtcgccgtgcgcgccgaccgggagaggctcgtcctggacacggtcagcgcggccttcgacggcaagctcgatatcctggtcaacaacgctgcgctgctgctgctcaagccggcggcggagtgggcggcggaggactacgcgcggatcatggcgaccaacctggagtcgtgcttgcacatctcccagctcgcgcacccgctgctcctcaacgcctccgtcgccggaggggcgagcatcgtcaacgtctcctccatcgccagcgtccttggcttcccgcaggaagttatgtacagcgtcaccaaaggaggactgaatcagatgacgagaagtctagctgtggagtgggcctgcgataggatccgtgtgaactgcgtcgcgccgggcgtgatcatgacggacatgggtaaagagctaccggcggcgttggtggagcaggagcggtcacgcatcccgctgcggcggaccggcgagccggaggaggtggcgtccctggtgtcgttcctctgcatgccggcggcgtcctacgtcaccgggcaggtcatcttcgtcgacggcggccggaccattagtggcgcctgatcgacgacgacggccagctatatattctctattctactgtatttgaatttgttttcgttcttgatcggccatgtatcaccgtcagacgtcagcggcaataatccggccgccgtcagctagcgccatgcaagctgcccgatcatgcaaggtgcagacactgtcgttgcctgcagttctgttcctttttctactatggtttcttgtattcactgcccactggtgatgtttctgtgataacgacttcgacagaggggatacattttaaaaaaaaaaaaaaaaaaaaaaaaaaaaaaaaa

SEQ ID NO: 643 - DNA, 1189 bp, Glycine max
  CDS (49)..(855)
attcggctcgagcggatatctcaaaggtttatccttcagtgaagagaaatggcagctgaggcaaattttgatagcaaaagcagcaggtggtctttgcaggggatgacagctctcgttaccggtggttccaaaggaatcggatatgctatcgtggaggagttggcacaacttggagccactgtacacacttgcgctcgcaacgaagctgaactcaataaatccttaaatgaatggaacacaaaaggatacagagtaactggttcggtccgtgacgtggcgtctcgtgcagaaagacaagacctcatagctagagtctcaaatgagtttaatggcaaactcaatatccttgtaaacaatgtgggaacaaacatacagaaagagaccctggatttcacagaggaagatttcacatttctggtgaatacgaatcttgaatcttgtttccacctaagccagcttgcacatcctctcctaaaagcttcagaagctgcaaacatcattctcatatcctccattgctggtgtggtagcttcaaatatagtatccgttgtgtatggtgcaacaaaaggagcaatgaaccaaatgacaaaacatttggcatgtgaatgggccaaagacaatataaggactaattgcgttgcaccagggccaattagaacccctcttggtgacaagcactttaaagaggaaaaacttaataatagtctgattgcgcgaacccctcttggacggattggagaggcagaggaggtttcttcgttggtggcattcctctgcttacctgcagcatcttacataacaggacaaaccatttgtgttgatggcggcttcaccgtgaacggtctctacataagctaggcttattgtgacagtttcaatgttttgtttagtctgttacactctacttgtattagtttctctttaagttgtggagagtggagaccctatatctgtttttaaggacgtgataataacagtactcagtgataagtttgtttttcttgttttgatttagtcacatgtcccatgattctaggagcagtataatcgtgggcagtttatcctatttcccgttggttgtaaggctttcaataataataataataatagccatgtttgcttttcaaaaaaaaaaaaaaaaaaaaaaaaaaaaaaaaaaaaaaaaaaaaaaaaaaaaaaaaaaaaaggg

SEQ ID NO: 644 - DNA, 1033 bp, Glycine max
  CDS (25)..(837)
attcggctcgagaagcaaacaacaatggcgaaccctgaaggcagtagcagaggctctagatggtcccttaagggaaccactgctctcgttactggaggaacgcgtggaattgggcacgctgtggtggaggaactagcggagtttggtgccacagtgtacacttgttcgaggaatgaagaagagctgaatgcatgcttgaaggagtggaaagagaagggattttcggtttctgggttggtttgtgatgcgtcttctccaccccatagagagaacctcattcaacaagtggcctctgctttcaacggcaagctcaacatacttgtaaacaatgttggaacaaatgtgaggaagccgacaattgagtatacagccgaagaatattcaaaattgatggcaactaacttggactccacataccatttgtgccaacttgcatatcctcttcttaaagcatctggaaatggaagtattgtgtccatttcctctgttgcaagtcagacaagcgtaggttctggagccatttacgcagcaactaaagctgctattgatcagcttaccaaatattttgcttgtgaatgggcaaaagacaatataaggagcaacggtgttgcaccctggtataccataacttcacttgtggaacctttgcttgcgaacaaacagcttgttagtgagataatatctcgaacgccgataaagcggatggcagaaacacatgaagtttcatccttggtgactttcctttgcctgccagcagcatcctacatcactggacagattgtttcagttgatggaggattcactgctaatggatttcaacccagcatgagaatttcttaaagcaaaatggccatttttattgttggattgtgtgaacaaagtggtggccacttgagttttggaccatctatgatcaacttgttttgattggtcaataaattattttagtattttagaaatttgcattgtcattttcaacggctatcattgtgagatgatgggtgctcttggaacaaaaaaaaaaaaaaaaagg

SEQ ID NO: 645 - DNA, 901 bp, Emericella nidulans
  CDS (68)..(853)
cattgggcacttacaagataaactcttaaattgataccttgaaaataaaaaatccgcaaaattacaaatgagtgatgcctacggtgggctaagtctacgctggacactgagaggaaagaaagcactgattacaggtgctaccaaaggcattggactagctgttgccaatgagttcttatctctaggtgcagaagtcataattgtggcacggaattctcaagatgttgaccaacaactaattatctggcgagaattaggattacctgcttatggaattacggcagatgttgcaactgctgaggggcgacaagccatttttgagcaggttggcaaaacctgggataaattagacatcctggttaataatgtgggaaccaatatcagcaaaaaagtactagactacacggctgctgaatatcagttcatcatccagacgaaccagatatcaatttttgagatgtgccgtctgttttaccctctactgcaaaatagggaaaatagcagcattgtgaatataagttctgtggcgggtttagtctcaaaccgtacaggcgctccttatggtatgactaaagcggctataaatcaattgacgcgatcgctatcagttgaatgggcttgcgatcaaattagggtaaataccgtagcaccttgggctattcgcactcctctaaccgagtctgtactcgataaccaagattttctcaaattagttctgtcccaaacacctatgggaagagttggtcaaccagaagaagtagcgggtttagtagcatttctttgtatgcctgcggcatctttcatcactggacaatgtatcactgtcgatggtggttttttggctttcggtttttaagtctcaaagccagatccatccacgaggtagaagaaactacttaca

SEQ ID NO: 646 - DNA, 906 bp, Arabidopsis thaliana
  CDS (1)..(903)
atggcaaaggaagggggcttgggagagaactcaagatggagtcttggaggcatgaccgctcttgtcactggtggctctaaaggcatcggggaagctgtggtggaggaactagccatgttgggagcaaaagtccacacgtgtgccagagacgaaactcagcttcaagaacgcttacgtgaatggcaagcaaaagggtttcaggtcaccacttctgtctgcgacgtctcttctcgtgaccaacgagtgaaactcatggaaactgtttcctctctctaccaaggaaaactcaacatcctcgtaaagtatacatatataagcttcgtcctcctcggtattgggatccacaagaacccaattatgttgtgttttttgttgtggatctatacatatgtaggtcaacaatgtgggaacgtcaatatcaagccgaccacagagtatacagcagaagatttctcttttgtaatggctacaaatctcgagtcagctttccatctctcacagcttgcccacccattgttaaaagcctctggctcagggagcatcgtgctcatatcctctgctgctggagtcgtgcatgtcaatgttggatccatctatggagcaaccaaaggagccatgaatcagctggctagaaacttagcttgcgaatgggcgagcgacaacataaggacgaactctgtttgtccttggtatatcacaactcctttaagtaacgattttttcgatgaagagtttaagaaagaagcggtgcgtacgacaccaatggggcgtgttggagaagcaaatgaagtctcaccgcttgtggcatttctttgtcttccttcagcttcttatattactggtcagaccatttgcgttgacggcggtgccactgttaacggtttttccttcaagactatgccataa

SEQ ID NO: 647 - DNA, 810 bp, Oryza sativa
  CDS (7)..(786)
tcatacatggccactgccagctctataaacaagaggtttagcctcgccggtgccacggcgcttgtcaccggtggcagcaaaggcatcggccgcgccatcgtggaagagctggcgagcttcggcgcgacggtgcacacctgcgctcggaaccaggcggagctgagcagatgccaggaggagtggacggccaagggcctcgccgtcaccgtctccgtctgcgacgtggcggtgcgcgccgacagggaggcgctcgccggcagggtgtccgccatgttcgacggcaagctcagcatcctggtgaacaacgctgggacggcgtacctgaagccggcggcggacctgacgccggaggagacgtcgaggttgatgacgaccaacttcgagtcgtgcttccacctgagccagctgttctaccctctcctcaaggactccggaagaggcagtatcgttaatatctcgtccgtcgcttctgtcctcgcgttccattctcttcctatctactcggctgccaaaggagcaatgaaccaagtcacaaggaacctggcttgtgagtgggcgagcgatgggatcagagtcaattccgttgcaccgggctacatccagactccactcctaactgccttcgtggccggcaacgatttcgcacaggttgagttcaaccgtcttcctttgggccgtctcggtaaacctgaggacatctcgtcgttggtggcgttcctgtgcatgcctgcggcctcctacatcactggccagattatatgcgtcgatgggggccgtatgctttcttaataaactctacatatacaaaat

SEQ ID NO: 648 - DNA, 2415 bp, Glycine max
  CDS (137)..(2119)
attcggctcgagtctgtatctatctatccttctcttaaaaccgcagtgtctgagacgagcgagccactatgacccgccgcgacttcgatctccggcaatctaactaaaacggcggcgtatagcgggatctgcgagcatggagggtgagaacgcgagcaaggtgatcgaattggtgaacgagatagccagcatctccgagtacaggcctccggtgaagaagcagtactgcaacttggcgcggaggctgaagcttctgatcccgatgttcgaggagattagggacatgaacaaagacgcgcttcccgaggacacttccaacgccgtcctcgccttcaaggaagctctccaatccgctagggaactcctcagattcggaagcgaaggcagcaagctttacttggtccttgagcgggacgatattatgaataagttctacgaggtgacagctcagttggaacagtcattgggtggtatttcccatgataaacttgatatatcagatgaagttaaagagcaggttgagttggttcttgcccagttcagaagagctaaagggagggttgatgaaccagatgtcaggttgtatgaggatatgttgtctgtttacaacagcagcagtgatgcagctacagatccatctgttctaagtcaattagctgaaaaattgcaattgatgggaatagctgatcttactcaagaatcacttgctttgcatgagatggtggcatcaagtggtggggatccaggagcacgcattgagaaaatgtcaatgttattgaagaagataaaggatttcgtgcaaatagaaaatctagtcaaggatgataatttaggaggaaaaggcattttctcaaaagtctatggacttgggacaaatgaaaagagtcatcaggctcctgttatccctgatgattttcgatgtccgatttccctggaattaatgaaggaccctgtcattgtttcaacaggacagacttatgagcgtacttgtattgagaagtggttgcaagcagggcacgggacctgccccaaaacacagcagactctcactagtactgttctcacacctaactatgtattacggagcctcatagcacaatggtgtgaagccaatggcatagagccaccaaaacgacctagcgattcacaacctagtaaatcagcatcagcctactctcctgctgagcaaagtaagattgaaagtcttctccaaaagctcacatctgtgagtcctgaagaccagagatcagctgctggcgagatccgccttcttgcaaagcgcaacgcagataaccgcgttgccattgctgaagctggtgcaatacctctccttgttggtcttttgtctgtgcctgactcccgcactcaagaacatgccgtgacagcgctcctgaatctttccatatatgaaaacaacaaaggaagtattgtttcttcaggagcagttccaggtatagttcatgtgctgaagaagggaagcatggaggctcgggaaaatgcagcagcaacacttttcagcctttcagtaatagatgaaaacaaggttacaattggatctttaggagccataccaccactagtgacactgctaagtgagggtaaccaaaggggtaagaaagatgctgcaacagcactcttcaatttgtgcatttatcagggcaacaagggaaaggcagtgagggctggcgttattcccacgctgatgcgactactgactgaacctagcgggggaatggtggatgaagcattagctattttggcaatattggctagccatcctgaagggaaggctactattagagcttcagaggcagtgccggttttagtagagtttattgggaatggctcaccaaggaacaaagagaatgcagctgccgttttagttcacctctgttctggagatcaacaatatcttgcacaggcacaagagctgggggtgatgggtccactgttagaattggctcaaaatggtacagacagaggcaaaagaaaggctggacaattgctagaacgtatgagcaggttagttgagcaacagcaggaagttccaatacaaactgaaactcaagctcagaacgaggatacccaaccacctttgattactaaccccgatgattcctaagatgtcttattatactttgttcattttgtctttttgttctctttaaagtgttgaaagaagcatctgtttggaggaaagggtggaagatcaccttcctactccataagttatttgtttgtttgtgtgatattcagcagagatgtaatgcaaaaaacttgtgaaagtgggcaagaagaaatcgaagcaaatgggcaagcttgaagtggaaaatgtataatttgtaacatgcactgtattctaatcatcctcagattttaatgaagagatgttttgtttaaaaaaaaaaaaaaagg

SEQ ID NO: 649 - DNA, 1569 bp, Glycine max
  CDS (63)..(1355)
gcaaaaagaaagaaagaaacaaagatcgttcattgctttgtagtaagatcagatcatcaaaaatggttttgtcttggtcaagaaggaacgttttccgccgtgccaagaaggagaagtcacaaactcaattggaagtggaggttgtgattcccaaccactttcactgcccggtgagtctggagctgatgacagacccagtgactttatcaaccggcatcacctacgaccgtgtgagcattgagaagtggatcgagggagggaacagaacctgccccgtcaccaaccaggtgctgacaaccttcgacatcatccccaaccacgccattcgcaggatgattcaggattggtgtgtcgaaaatagttcttatgggattgatagaatccccacacctcgtattcctatctcggcatacgaggtttccgacacgtgtaccaggatcttgtcggcttgccagcgtggagatgacaagaggtgtcaggagttggtcgggaagattaaggtttggagtagagagagtgagaggaacaagaggtgcatagttggtgctggtgctggtgctgttcttgcatatgcctttgattgtttctcaagtaactctattgaaaaacatgtggtgcttttggaggaggttttggaggtgatgacatggatggtcccacttggggaagagggtgtttctaaattgagttcaggagcttctttgaattcgttggtatggtttctagaggggaaagaccttgcatcaaggcaaagtgctgctttgttgcttaaagaagtgtgtgttcaagaattggccaaggttggagaagttgttgaagctttggttaagatggttagggagcctattgggagcacttccaccaaggcttgtttggcaacaatttttaacttggtgtcgttggctgcgaatagagagggaattgctcaaagatttgtggagttgggtttggtttcacttttgctagaggctattgttgatggagagaaaggggtgtgtgagaaggcacttggggtgttggattgcatttgtgattgcgagaaggggaaggaggttgtgaagagcaatgctctagccttgcctcttgttgttaggaagcttttgagggtgtcaccattggcttcaggttttgctgtgtctattcttaggaagatttgtgacaagagggaggaagggattctgattgaggcacttcaagttgggctttttcagaagctcttggttctgctgcaggttgggtgtgatgagagccccaaggagaatgctaccgggttgttgaaactgttgaatggttacaggaacaaagcggagtgcactgactcatcattgaatttcgagcatcttaagaagccattttaattagtgatgaatggcaactagattcatttattctttttttttttttgtgtaggtcaatttattgatacagaattctttgctgtaaaaagatacacacatcaattgattctttgaattcattctttggaaaattgattcgaagtaattagttagatataataatcatggttgtggcaaatacaaaaaaaaaaaaaaaaaaaaaaaaaaaaaa

SEQ ID NO: 650 - DNA, 2363 bp, Glycine max
  CDS (26)..(2053)
ctaattaattattagtttcacttcaatgactcaaagggatcgtcgcaccctatcattcccggcggttcacccatgcgaagccatttctccgccgacacttgtcacctctctaatcactctctcccaatccatatgcaatttccaaccccaatcattccccacccaacgaaggaacgccagggaaacaatacgccaaataagcattgtcttaatgttccttcaagaaattcgactaatccccaactccactatcctctctttggcggaactccacttcaccttacaaaaaatccactttttattgcaagattgcaccctccaaggctcgcgcctcctcctgctcgccaaatcgcaacacgtagcgtccctgttccccgccctccttcgctccgtggccacctctctggacgtcttgcctcttcaccagctccacttgtgccccgaagtcagggagctggccgaccttgttaccaagcaagccagcaaggccaagttccagctggaccccagcgacgcacgtgccaccaaaaccctccacacgcttctgcgccagttctccatgggcaccgaacctgacctcacttccatgcagggaatcctccactacctccaaattagaacctggacagattgcaatacggagattaaattcttagaagaagaaatcaccttagagtgccgcgaccgtgaagaaaaagaggttcccttacttagtagcttggtagggttcttatgttactgcagaggagttattttcgaaactaatcaatcccaaggaagatgcagcacggagatgacatcgttaaacttaaccctgttgacgtccgttaatccagatgatttccgttgccctatttctctcgagttgatgacggatccggtcactgtgtcaacaggtcaaacctacgaccgagcctctattcagaaatggctcaaagccgggaacacaaatgtcccaaaaacaggggaaaaactaacaaacacggacttagttcccaacacaacgctcaagagactcatccaacagttctgcgccgacaacggcatttccgtcgctaactcctgtaaccgtaaaaccaacaccgtctcagcaggtagtcccgcggcggcacacgcgattcagttcctcgcgtggttcctcacgcgcaggctagcattcggaacccaagaccagaagcacaaagccgcgcaggagattcgctttctcgccagaaccagcattttcaatagggcgtgtttgattgaaatgggaacagtgcctcctctgattgaacttttagcctctgcatcgaacgataataaatccacgcaagagactacaatctctgctctactgaagctctctaaacacccgaatggacccaaaaacatcatcaacagcgggggcctaaccgtaattctctcggtgttaaaaaatggacttagccttgaagctcgtcaagtcgcggctgctacaatattttatctttcttcggtgaaagaatttcgcaagttaataggggaaaaccctgatgtcattccggctttggtggagttagttaaagaaggaacaacctgtgggagaaagaatgctgtggttgctattttcggattacttttgcttcctaggaatcatcaaagggttatcgctgctggtgctgttccggcgcttcttgacattatagcttcttcgaataaggacgagcttgtgactgaatctttggcggttcttgccgcgctggcggagaacgttgatggggcgcgtgagatactgcaaggttcggcgttgcggttgattgtagggatgctgcgatctgccacgtcacgcgaggggaaagagcactctgcttcgattttgttgtcgctttgcgtcaatgttggagcggaggttgtggcggttctcgctaaggagccttcgttgatgcctttgctttattcgcttctcacggatggaacttgtcatgctgcaaagaaagcgcggtttctcatcaaggtcatacaggattttcacgagactagaagtgctggactcaagggttcctcgcttccgcaggaacgctcgcttcacgtttggtgattgttgatcaatcatgactaagaatttggaatctcttccctttctgtgaatatgccaaaccttatttatttttgtgtaaatactaaatactaaatactgtaacacatgacattagttttttttttttgtcacgttttagatttgtgaaattagctctgtgcttgtttttatcgccggctagctaatttcaataagtgaggcttttatttagctcacactccgaagtggaatttttcgtttatctctgtctggctatgaattgaattgttgtgtgaaaaaaaaaaaaaaaaaaaaaaaaaaaaaaaaa

SEQ ID NO: 651 - DNA, 2081 bp, Zea mays
  CDS (197)..(1774)
gaattcccgggtcgacccacgcgtccgatttcccactccactcgaattaaaaccctagcggcaaaaccttcgctctgcgccgccgtcgcctgctcccgtcccgccaccacatccgcccaggagctcgccgtcggggaggctgctcgaggagccgcgctgtctctcccgcgccgcgaccttcgccctcgccgccgccatgatctgcgcgatctccggtgaggtgccggacgagccggtggtgtcgaagaagtcggggcttctcttcgagcggcggctcatcgagcgctacattgaggaccatggcaagtgccccatcaccaaggatgagcttactatggatgatatcgtgccggtcaataccaacaaggtcgtgaagcccaggcctttgcaggctgcaagcattccaggactccttgggatttttcagaacgagtgggatgctctcatgctttctaattttgctttggagcagcagctacacacagcaagacaagaacttagtcatgcactctaccagcatgacgctgcctgccgtgttatagccaggttgaagaaggaaagagatgaggctagagcacttttggctcaagctgagagacagattccagcatcagttgcaggagctgctcctgcagctgttgtttccaatggaaaaagagcaatggaagatgaaattggccctgacggaaagaagattcgtcctggtatcaaccctgtcatgattgatgaacttacagagtgtaataccatgctttcagcacagcgtaagaaaagacaggttcctccaactctggcaccattagatgcactcgagagatacactcaaatctccagccatccccttcataagacaaacaaaccaggcattttgtccatggatgttcatccttcaaaggatgttgttgcaactgggggtatcgatacaaatgcagtaatctttgatcggtcatctggtcaaatcttgtgcacgcttactggtcactcaaagaagataaccactttaaagtttgttccacgggatcaactctttgtaactggatcagcagataagactgttcgcatttggcaagagaacgagaatggaaactataactgcgtccatacattgaaagatcatactgctgaggttgaagctgttacagtacatgcgactcagaagtattttgtgagtgcttccaaggataattcgtggtgcttctatgatatttcaacaggatcttgcctgacacaggttggcgaggcttcaggacaagagggatatacatccgcgtctttccatccagatggtcttatccttggaacaggaactactgatgctgttgttaaaatttgggatgtgaagactcagtcgaatgtcgcgaagtttgaggggcatgtaggaccagtcactgctatgtccttctctgaaaatggttacttcctagcgactgctgctcatgatggtgtcaagctttgggatcttcggaaattaagaaattttaggaccttctctccctatgattcagatacgccaacaaatactgtggaatttgattttagtggaaactatcttgccattggtggttcagatataagggtctaccaagtagctaatgttaaggccgaatggaatctcatcaagacattaccagatttatctggaacagggaaagtaacttcggtaaagttcggagcagatgctaagtacatagccgtaggttctatggaccgcaatctacggatatttggcctccctggagacgaccaaatggaggaatcaaccacagcggcagagtgaggaaaatccatggtacctaatttcctcctcctggtatactccgcaatatgttctgatgatgggtagactgagtgcaaatggatacatcacgagagaagggtcctcgcggcgatgaactggcttgagcttcggtcggtgtaaacaagctgtgacattattgtattgtaggcctcactaattcgtctgatggggatacaatttgttttgatgagtacgagtgtacgacgctaaacagccaaagttctatgcataaaaaaaaaaaaaaaaaaaaaaaaaaaaaaaaaaaaaaaaaaagggcggccgc

SEQ ID NO: 652 - DNA, 1398 bp, Zea mays
  CDS (104)..(1183)
gtcgacccacgcgtccgcccacgcgtccgcccacgcgtccgtcgcattccacccgcccccttttcgcgtgaacgcgccggcgccgcggatcctgccgtcacgaatggaggcgtggccggacgatttccgctgccccatcacgctggaggtcatgacggacccggtcatcctcccctccggccacaccttcgagcgccgcagcatccagagctggctcgacggggggcacctcacctgccccgtcaccaacctcccgctgccgccctccccgccgctcatccccaaccacgcgctgcgccgcctcatagccgccgtctcgccttccgcggcggcgtctctcgtccctgcggagggaggggcgcacgcgaggcaagaagcggtgtcggcggcggcggcggcggcggtgccagcccggcccgcgtcgcccgtgccggcgctgctgaggctggccaagtccggcgccgcagggcggaaggaggtgctggagtccggcagcgcggcggtgctgctgcggcacgcggaggccggggacgaggcggcggccagggcgctgctgcacctcagcctggacggcgacgacacgcgcgtgggcctcgtggcggacggcgccgtggacgcgctgtccgccgcggtgtcccgcggcggcgcggcggcggcgtccgcggccacggcgctgaccagcctcgccaccgtggacgtgaacaagtgcaccatcggggcgcacccctcggccatcccggcgctggcggggctcctccgccgcggcgggccgcgggagcgccgcgaggccgccacggcgctctacgagctctgcaagctgccggagaaccggcgccgcgcggtgcgcgagggcgcggcgcccgcgctcgccgacttcgccgccgccggctccgcgcgcgccgtcgaggtgctcggcctccttgcccggtgccgggaggggcggcaggagctgtgcagggtccccggcgtcgtgtccgtgctcacgggcgccgccgggagcggcaacgcgcgcgcaatcgagcaggccctgctcgtcctcaactggatttgctccgagagcaacgagttggcggtggaagcaatcaagctgcaggctttcgacctctgcgaggctctggtgaacgacgacaactgcaagatcgccaagaacgcggtcgacttggcccggacgctcgagaaagcgtagaattggattgggctgtctcccccaaaacatgagatgagattcgccatgggttttgattcaacacctgctcgattggtcgggtgttggcctcattgtacagaggtagcaacagcaaaggtgaaccttttatctttcttctcttactccgtttcatttccaagttgtagctgcgccgaaaggaggacaaaaaaaaaaaaaaaaagggcggccgc

SEQ ID NO: 653 - DNA, 1742 bp, Glycine max
  CDS (64)..(1494)
ataaatgggttttggaggaaggaagagatccttgtgttgtgggttgaggtgagaagggaagggatgtggagttcaacttcaagcacagcagcgattccctccgacgaggaacctagcgaatcctcctcctcgtcctccttctccacctctctcttcaatttctcttctggaaacccgagaatcgaggagacccgtggcctcatgcatctcttcccagacgacactccttctactctacccgttggacggaagcctctcgtttgcgttgtcggcgtcccaaatcacatgacctatgcggatttctgccagttctgtggttccttcattcagcacatgctagagatgcgcatagtcaggatggatgggatggaggatcagtacagtgttttagttcgctttgacgatcaagactccaccgacagcttctacaagcactacaatggccgccgtttctcttctctcgaggttgaggtttgccgtgttcttttcacattagacgtgcagtacactggctccattgaacatgcacaaccctccaatgctacttcaactgaactgcctacttgtcctgtttgccttgagcgattagatcaggacaccggtggaattcttacaactatatgcaaccattctttccattgttcctgtatttctaaatgggcagattcttcttgtcctgtatgccgctattgccagcagcaagctgaaaaatctatatgttttgtttgtcaaaccactgagaacctatggatatgtgttatatgtgggtatgttggctgtggaagatacaagggagggcatgctataatacactggaaagagacacagcattgctattccctagaagtggaaacaaaacgagtttgggattatgtgggagacaactatgttcatagacttattcagtccaaaactgatgggaagttgattgagctgaacactcagtgtgcgcatgcagacaatggatgtggaagttgcagctgtgaagataatgccatgaatgaggctatacttaatagtaaagttgaagctattgtcaatgagtacaatgaattgcttgctactcaacttgaaaaccaaaaattatattttgaatccttgttacaagaagtaaaagaagaatctgagagaaaaatttccaaagctgttcagaaggctatcagtcttaaacagcagaagattcagtccaagattgacagatgtaagaaagagaagaaatttctggatgatcttaatgagaatcttgtgaaaaatgaggacatttggaaaactaagatacttgcgattgaagagagggagaaaaaaaccacgagactgatgggtgatagagtagcggacctggaaatgcagcttggtgatctcatggtttgtcttgagggtgggaggacggtagaacagctggcagcttcagatgagattaaagaagggattatcttggacaaatcaatagaatcctcgacaactagtggctctgacctggtgggaagagacgcataacagaagaatggttccttttaatgacagaagaatgattccttttaatggactacattgcacggactgacctataccatgtttataatcacagatttatagaaactacactcgtggatccacagttgacatgttttcactctaattttttcccatataaaactcccagtgtatgtatctgtttagatttgtaaataaaaagatttccaactaccagtataaattcttaatatttataaaaaaaaaaa

SEQ ID NO: 654 - DNA, 2004 bp, Zea mays
  CDS (353)..(1771)
acatgagttcccgttttgctcccgagttctctctcacgtccatccctctctctcgtctcgttctttagcagggccggctggagcgcccactcctccctccagcccggccccagccgcgccgccgcgccggtcgtagacccaacgcccgccgcccagcccagcgcgccctccggccgtgaggcggagaggatcgggcgggcctcggggcgagcgccacgcgtagacggcggttgaggagcctgagaaaacaacggtcctccttcaagatcctgatccctacgcgcaggcgtaggagattgtattccgtctgattaatcggcggagagcaagcgggtgttgcggctgcgcgagcatggcgggcgaggaggctgcggagggcagcggaaccaggaggcacatggatctaaacctgtatctcggcctccctccattgccgcggcctccagtctggctggacccgacgttgatgcccaacttgaccggtgctgcgccagaatcctcaataactggtgagcctgaggaatcgttggccctgggggcggcagcctattctccgtcgaatgcactttccaccccggaggagcacccaatgcttgatcccatagtttattcctggctcgacggcaacaggaccgatggtgaagaggacactgatgctcctgagccggggccagtggatggtgccaatgtctctaggtcgcagcttgtggtagctgccacaggattggaaggggatgatgatcttcctctagtaaggtttgtgcgccctagccagatggttgttgctggtggaatggagacggtgaacacaagtatacttcagcagtccattcaaagggctgctgcaattgaggccaggactcctgaactccgctttcagagggtgatacagattagccagcagcatagaattgtgaggccagcatcagtgaaccgcagtcaaggggcagctagtacagatgcggataggcttgtctgggcaatccagcgcactcataactctttagaagcaacaaggcggcaaaaactagatgacaacaacttgtgtggaaacggttctgctaagaaggatgagtcctgtgactgcaactccagctttgagtgcaatatctgtcttgacccagctaaacagcctgtggttacaccctgcggtcacctcttctgttggccatgcttgtaccagtggcttcatgcacattcaccccactctgagtgccctgtatgcaagggtgaggtgctagaactgaatgtcactccgatatatggaagaggcggtgaagaagggaattccaccaaccctgacttcccacctaggccacgagcaaacagaagggagagcctgaggcaacagctgcaaatgacagacacaagaggaattgcaacagtggtgaggcagttgatacaaaaccagggtataattagcgttctcccaagcccaacagggatcgagatgtcggtggttcctgcaggccggcaaagggctagggctcggagacagcaaaggcaggataataatgcatcatcttccatacacgttgtagcgcagaatatgggcaatgttgcccctgagagcagcaaccaaatccagttgtcacattctaacggtgacaatgctgcacagatggttcttgcagctcctcagcagtcatcatctgtcgaacagctgtcaacttctagcaccacagctgttatattgggcgagcctgggtcaagtaggcggtcaaggccttcggagtctccaaccataagaagaacgaggaggaggccacagtaggtactcgagtgttgtcactcccttcagtaaaatctacagaccatgccccagtgatagttattaccatgattatctccaataacatctcaaggttaataatgtagaaatgtatatgccatcactggtttctgcctttctcttacattccatgtatcatctattatgcaaaacgagtcgaaatatcagttccagtatctatgataatcttgacctttgtatactgggaatat

SEQ ID NO: 655 - DNA, 1629 bp, Zea mays
  CDS (292)..(1404)
cttcaccccccctctcggtctcaccctcctggcgacgactgggcggccgaacggccgtcgccgccgccccacgccaggtttcaaagtcttcgtcaggcccttctccggcgactcgagcaccacagggtgacaaggatagctttctcgggtcactgaaggaagacatcttctcgacgcggtagaccttctgacggttggctggttgtgctataagtgttcaaggggtggattaggaccgggaaactctgtactgaagggaaggtcaaaagtgtcaagagagcttgttccaagatggatgaaggtcagggagttaggtattggtgccacatgtgtcaggaggtgatagatcctatgcccgagatgaagtgcccaggctgcgagggcgggtttgtggaggagatggactccgaagacttcgagccagctgcgaacgcgaggtctgatcgctccgtctctctcttggctccactgctgcttggtatgatggggggttcgtcgcgcagatcaagactcaggagggaggccatggttgaagctgatgccgaccaggatgacgaagaggatgattcagaccatgagcttgaactttccaggaggaggcggaggaggaggcgctcatcagcgcttttcagtgtgcttgaggctatgcgtgaccgtgatgaagtaaggggctcggatgacaccgacagtgatacagagagagacctggagagagggagaagggagaggatggagaggcagagggagaggttaaggcagatcgagagggtgagtgctcgtggcagagagaggacggaaagcttaatactgatcaactccaacaacgaggctattattctgcagggaacattcggatctgatgacaaccaggaggactcaagcaacacaagttctggtgtatcacttggggattactttcttggtcctgccttagacactctcttgcagcgtttggcggagagtgacctcagtcgttctggcacaccgcctgccaagaaggaagcagtcgccgcgctaccaaccgtgaacatcgaggaagcgttgggctgttcagtctgtcttgaggatttcgagatgggaggagaagcgaagcagatgccctgtcagcataagttccactcgcactgcatactcccgtggctggagctccacagctcttgcccaatctgccggtttcagttgcctactgaggagacgaagaacaacccatgcgaatcagccagcaccgcagggaccgtgaacggcggtggagacaacgctgctgcaagcggcagcgatacagaaagtactaaccacaatgaagatgaccattccgatagccctatcttctctgctctgagcacactcttctctgatccgttctcatccgacgatgatgaaagtgttccacactcttacgagaactgaagatagcgtcggacgcaggcttgcaatatggtgaagacgttctgcttctgaggctggcatctttatattgtagcttctgtacatatctctctgaacggtcgccccccataagacaaactattacctctccgttttactgaaaactatgtggcttgtaatctgctagtgcttgctatgttcacttgcctcgaataaatgttatcctttagcgtgctaaaaaaa

SEQ ID NO: 656 - DNA, 1374 bp, Zea mays
  CDS (103)..(1077)
gccctgtggtgtactggtgtgtcacgcccctcgtcactcaccccgtcagccgcaaccccatcttctattcttcccgacggcgctcctggcagcaggaacaagatgtccaatagggccacacattggtgttatgcctgtcggcggccaattcgtctccgtgggcaggatatcgtatgccccaactgcaatgatggttttatccaggaaattagtgagatgggtggcatattgaacacttatgggctaattgaaccagactttgaagagcgtcgagctagaagattcggaatgatggatgccatgtcttcccttatgcggcaacggatggaagaaatgggaagagatggtttgttcgatattcgtggtagacaaggaacaggtactgaatatggaaggagaccaactgctgttcctacattggtatttggcggcatcccttctcctggagttgatagcggtgatgttaatgttgtcctcaggggaggccgcagagttggcgctgcccaaccaaatttcagtagtttagttgttggtcccagtctggaagccctttttgagcagctacttctccagaacaaccgtcaaggcccagcacctgctccacagtcagctattgactccatgcctgtggtaaagataaaccgcaggcatcttgacgacgatccacagtgcgcagtttgcaaagacaaattcgaggttggagcagaggcacgggagatgccatgcaagcacctgtaccatactgactgcatcatcccctggctggttcagcacaattcttgccctgtttgccgccatccactgccatcacagagatcaggcagtaccagtagcgcccggccttcagcttactacaacgaagccgctgatcctcctggggtcaccagagcagatcttgaacctgctccaagagacggtggcagggaaagccaggaaaggcgccgctccttctcgtttctgtggccgtttggcccgtcgagttccagatccagttcttaccagtacgaacagaatgttgatgagcctgcagtatacgatccaaaccagatagcatattctgagtggcactatgaccactgactgaaaccctgcagcaagtgcaagctatctgcaattcgtgccttcaaccctcagctttggagaggcattcatcagctgtaatggctgcttgccgtataaaaaaaggatggttcttgcctttatattgtgttcagtgcagccttgctccgtatgtccgtcgtatatataatcccttgcgtgtagtaagcggtgaactgaatgcatccagaatatcatgtcatgataaacttgaatatagtttcatggtttatttcagactgaaaaaaaaaaaaaaaaaaaaaaaaaaaaaaaaaa

SEQ ID NO: 657 - DNA, 1233 bp, Zea mays
  CDS (20)..(1093)
gttactcacttgggaatcaatgcacatttccctttttaatcatagtgccttgttgacaccttttgtctctgtgcaagcaggaaggatttggaggatgacagaagctgcagttacaaggtactggtgccatggatgtgtgagggttgttgaggaggccatgggggaggagatcaagtgcccattttgtggtggtggattcattgaagagatgattggtgaggaatttgatgggttggccagccagcagtcagagcgggattcatcacaatggggagcgtcgaacaacccctttgagcagccaagggcggaggcggacagtgaggatgaagaagatgatgatgattacgatgatgatataggccgtgcatttgagagtttcatcaggaggcatgggcggccatcagctctccgtcgggcgtttgacagcatccaggacgaccttagagctgatagggatagtgacttctccattctgatcaatgccttcaaccaagccctcgctttgcaacgctcagtgcttgatgctgatgaggcccgagatgaccaaggtggatctagcaatgatgatggcttgatggaagaatatgtcctgggggctgggctaaccctgctgcttcaatatttgactgagaatgatccaagccagtatggcacccctcctgcaaacaaagaggcggttgacgctctgcccactgtccaaatagcagaggctgtcagctgttcagtctgccttgatgatcttgagctagggtcccaggcaaagcaaatgccttgtgagcataagttccactctccttgtatactgccatggcttgaactccatagctcctgccctgtgtgccggtttgagctgccatctgaagagacagaagatttggatgagcctagcaatgtggacagaacagagaacacccatgaggaagtcagggccgatggccctgaagatgacagtgagagcagtaacagagcgtgggcccttgttccttggttcagtgggctattctcaacacctgaaccacaaactgtcagaggcgctttcactgatcagcagactcgctccacttctggaaccaacatgaatgctggcgaaagctgatctcttcctcctttgtgaataatgcccatacatctgagaatagcaatggaccttgtcagtagataacttatttttctgtactgataatccttcttggatgaatcgcaaggtacaaagtttgtgacaaaaaaaaaaaa

SEQ ID NO: 658 - DNA, 1489 bp, Zea mays
  CDS (252)..(1295)
gccgggccgaggccatgatcgatgcagggaggaggatgctgccgctgctctggcctaatcactagtataaagcaggcggagacagccggcccctctggcctcgctgctcccccttcctccccgtccccacccacatgccctgcctccgccccgccccgccctgcccaagctgagttcccccaccccccaacaaacaattactagagtagctgcattggcggggaaattaaagcgctagaagctcagcagcaatggcggagcaggcgggcgccggaaggtactggtgccacatgtgcgccgcggccgttagccccgcggagggcgaggtggagatgaagtgcccgttctgccacagcggcttcctcgaggagatggagaccgcccgcggggccgcgaccgacgacggtgacggcgacggcgacggcgcggtggctcaggtgcaccccggcgccgaccgcccgagctccatctgggcgcacgctatcctcagcacggtcgacagctccgcccgtcgccgccgcaaccggcggcagcaggaggccgccagcgacgtctacgactggaacgaccccgagttctcgctgcgccggcggcgcgtcaccgcgttcctgcggctcctgcacgagctccgggaccgccagctgcagcggctggagtccgctgccggcgtcgccctcgaaggcgaccagctgaccccgttcggccggagcctcttcatcggcgcagctggcggcgagcatggcgtggcgctgggcgactacttcctcggccccagcctcgacgccttggtacagcagctcgccgagaacgatgcggcgcggcacggaacgccgccggccaagaaggaggccgtggaggcaatgccgaccgtggaaatcgccggcggcaacgatggcgacgacgcggccagctgcccggtctgcctggaggactacgcggccggcgagcgcgcccgcgagatgccctgcaggcacaggttccacggcaattgcatcgtgccgtggctcgagatgcacagctcctgccctgtctgccggttccagctgccggccaccgacgacaagagctcatgcagcggcggcgacggtggtttcgtcagtgtcgatgcggatcgtgaaggcagtgacaacggcgggggtgatggtagggcaagctctccgggcaacgccgagctagctgaagctgaagagagtggcaggcggttgccgccatccttgcagtggctcaacagcctgttctcgccgtcggcgcagtcctccggtagcggcggcagcagttcgcatcattgggagaactaagcaatattgccatggttgctgccgcttgaaagcttggcccgttggttggtcccaatgtacataggaaggagcaggagcatgccgggttggtgccatgtaaaaatctggagccttttttcagtttggctcatgttaatggtctctgatatgtatcatggctgtaaaaaagaacagaaatgggcaaatgtatg

SEQ ID NO: 659 - DNA, 1278 bp, Zea mays
  CDS (293)..(925)
caccaatacactacaccataccagaaggagcaaaaataagacgagatggcggacgagcgcttgcctcaaacggccggcgcccgcacggctctcgccagagctactggatcctcggcacggaaacgcgcccgcgatagttaggtgcgcctgtgggcccggccggctcgtcacttacataggcgcacgcacccccgcctggtgcgtcgtcgatcgctgctttgctggcgcgcggcggccctgtgtggcacagtagaggtctgctgaggacgacgaccggaggcgtgctgcgtggatggtcctcatggccgggatgctccccggcgtggagtgcgcgcggcggcggcgggtccggcagggcggggcggggatgggagcggaggcggccggaggaggcacggggcggcggtcctccttctgcctgtacgcggccggccacggcggcgccggcaattctggcaagcggagcggcggcgtggtgcacgggcacgggtggacgctggacagcaatgcccgggaggccaaggagcggctggaccagaagctcaggaccaagagggaggccgccatcaagaggcaccacagcacggggagcataaagctgggcgtgccgcaccggagcgccggcgcggacgagcgcggcgagagctccgcgccggcgatggccggcgtgcagcgcgaggtgtactcgaagaagggcgtgatgcggcggctgatgcggtggagccggccgcggtgggccgcggcggagcaggcggagtgcgcggtgtgcctggacgagttccgcgcgggcgacgtgctggcgcacctgcgctgcggccaccgcttccactgggcctgcgcgctgccctggctcgagggcacctcgcggtgccccttctgccgcgccgccgtggacgccggcgccgccgccgccgccgacggcgcctagaagcggccgaggctctggtcttgctggggcttgccctgggctgggacggcgcggggcgccttgtcgctgtcggcccacgccagccacgccacccccatggcgttgccacgctaggcagtggctagtgggggtggtcatggtgagtggtgaccggcctgcttgtgcatgtggcgcggagcggaggaggacagcgagacgcgcacgacgaacccgtgagtgccttggcagtttttgcacgctttgcgcgcgcaaaggcacggttggtgcacatttgttggttgggccgtttggcccccctttgccgtgtcctcctcccatcatcgcgagcaagtgatgaacggttttgtttt

SEQ ID NO: 660 - DNA, 1204 bp, Zea mays
  CDS (95)..(934)
ctggttcactggccaattcgttgcttcgtggggctttggagtttggagccaatcttgccccttaaagtgtcggtggcagcgttttgtgatcatcatgagctttgtgttccgagggagcaggaccgacatcgaggccggtggcttcccagggttcgctcccgagcgccgcgccatgcgaattcatgcagggagcaggccggtgaatagcaattccttggcttttcttctaactgttcttgttttgttcatggtactgaactcgcaccagatctctcccaatcttctgctttggcttgtcttgggagtcttcctaatggccacgagcctcagaatgtatgccacgtgccagcagcttgctcatgctgcagctgccaacagttttctcggccacactgagctgcgtgtgcatgtaccgccgtccattacccttgctacgagaggccggttacagagccttagacttcaactggctcttcttgatcgtgaatttgacgatttagattatgacactctgagagcattggatgctgacaatagcccacatgctccatctatgagtgaagaagaaataaattctcttcctgtcttcaaatataaagttcaggcacaacagaggcatccccctgcccgaaaaagtgatgggccatctcagctatcggtttcttcaactgggtccggcaatgaggaaaagcaggatggtttaaaagcagatggaaccagcaaaccttcagaggatgaactaacatgtagtgtttgcttagagcaagtcacggtgggtgatctgttgagaagcctaccatgcttgcatcagtttcacgtaaactgcatcgacccatggctgcgccaacagggtacatgcccaatctgcaagcaccaggtgagcgatgggtggcatgctacaggcaacggtgaagaggatgcttcttacatggtgtgagtagctgactaggagtaggccatagctaactaccagtagctgctaactgaatccgtggaacatagttttcgaggtgacgggttggactgatctagggatgtgatctaatccctttctatcctaacaaaaccgcgtgtggaaacagttgtccagtacggttcttttacaggtaacgctcatttcaatcattctctgtaacggggcgtttggatcccttcattttagaggaattggaattcactcaataaagtaacttatttagtttgg

SEQ ID NO: 661 - DNA, 1085 bp, Zea mays
  CDS (99)..(563)
gtccgtgaccattcccgacggccttcccaaaagaaccggaaatttacaacccagtccaccacgggccacaatccccaaatctaacccctccgacggcgatggggatctcgagcatgccggagccgcgggacagcctgctggggtacctggtgtacaacacggtgatctcgatcgcggcgctggcggggctggtgcgggcggcgctggtgttcctggacctgcaggccgcgctgccgcccggggacgacggcggggaccaactggcggcgtcgggcccgggactggcagagcggttcctcagggccttccggccggcgctgtacgaggtgctggcgtcgacggcgacgacgtgcgaggcggacggcggcggcgacgactgcagcgtgtgcctggccgggttccgggcgagggccgtggtgaaccgcctcccctgcggccacctcttccaccgcgcctgcctcgagacctggctccggtacgagcgcgccacgtgcccgctctgccgcgcccacgtgcccctccccgccgacgagacgccgctgctccgctacccggagttcgagtgatccggtcggtaaaaaccaccaccccggtcccccaccccacccaccccccggcgagcggtgagcggtgaccccccgtcgcgcgcgcctcggctgtgtgctgcaagttccgtgtggccttccgtgtacgcgtagcaaaccaaagaagaagaaaaaaaaggtgtaggagcagtagtagtagtgcagggttgctgtcgcttgctttcccctttcgcttcttgtattccccctcccattctctttgcgttttccgttccgtgctgtcgcctgtagcgtgtaaatactccggttcgcacttggcagcagaggcagagtgtagagtgctcccgtggccgccgtggctgtggctgatggtgtagcactttttacgtgctcagctcgtgtagtagtacattgcatccttcttctattcaattctcccccgactggctaaaatatcgaggactgttttggaattggaacggttgtatgtgtgcgtgcagttgcatactgtaataataactccacagcaaaaattacagc

SEQ ID NO: 662 - DNA, 1379 bp, Zea mays
  CDS (308)..(1054)
attcggctcgagcttcccttctttcccctttgcttgctgctgcctgcttctcgccgtcgccgcctcaattccctcctcgttgtccgtcgcctcgtccacgcgcacctcgtcctcctctccgttccctccacctcctcgaccgcaccgtcgtcgtctagctagcggagcgagctgcgaccagatcggagagccaagcacccaggaagagggggccggggaacaagaagaagccgccggaagccgggcgtggacgtgtggtggttttctgccggcggctgacaagtggtgtaggctacccgctctggccatggatccgtcgggcggcgcgttcctgccgccgctgcagcaagggagctcctccttcccgcggtcctccagcaacgcgtcgctcgccaggagcggcagcggcggcggcggcgttggcgccgggcgcgggaccaggggcaggaagatgatgcgcagggtctgccgcggcgtcatcaccttcatcttcgccatcgctgggctgttcctgggagcggtgaccggcggtctgatcgggctggcgacggagagcgggctgttccgcggcaccgggatcggcgccatcaccggcgcgctcgtctccatcgaggtcgtcgactcctccatccgcctctggcaggcgcgccgatccgggatctggagcatcctctacgtgctgaacgtgatctacagcctcctgacgggcaggctggtgcgcgagaaggtcgacccggcggtgcagcgggtggtccgcagccagatgaacgcggtggactcgtcgccgttcagggagtcgccggacctgttcgaggtggaggccaccaacggcatgccgcgggcgtccatcgacaagctccccgagtcgtggatcaccgaggagtacaggcgcgacgccgtcggcgacctctccggctgctccgtctgcctccaggatttccaggtcggggagaaggtgcggagcctgccggactgctggcacgtgttccacgtgccgtgcatcgacggctggctcatcaagcacggctcctgcccgctctgcaggaggaagctgtaggcggatcgaccggacgacgccatggacgatgttcttctctgcgatcgagccgatgatgtgtgtgtgtgtgtgcccccgccgccaccaccgatagctgctgctagggtcggaggagggaggaggaagaagagactgacatctatagaacccttaatttatagagagggcttttgctttgctacttgtacgtgctctactacgtacctattgcaacttttttttttgattcaccatgatcgacctccttcctcagatccatccatgcatgtaatataccctggaccggcttgtgcttcgttcgatccaaaaaaaaaaaaaaagg

SEQ ID NO: 663 - DNA, 793 bp, Zea mays
  CDS (71)..(622)
ccacgcgtccggatctccatctctcatccgctagctagctagctaggcaagacagtcgagagtcgacaccatggccatggcgacgcaggggcaggccgaccagcagcagcagcacgggcggtctgagcccaccaccagcgtcgccgccaaccgctgggggccctactccggcgccggcgacttcgccagcaacatggccgtcatcctggccgccctgctggccgcgctcgcgctcggcctggcgctcaacgccgccgtgcgctacctgctccgccgcagccgccgcgccggctctgttggtggacagggcaacggcagcggcgtgctgatgccgtcggacgacccggctgagaagccctctgtggaggtggagctgcaggcgccgccgcccgccctgctggtgtactccgccgccgggacgacgctggcgggcgccgcggcggagtgcgccatctgcctcgccgagttcgcagacggggacgccgtgcgcgtcatgccggcctgcggccacggcttccacgcgcgctgcatcgagcgctggctcgcggagggccgccgctcctcctgcccgacctgccgcgcgccggccgtgcagcgcagcctgcacgcaagtgaattactctaaataaataattgccgttttagtgttgctatttaccattgcttgtactgcctctgtaaatcaagaagaagaaataaaattataactcttaggtttgggctcaaaaaaaaaaaaaaaaaaaaaaaaaaaaaaaaaaaaaaaaaaaaaaaaaaaaaaaaaaaaaaaaaaaag

SEQ ID NO: 664 - DNA, 2191 bp, Zea mays
  CDS (215)..(1756)
ccatctctctctctctctcctgcgccgactcatcttcaccctcgtatcacctccctgctgctgctgacgctgctgccggcaagatcaaatcgttcaaaagaccctggatttcggcgaattctagatggatcatgtgttttaggtgattggtgctttcgacctcattagtgccttttgttcaattgctggacccaaggagcagagttctgtcgacatggcatctccaagaggaaggatgtcatttccccttcgttcctttctgatgatctgcctcatggctcagctgggagcttccaatgttgtactcatggcgaacaacactaccctgtcgttcgacgacgtcgaggcaatttttactccagcagtgaaaggttcaggtgtaaatggtgtcctttatgctgtggaacctatggatgcatgcagtccattgagaacaaaagcgataggaggctctgtctcaacatttgcgttggttataagaggcggttgccatttcgatgacaaagttagaaatgctcagaatgctggattcaaggctgctgtagtatatgatactgaagacaacggtatccttgtttcaatggctggaagctcgtctggagtccacatatatgcagtgtttgtctctaaagcgtcaggggaggagctgaagaaatattcaggccaaactgacgcagagttgtggataataccaacatacgcgaactcggcttggtcaatcatggcaatttcatttatatcactgcttgttatgtctgctatcctagccgcgtgtttctttgcgaggagacaccagataagacgggacagggctcgacttccccaaactcgggagttccatggaatgaacagccggttagttaaagcaatgccaagtcttattttcacgaaagtgcaagaagacgactgcacatcagcaacatgcgccatttgcttggaagactacagtgctggagaaaagataagggttctaccttgtcgacacaagttccacgcagcctgtgtggacctatggctcacctcctggagaacattctgccctgtatgcaagcgggacgcgaatgctggaacaccagagccccctgtatcagagtcgacgcctttgctctcatcatccgccattcgcttaccagaaccaaccgcttcggtttccttctggtctacagtggcagcagcagcagcagcgtctccccccaggccaatcagccggcatccgtcgccatcacggtccatatcccgcaagcactccgtttcaggttccagcatccctggcacccctatccccaggtttcacgcaagctcatcatctcctacctgcacaagtggaagcagtttggacctcgcaaacatgccgtcgtctccatggcctcgcgcttcgcaccttgcatctgctcactcttcgtgcggtggccgcctgtccccgccgatccacatcaggaatacctctgcagcgcacgtctcgcgctctgcctatggatctcccagccgttacgtaggctcgtcgcacatgtcccgtggatctccgagttgctactaccttggatcttcttcagggcagcagcatccttacctgaggcactgcaccttgtcaggcacgagcctgttcaccatggtgccccaatcaccgcaacagaaccagctgcagcacggtggagactcggaaaaagatctgtcagctgctgcaccattccgtcagctctactacctgcagcattgtccagattctggcacgtcgtctcagtcgcttccagggtgctgattcttcattcttgctgcaaaattcaccattttaaaaaacattgatggtggctccagtaaagcttccggccgtgaggaatcttacatggcaccgaattgacatgtggatttgagctcctcagttcaccatgatgatgagagaaaaaaggtgcgacagaattgcttgtaagaagagagaattgcaccccccagaatgtgtggcttcatcttgaagaagcaaatgcccatgtcgggcttcaccagcgtttagcgtgtactgatacagctctgtagtaattctagttgctgtttgtctatcgaggtttgagccggtagcattccttcctctcttttttgttttcctaattttgaattagttatatgacagacaaggttttcaagaaaagaaataacaagttttacccctgcatttttataaaaaaaaaaaaaaaaa

SEQ ID NO: 665 - DNA, 800 bp, Zea mays
  CDS (162)..(599)
gcaggttcctaacccccacccacctcgcccaaattgcaaccttccccgagtgctccaggtcccgtggccggcccccagatcctctccaatcccaatccaagtatcgaacggatcccatcggtggcgctcgagcgagcgagtgcggccggaaccgagcgaagatgggcatctcgagcatgccggcgcccgaggacagcctgctggggttcgtgctgtacaacacggcggcgtcggtggcgatcctggcggggctggtgcgcgccgcgctgctgttcctgggcctggcggcggcggcggaggacgaggagccgcggcagcaggcggaggccgtgacggtcacggccgtggggcccagcctcgcggaccggttccggagcaggttccggccgtcgcgctacgggcggcgccggggcggggactgccgcgtgtgcctggtgcggttcgagacggagtcggtggtgcagcggctcccctgcggccacctcttccaccgcgcatgcctcgagacctggatcgactacgaccacgccacctgcccgctgtgccgccaccgcctcctgccccccgccgctgccgccgacgaggtgccccggattgcctgattagcgccctaggaattgagagtaggcgtagcactctgcacctcgcagcagcagtgtctctgtacaggtttttttttttcttttcctttttgttcgggggagagagaggacagaacggagattgaaggaagaaaatggtggcaacaaagctgttcccctttcgtttctccgaagctctctgttgtctttattcattcc

SEQ ID NO: 666 - DNA, 2746 bp, Zea mays
  CDS (411)..(2375)
gacaaaatttcctccacccattctcttcctcctcttcttccccaccgactccaccgatccacatctttctatctgaatttcctctcgtcttgcccaccggtccatctgtctgttgcctctctctctctctccctctctcgcaaccaatcggttcttgtttcctccgtctgctgggttgattctctctctcttcctctccgtggagaggagaggatcgagaaacaggagacaggaaagaagagaaatcagaacggagcctgttcttttgcctggattgcggttctcgcgagttgttcagaaactctgggccagtttctggtcctttaaaatactggaacgaggaaccatcagagatgctaaggcaacagaccaattgatgttatctcgctaccctagtttggatcatcacaatgcaaggacagaggaattctgtggagcattttgctgatgtttttggattcgacattgcatctagttcaggcaaccctgtgatggatcagcagtcatattggaacaatgttcttggatcagtagaatcgcagaatcttcaaggttatcagatgaatcacagtgatgctgccatgccatatgggaatgagacacagcaagatggtacatttcttggtttctgggaatcaggcgaagcaagtgcaagtggcagctctaacaatgccaaaacagagcatcttagtattggcggtggtctgaggattggtgaaaggcgactggtagctgacaatggcatttctctggatgtggatatcaaccttaacgccaacgttaacgatctatgtggtcaaagttcaaatgttaactgtacatctcagggccctgagcactatggtggcggtgatcgtagtgttgtaaattctcagccaactgacctgagattacacccatacaggactttcctactagatgcagagcaagcagattcttttactttgaaccctagtgaaaaccctttgtgtgatttttcactgatgcaagaaagcattgaccaaagacccggtagttccctggatggacgccggctagcctgcaagagaaaaaatgttgaaggacccaatggccagagttcagcaggtgctagcactagtttttcccacaggaacgacaatgctttccataacattgcttcttcaagttacaatcctgcacctatcagaaatccgtcctcacccaattgcttgccggttccaagttctatcgatgatcaactcccacgatatggaactaatgcagggctctcagccggtacctatgaccttaatggaggggtcaacaatgctgggaattcgcagagaagtttccgggcaagaattactacgtctcaacagattgctccctgtagtgtatggccctcttcaaatgctatcagacttcctaattcatggaatcatcagccacctcattttcaaagtgcatttgatgatacccaggaggttattcctgtggtcagcagcctcaacttgcaataccagcatccagtgaatgtttctagtgtgccaccggctgcaaaccgtttcactggccatggagcttcatcatcgagagctggcagtttggagaacagaattcttggtagtcaagaggctcctacaaggaatgtggtgcctgccaactactctgatttagttcccccgtctgtagtagacccgagacgtttgctgccagaaccatctaattggagttctgatgtccgaggcactgcaatatcaggaagtattcctcctgtatcaagagctaataacagtgcaactgttaatccgccagcaggattcagtcaccaaaacctcacccggcgccatcctcgaaatttatcagaggagattggtcggctatctggagcacttcgcggccatcaacccccacgcttaaggccggggtttctgttggagcgccagggcgatggtgtttggggtgttcctttatcaacaaggggtagagaaggaagaaggttaatggagattcggaatgcacttgaaatgatccatagaggggagaatgtaaggcttgagtctatcttctatggcggtgttgacattcacgatagacacagggacatgcgccttgacattgacaatatgtcctatgaggagctattagcactcgaggaaagaataggaaatgtcggcactggcctcagcgaggaagctgtgataaggttgctcaaacaaaggaaattttcatcttggacactaaaagcatctttggaccctgaaccatgttgtatctgccaggaggagtacgctgatggagacgacctcgggaggctggactgcgggcacgacttccatgctggctgcatcaagcaatggctggtggtgaagaacgtgtgccccatctgcaagagcaccgcattgaagaagacctgaaacccgaacgaaggctcgtgtcagagacacccccccccccccccccccatgtttctatgttcactcgacggttcgcgagatcatttgccgattcgtattgctacgctttttttggtcgggaaaattttgccagccacctgcgattgggaaaggaaaagagagaaacagagagagagaggatgcggttgcggtcctctgtaaactgctgctgcagtaaataatccctggaatatgtcttccctgcattcaaccaaatatttagtagtagctgttatagtggacgtcgtaggattaaaaccttggaagagagcctgttggctgttgcccaccacttgccataattatgttcgatccggatttcaattttc

SEQ ID NO: 667 - DNA, 2035 bp, Zea mays
  CDS (269)..(1828)
cgcttcccccttccacccgccgatcgccctccgctcgctccaccgcggcgggcgatcgctcatctccccctaacctcccccgctcgcgattcccgaggcgaggtgccacccaccgcagatttcttccgacggacggttggctcgctcaccccctacttcgctgatcggatcgcgtgctgcccgaggtagaggtgatgataaggcatagttgtttgacttagcctgccttagctatttcttgaagctaagggaaataataattggtgttatggcatttagaaatatggtttgtactccccaagtcattaatcttacatcagactcagagagagggcaagctcaaggaggcaatggtagtgagatatctgagcaaggtgcacaacatgctgtcagagttgtaggaaatgcaatgaacattggtctctctggtgtgcgaagttactatgatatgagcataaatcatcaccatcagtctgttcataacccacccccgaatttaggtgttgattctggttttgtcttcgcatcaaatatgtacaatccctgcatgtcatcaacatcaatgaacagacatgtttctcatgctcagagctttggatcagggaatcaagtgttgcctcaaaaccaagtcccaggaactatggatgagagtagcagaaatgacagtattggtgaaagtgctagagagcatattaaaaggaaaaatgctgcagttgctggaagctatcattttgttaatggatttgcaagctcaagctcatcttctcatgcacctcaaaatcctatgcttgggccttgggacccttcttttgaatcaactgtttcttctaatgttgcaccattcaacccatcagaatatcatggacacaacaacagttggccgtccttagaaggatcttccataacaggaagtaatggattcaactcaatggttgttcatccagactcagtacagcgtgggaactatacatttccacccactcatattagccattcatggatgtcccatgctacaaatggtattgctgatggagttccccagtgggaatatgccaatgcaactgctaatattcaaggcagatttgcccattcaggagccacagaaatcgcaaatgttggttttcatgaatatcagaatggcccttcaactatttgtcggggaccagtaccttatttccaccagcatgcgatgcatggcatgcaagctcttgatcctactcaaatgcaagttccttatcaacaatgccacagtaatggtttcttgcatggtggtattaattaccctggaaaccgtctccaattaggtccacgaaatccagttctcttcaccagttctgaacgtgcttttgggcctccacagcatccgttcctggcaaatccagttaaccaccgcaacataaggattctaccacccgagcatgctacaataatggatttttcgagattgtatgaagtgtcaaatactgtagatgagcatagagatatgcgtctagatatagacagcatgacgtatgaggagcttttagcattagaagagcagattggagatgtcaatactggtctgacaaaaagtcacattgtagataaattgaggactagcctatatgttccaggaatatcgagcatgtctgatcagccatctaaatcttctctagagaatgatgcttgcataatatgccaggaggagtaccaggctagagactgcgttggcacccttgactgcggtcacaggtaccacgcggagtgcgtgaagcagtggctgatggtgaagaacttgtgccccatctgcaagacgacagcattgtctgccaacagaagacaaggacagtgagcgggaatggagaagcctgttggttatttgctttgacaaacgttcagctcaattttgtatataaagaagtggtagacaatggcgctacctgtatttgttgttcactttgttgtgactgggagtactcagcttcctgaaactgtacagccataacatttgttatttttcttcaaatgtagaatgttttaaatcgctcagttcgcc

SEQ ID NO: 668 - DNA, 1253 bp, Zea mays
  CDS (167)..(781)
ggctaccgccgccgccagatgcgcaggtcttcgtcggctccttctacttctcaggcaacgagcacccggcagtaccgatcgggtgttcttcactgggtccgctcctgcgtgctagaactagaagaatcctctgctcggctcgaacttggaaggggggaggcgagggatggggtccctgctttgctgcatggggtgctcggaggacgtctcggcagcgccgcccgtgagctgcttgtgcctactatggcctttccattattaccacaatttgaactcgggctctgctgcttgtcacagatgtgatacacgggtggcacctgatggtggaaggagtcctcctgcaaatcaagtggattcattggatactttgggtctccctccaaggcctttgccttacgatgatcctcaatccagccctcgcatggtgcaacacccacttgtatcaggacacgacaaagcaccaacgcatgtccagaaactaggacagcctgcagaaactaagaatacccatactgggtcaacttgcacagctcataaggtttctgcgtcctcaccaaaacagcactcagaaggttcaagaatggatgatggagtacaattctgtgattcctctgacagtgaggatgactgtccagtatgcctggaagaatatgattatgagaatccgaagattgcactgcaatgcaaacataatttccaccttagctgcatttacgagtggatggaaaggagccaggcttgcccggtctgtgcaaagactatgttgttcaatgaggatgaatgaccccgccgatggaagtcttcccagacgctggattcatgggctactcgtcagaaaaagaaggagcaaaaaatggtggttctaggaagcaagctaatccgaaagacggcaagtgaggcattcggccgggcctttgggtggtgccctttagataggcgcatttctggttgatatggaagctggaacttggaagatggtgatgaagtttgtttgtctcttgatggttggcttgttcagttccttttgtggcttctgcctgtctgattgggttgtaaataagaaagtcttatgtagttaatcgtaggccaaactttctctgctatcttaggctcttcactaatctagtttgatagtgtttagagtctagatagggttctggccgtgttcgatcttttgggatgatgtgccgcgtggttgtggatgtttcaaactttcctatttcttaatgaaatagggggcttcgccccttcgt

SEQ ID NO: 669 - DNA, 1341 bp, Zea mays
  CDS (294)..(806)
ccgcagaatccgagtccaatagctctcctccccagggctttcaacttctccaaaccccatctcgccgccgaggccgagcgagcagagcagaacaccacgtcggcggcttttccctgtctctccgctggatactacacccgccgccgcagcgccgatcctgtccgagtcaagcggagcgggggatcggattggttgcttccttccctccatctcatgttggtggactgagagatggagttttaatttcaaatagcatctagaggactgccactaagcttttaagttggtatataatgggtggctgttgttgctgttcgtcgagaacatctgaagcagttagagcacgagcaccagttgatatatatcatcaacaaaatcttgaggagcaggagccattgtcttcaatttttgatggatcatctccagcctctgcaattgttgcagtagacacaaatctggatacttccacacctgacacatatcgagcgccgcctgcacccttgccttatgatgttattttggcagtcccaaataaccctggtttggagaagccagacactaagagcaaaactgatgaccaacaagagtccataaatgatcaggagtctttaaaggtggatgagtcatgtaagaaaagtgtcactgaagataaggctgatgaggaggatgtttgccctatctgccttgaagaatatgatgaagaaaatccccgttctataactaaatgcgagcatcatttccatctttgctgcattctcgaatggatggagcgaaaagatacttgcccagtttgtgaccaggtttggtaaccttggtggatcatcactcgaagctgttcgttactgagaaagtgcagcaactaatttacttttgatattgatccattccgggtggctcgcatggtaatgaattgagggggcaaaaattgaaaggatgaatgtcatgaaatgtatttacaacgcctcctttgtcatgcgttgtgtcatgctatatatatgccggcttgcgggttcattcagttcaaagtccaggactatccttttgcttttctgaattcagagtttcagacatctgctggttcttccaggttccggtcagctgtgtatatcatatattaggtggttgcaggtaaaaatggtctagagggtgggggttgctttgtacaatccacatggtatttaagcttcatgtatataatcttttctgtttctcttcgttttgttctgctgaatacttgcagatccttactgttctgataaaacttactgactcccaaatctgtgccagacaaaacgtgtttcaggaacataatacatctgatagcacttgttaaaaaaaaaa

SEQ ID NO: 670 - DNA, 1678 bp, Zea mays
  CDS (187)..(1374)
ctcctctgcctttccccatcgtctctccgtctacacctcatcataatcacagagcgctagggaggagagagggggaagagagagggctagggtttcgtgctccctcacgcaacgaatccgagccggatcggggggtgcgcggagtcaccggcggcccggcgttgcctgggctgtgatacagttgcaatggcatctgtaactgatgagacagctaagattgagggtttgacatctgctgcagcctttgtggagggtggcattcaggacgcatgtgatgatgcatgcagcatttgccttgaggctttctgtgagagtgacccttctgcattgactggctgcaaacatgagttccatctccaatgcattcttgaatggtgccagagaagttcacagtgcccaatgtgttggcagcctattactatgaaggatcctaccagtcaggagctgcttgaggcagtagagcgtgagaggaatataagaactaatcaaactcggaacacaactatatttcatcatcctgctcttggggattttgagctgcagcatctgcctgttggtaatgatgctgagcttgaagagcgtatactgcagcatctagctgctgctgctgcaatgggaagggcacaccatcttggaagaagggaggggcacaggggacgatctggctctcatggtcgtccacatttcctagttttctctacacaaccaaattcaccttctgctggcacaatctcttcatcttctgctcatatggagggagaaaatgattcaaatcctgccacacctagagctagcgagtcatctccacgagctattcgcattggagaagtgggaaaccaaagtcctgggatgcttacctacgatgctgaacaggatgctgtcgtttcttccggaaatagcactcctgtatcgagtcctaggttttttaacaggagacactccactggacagtcaactccagacagggctgggccatcggatattcagtctttctcagactccctgaagtcccgcttaaatgccgtctctatgaagtacaaagaatctattacaaagagtactcgagggtggaaggagagattgttttcacgtaattcatccgtggcggatcttggttctgaagtgagaagagaagttaatgctggaattgcgtccgtatcacggatgatggagcgtctggaaactagaggaaatagcagaacaagtgatagcccggcagcatccacttctgaagttccccctgctacagaatcaagcaatgaaagggttacagagagcaactctgctgctgctgctggtggtggtggtactaccactacgggtaccagcgctagcaacgcctccgccccttgtgttgcgacatccggttcaaattaggacatgtttgtgagcctggcggcagagcagaagtgcagtaacatgatgccgtcatttttttctcaaccactgcataaacggctgcaaggggaaaaaaccaaacggtgatttgatgtattggctcgataaaatggtggtgcgtgtggcctaggagaagtcggatttcatcttctgttttcgtctctttgtaaaaaaaatcgtctgagggcagatgtttaccggtataaataacggatatgtcatcttcatagtacgtggatcagttataaatatgattggaacagcaaagcttgctgctgtt

SEQ ID NO: 671 - DNA, 746 bp, Zea mays
  CDS (94)..(597)
tttcctcgttcccaatcatcttgccgcgcgccgcacgtagctagggtttcgtcctgtcgttgcacccgcattactagcattcaatccacgccaatggctgagaagaagatggttacgctcaggagctccgaccacgaggagttcgaggttgaggaggcggtggcgatgaagtcagagatcatccgtctcttgatcgaggacgactgcgccgacaacgccatcccgcttcccaacgtggattccaagactctcgccctggtcatcgagtactgcaacaagcacgtccacgccgccgccgccgacgactccgccgccgcggagaccagcaacgcctcatcagctgcgggcggcggcgacgtcgacctcaagaagtgggacgcggagttcgtcaaggtcgagcaggcgacgctcttcgacctcatcctggctgccaactatctcgacatcaaggggttgctggacctgacctgccagacggtggccgacatgatgaagggcaagtcaccggaggagatccgcaggacattcaacatcaagaacgacttcaccgaagaggaggaggaggagatccgcagggagaactcctgggccttcgactgatgtagtctccccgtccgcggacctagctcggtggttattactgttagattcgatctctagtgctagtttgttcgtctgcacttatcttctgatctgaaacattaataagtagttcgtttgtctacagttaccagttgataaaaaaa

SEQ ID NO: 672 - DNA, 1583 bp, Zea mays
  CDS (158)..(1159)
gccgttgaagccaaaatttattacgataaaattttgatcctttcatttgttggacattggatcaactggtgctgttatacatagaaaggagttcattgtaatttctcatctatatttagtggtgccataatcatttttccactggtgttcggcaataatgtcggagagcgagttagcagtaataaaaccagaggcgttaaagacttatatctggcttcagtgctttgatggttccattcagcaagtggaggaggaggttgcaatgttctgccccatgatatgtcgtgaaattgtgaaaaatggcacagggtcgtccaaaaatcatgctattgcgctccctgaaagagttaatccagccagtttgagtttgattcttgactactgccggtttcatcaggttactgggcgctcaaacaaggagcggaagtcctttgatgaaaaatttgttaggatagaaacagaaagactctgcgaattgacttctgcagctgacagtctacagctaaagccacttgttgatcttactagtcgagctcttgctcgaattattgaaggaaagacacctgaggaaatccgtgacattttccacttaccagatgacttaacagaggaagagaagttggagcccctaaaaaatgtaaatgatgatcctaggattcgcctattgaaccggttgtacgcgaagaagcggaaagagctccaggagcgccagaagctgaaggatgtacaagtacaaaaggaggaaaaagatgagagatctttggatgagttactttgttttattaatggggatggaggttcaggaggtggggaaagtagtaccaagagtaagaaaaagaataaaagaaggaaggatcatgctaagaaccccgcaaaagctgactctgagtctgtaaatgtggagggagctgcttgtgtggttccgtgcaaagtggatagcagtaatgtttctagacttccatgccaaagtccagatatgcaagatgatgtcgagtacccctttgaagatgctgacctcgatgatggacttgatcctgcaatgaaagaagagcttgatagagaagttgaggactttgcaaggaggttgaattcagtttggagcgagtcacatattggtggtaatggttctgtgcagagatttcctgggtttaatcacaggtgagtgttaagctggcaagatctgaaggcagaagcagaggagatttgtgggcatacagcttggaagggattaaaggccaaacaggccaccttggctcctgtgtgttgtaaaaccttgataactcaggaaccaagcatgcagaaatgcgcaagttcccttggccattttcctgggaaggaggccacctagttgggatgaccctttttttttttctttgggaagggagggttagaggtctgtcttgactcaattttttgttttccttaactgctgtgttgccagttttcctgaataggggaagagaggagtgttgcctgttagctctgttacagatgtccatggaattctgttgtaacactgtattgtggtgcacatagaaatgtgattccctgtattgtggtgcgcaaaaaaaaaaaaaaaaaaa

SEQ ID NO: 673 - DNA, 889 bp, Zea mays
  CDS (106)..(633)
caatctttcgccctcttcgcgcagcagctacagagctagggttccgtcctcgatccgatccggcgagtgctcaccacctttccccacttccctccgatcgaatcgatggcggccgagggcgaaaagaaaatgataaccctcaaaagctcagatggtgaggagttcgaggtggaggaggcggtggcgatggagtcgcagaccatccgccacatgatcgaagatgactgcgccgacaacggcatcccgctccctaacgtcaactccaagatcctatccaaggtaatcgagtactgcaacaagcacgtacatgccgccgctgccgctgccgcagcctccaaggccggttccgacgacgtgggtgccgccgccgccaacagcaccgccgcctccggtgaggacctcaagaattgggatgctgacttcgtcaaggtcgaccaggccacgctcttcgacctcatcttggctgcaaactatctcaacatcaagggtctgctggacctgacctgccagactgttgctgacatgatcaagggcaaaaccccagaggagatccgcaagaccttcaacatcaagaatgacttcacccctgaggaggaagaggagatccgcagggagaaccagtgggcctttgagtaaggaggtgctgagccctctgatctcttatgcctaggtttcgtcatatctactaccttgcaatgctctgcttttaaatgtcatcgtaatggttgtaagtattttgggagtcactttgcttgagaatgtgttgggtaaaactgatgtggtcaatggtcggttattactatgaaaggacatcggctgctgccctaagaggtcaaaaaaaaaaaaaaaaaaaaaaaaaaaaaaaaaaaaaaaaaaaaaaaaaaaaaaa

SEQ ID NO: 674 - DNA, 2127 bp, Zea mays
  CDS (184)..(1980)
ttttctcctctctgcttgctccagttccaagcaccaccgaatcagggcgagtgggagcagagggaaccccatgtctccgcccctcgctggagtagattctcggcgagccggcgtggagctgccgcggtagaaagccagctgagcctgcgagcgcctgatccgcccggagcccgatcgggatcgatgggtggggaggcgccggagccgcggcggctgacccgcgctctgagcatcggtggcggtggcggcggctgggttcccgatgagatgctgcaactggtgttggggtttgttgaggacccgcgcgaccgggaggccgcgtcgctggtgtgtcgccggtggcaccgcgtcgacgcgctctcgcggaagcacgtgacggtgcccttctgctacgccgtgtccccggcacgcctgctcgcgcggttcccgcggctcgagtcgctcgcggtgaaggggaagccccgcgcggccatgtacgggctcatacccgacgactggggcgcctacgcccgcccgtgggtcaccgagctcgccgcgccattcgagtgcctcaaggcgctccacctgcgacgcatggtcgtcacagacgacgacctcgccgagctcatccgtgccagggggcacatgctgcaggagctgaagctcgacaagtgcaccggcttctccacggatggactccgcctcgtcgcccgctcatgcagctcactgagaactttgtttttggaagaatgtcaaattaatgataaaggcagtgaatggatccgcgatcttgcagtcaactgtcctgttctggcgacattaaatttccacatgactgagcttgaagtgatgccagttgacctagagcttcttgcaaagagctgcaagtcactgatttccttgaagattggcgactgtgatctttcagatttgatagggttcttccaatctgccacatcactggaagaatttgctggagggacatttaatgggcaaggggaactcaccaagtatggggatgttaaatttccatcaagaatttgctccttgggacttactttcatgggagcaagtgaaatgcctattatatttccttttgctgctatactaaagaagctggatttgcagtacactttcctcaccaccgaagaccattgccagctcattgcaaaatgcccgaacttactagttctcgcggtgaggaatgtgattggggatagaggattaggtgttgttgcagatacgtgcaagaagctccaaaggctcagaattgagcgaggagacgatgaaggaggtgtgcaagaagagcagggaggggtctctcaagtgggcttgacagctatagcggtaggctgtcgtgaactggaatacatagctgcctatgtgtctgatataaccaatggggccttggaatctatcgggacattctgcaaaaaactctatgacttccggcttgttctgctcgatagagaagagaggataactgatttgccactggacaatggtgtccgagctttgttgaggggctgcaccatgcttcggaggtttgctctgtacttgagaccaggagggctctcagatgcaggtctcggctacattggacagtgcagtggaaacattcaatacatgcttctcggtaacgttggggaaaccgatgatggattgatcagtttcgcactgggatgtgtaaacctgcgaaagcttgagctcaggagctgttgcttcagcgagcgagctctggccctcgcaatactaagtatgccttccctgaggtacgtatgggttcagggctacaaagcgtctcaaacaggccgagacctgatgctcatggcgaggcccttctggaacatagagtttacacctcccagttcccagaatgctggtcggttgatagaagatggggaaccttgcgtagatagtcatgctcagatactggcatacggctctcttgctggtaagaggttggactgcccacaatccgtggtcactttgtatcctgcgtgagtgtaaatagactgagggcccgtttggtgcccatggaaccgttgtctggaacaatttctggtaggattgcttgctgatttgtataggctttgatcagctggaaacaaatgaacaaggcctaagctcgtgtctttctctcaaaaa

SEQ ID NO: 675 - DNA, 2336 bp, Zea mays; identical to SEQ ID NO: 372
  CDS (167)..(1936)

SEQ ID NO: 676 - DNA, 2106 bp, Zea mays
  CDS (174)..(1892)
aacaacctcggcttctacgactacccgtaggagtcgaagtcgactggcgtagcgtaggaggcggcggttccaggcgaccatccaataatcgccaccctcacgcgagaaatccccggcaacttttggggaactacacgtgtatggagttttattagtattccaggggcatcacaatggcatactttcctgatgaagtagtagggtatatccttggttatgtaacgtcgcatcaggaccgcaacgcggtgtccttggtctgccgggcatggtacgacattgagcgtcatggccgccattcggtgcttgtaagaaactgttatgcggtgtgcccagagcgtgtacatatgcggtttcccaacatgcgcgcactgagcttgaagggcaaaccgcactttgctgaattcaaccttgtcccggcgggttggggtgccactgcaaatccatgggtggatgcgtgcgcccgtgcatgcccaggtcttgaggagctccggctgaagtttatggttgtgactgatgaatgcctcaagttgctttctctatcctttaccaactttaaatcacttgtccttgtttgttgtgaggggttcagtactaccgggcttgctaatattgccaccaattgcaggtttcttaaggaactagacttacaaaagagttgtgtgaaacatcaagaccatcagtggattaattgttttcccaagtcttcaacatcactagaatgcttgaatttttcctgcttgactggggaggtgaatgctgttgcactggaggaacttgttgcaaggagtccaaatcttaaaagtttaaggctgaatcttgcagttccatttgatgttttgtccagaatcctttctcgcacacctaagctagaggatttaggcacaggatcctttttacaaggcaatgaccctgctgcatatgccagtttatgtagagctcttgagaactgcacttcactgaagagtatatctggtttttgggatgctccaggcttttatgttcaaggaattttgtcaaattgcaagatcagaaatcttacatgcttgaatctcagctatgctacattgattcagagtacccagcttatcggtattattcgtcattgtaagaagctccatgtcttatgggtgttagatcacattggtgatgagggcttgaaggctgtgtccttttcttgtcctgatcttcaggagttgagggtatatccaagtgttgttgcaccaagaggtactgtgacggaggaagggttggtagccctatcttcgtgtcggaagttacagcgtgtgctcttctcttgtgttcgaatgacaaacacggcgctgatgacaatagcaaggtactgcccacggctaacgtccttcagactatgcattcgcaagcccaggtcagcagacgccgtcacaggacagccactggacgaaggctttggggcgatagtgcggtcctgcagaggcctgaggcgtcttgccatgtccggcctcctcacggacagcgtgttcctgtacatcggcatgtacgcggagaagctggagatgctctcggtaacgttcgcgggggacaccgacgacggcatggtctatgtgctcaatggctgcaggaacctcaagaagctggtaatcaaggagagccccttcggtgacgccgctctcctcgcgggcgcgcacaggtacgagtcaatgcgcagtctctggatgtcgtcctgccagatcaccctgggtggctgcaaggcccttgcggccaccatgccaaacatcaatgtcgaggtcatcggtggggcgagctttggtgcgatggatggtggtgtcagcggtgcgaggaaggtggacatgctctacctctaccgtactctggctggacctagatgcgatacgccaggattcgtctcgatattgtgagctgtatctatggctactgttggtggcgttcagggaaacccgatgttcttaaccgtgcctgctgtgggctgtggctgtgctactctgtctggtagtgtttcggaaacacgatgtttatttgcgtaaggtagtgtttggttctggaaccattttaaaaaaaaaaaaaaaaaaaaaaaaaaaaaaaaaaaaaaaaaaaaaaaaaaaaaaaaaa

SEQ ID NO: 677 - DNA, 2146 bp, Zea mays
  CDS (107)..(1894)
aatcacagcggcaggggacagcaaaaatctccatgcccacgctcggcctagatctccggcgagccggccccgcgcggtagccgattcactctccgaccccgacccgatgggcggcgaggtgccggagccgcgccggctgagccgctcgctcagcttcggctgcggcggcgtccccgaggaggcgctgcacctcgtgctcggctacgtggacgacccgcgcgaccgggaggcggcctcgctcgtgtgccgccgctggcaccgcatcgacgcgctctcgcgcaagcacgtcaccgtcggcttctgctacgccgtggagcccgcgcggctgctcgccaggttccggcggctcgagtcgctcgcgctcaaggggaggccccgcgccgccatgtacgggctcatccccgaagacttcggcgcctacgcggcgccctgggtcgccgagctcgccgcgccgctcgactgcctcaaggcgctccacctgcgccgcatgaccgtcaccgacgaggacatcgccgtgctcgtccgcgcgcgcggccacatgctacaggtgctcaagctcgacaagtgctccggcttctcaacggacgccctccgcctcgtcgcccgctcctgcagatctctgagaactttgttcctggaagaatgtataattgccgatgaagggagcgaatggctccatgaactcgccgtcaacaattctgttctggtgacactgaacttctacatgacagaactcaaagtggagcctgccgatctggagcttcttgcaaggaactgtaaatcattgatttctctgaagatgagtgactgcgatctttcggatttgattggttttctccaaacctccaaggcactgcaagaattcgctggaggcgcttttttcgaagtcggagagtacaccaagtacgaaaaggtcaagctcccacctaggctatgcttcttggggggtcttaccttcatgggtaaaaacgagatgcccgttatctttccgtattctgcgtcgcttaagaaactggacctgcagtacactttcctcaccactgaagatcactgtcagcttatcgctaaatgccccaacctactggttctcgaggtgaggaatgtgattggggatagaggactggaagttgttgccgatacatgcaagaagctacgaaggctgagaatcgagaggggggacgatgaccccggccaagaagagcagggaggagtctctcagataggcctgacagccgtagctgtcggctgccgggaactggagtacatagcggcatacgtatccgacatcacaaacggggcgctggagtccatcggcaccttctgcaagaacatgtacgacttccggctcgtcctactcgacaagcagaacaaaataacggatctgccgctggacaacggtgtccgagctctactgaggagctgtaccaagcttcggcggttcgccttgtacctgagaccgggagggctctcggatgcaggcctcggctacgtcggacagtacagcgggaacatccagtacatgctgctcggcaacgtcggcgaatcggacaacgggctgatccggttcgcgatggggtgcgccaacctgcggaagctggagctgaggggctgctgcttcagcgagcgggccctggcggtggccgtgctccagatgccctcgctgaggtacgtatgggtgcaggggtacagggcctctcagacgggccgggacctcatgctcatggccaggccgtactggaacatcgagttcgtgcctccccgtcccgagagcgcgtgtcgggtgatggcggatggacagccttgtgtcgacacccatgctcaggttctcgcgtactattccctcgctggaaggaggccggactgtccgcggtggctggttactttgcatcccgcgtgactgtagatacggcaaggtgtccgagtgtggttactgttactaccagctgcttgtgtaccgtaatgaactgtagtgccgacgtactgtagcggaggtgtagtgtagtgcaataataagttgcggtgttgcttgtactggtatctagtcctaggaggatgtatactaagttatgctgtgctttcttctccccggaattgtattctgttgcttccactgtaaatatcagaaatggctttttgctaaaaaaaa

SEQ ID NO: 678 - DNA, 966 bp, Zea mays
  CDS (42)..(746)
cctccaccaccattcatcagaaagcgaagcaccagcctctgatgccaagccaaagcacacacacctcctccagcctttcttcctctacaaccccaattcttccctgcagctctgctgctgccttgtttcgatcggtcatggcggcggtggccacagagactccgttccatgtcctggcggtggacgacagcctcccggacaggaagctcatcgagaggctcctcaagacctcttccttccaagtgaccactgtcgactccgggagcaaggcgctgcagttcctgggcctccatgaccaggacagcacggttcctcctgtccacacgcaccagctggatgtggctgccaatcaggatgtggctgtgaacctgatcatcacagactactgcatgcctggcatgacaggatatgacctgctcaagaagatcaaggagtcgtcgtctctcagagatatcccggtggtgatcatgtcctctgagaacattccttcaaggatcaataggtgcctggaggaaggagctgacgagttcttcctaaaacctgtgcggctatcagacatgaacaagctcaagccccacatactgaaaagcagatgcaaccaggaacagcaccagcaaagtgacagtcacagtggcgaacgcaggaaccccacaatcagcagcagcgatagcataaacaaccgcaagagaaagggtgcaggcaccgaagaaatcttgccccagctggcaaacagatcaaggcacagttaactgagaactgactagtacagctaaaaccttttctttttcactttactttggcttactgatttgtaacgtagatgttagccctggatttgcaaaacggaacggaatctgtaaactgatactgcttgagtcgaatcgatcgaagtgattctgcaccaaaaaaaaaaaaaaaaaaaaaaaaaaaaaaaaaaaaaaaaaaaaaaaaaaaaaaaaaaaaaaa

SEQ ID NO: 679 - DNA, 1485 bp, Zea mays; identical to SEQ ID NO: 604
  CDS (107)..(985)

SEQ ID NO: 680 - DNA, 1962 bp, Zea mays
  CDS (597)..(1496)
tgagatgatctctattcgcttggaaagtagagataggttaaatttcggtctgaacggtgaaaccttaaataaaatcttaggatgctgtgtgagagaagcatgctggctccctcaaaggtatgtttgattgaagaatcaacggattgaaaatctcttatggatagaagtgcttattaactaaagattttgaagaagaagctgctgtctgctggagagaatggtgtggacaacgcggtaaatttggtgcagatggatggtgtgttcaaattgatcggagttctctggatggatacctatcgagtagtataattcctctctcagctcactgtccagacaattagtgctatctgtgactgttgggcaatcaggttatcgagattttgctggttggagctgtccggcattgctttcatcttttatcaatatgccggtctttggcagcatatggcgattcagaactgtgcgcagtggtttcctcgaatttaggaccccccaactgcattctgtattgagaacattcctgctaaatacatgatacttgcaggtattgtgttgtgtttgcaacgtgatagcttgtactgggaacaaaggtcaagatgggcgccttggacctacaccttgactttgcttctgctcaacatggacaagccaagttaaaggaatatgccaagagctctttgttgtctgatggaaactacaatacagacaagatcaatggttcaaaccctgatgactatgagaaatttgagaaagggataatgcactatgggtgtccacattatagaaggagatgccgcataagagctccttgctgcaatgaaatttttgattgccgacactgccacaatgaaactaagaattccattaaaattgataaaatgaagaggcatgaacttccacgccatgaagtgcagcaggttgtatgctcattgtgtggcactgaacaggaggtgcgacaagtatgtatcaattgcggtgtttgcatggggaaatacttctgtggtttgtgcaaactcttcgacgatgatgtctctaaacagcagtatcactgcaacggatgtggaatatgtagaatcggagggagggagaatttcttccactgttcaaaatgtggatgttgctattcaattgcgctgaagaatagtcatgcatgtgttgaaggggcgatgcatcatgactgtccaatctgcttcgagtacttgttcgattcgacaaatgatgtttccgtcctgccttgtggtcataccattcatgtaaagtgcctgaaagaaatggaagagcactgccagtttgcatgccccctttgctccaagtcggtttgtgacatgtcgaaggcatgggaaaggctcgacatggagctggcaactctgtctgactcctgtgatcacaaaatggtccgcatattatgcaacgactgcggggcaatatcagatgtgcagttccatttgattgcgcacaagtgccagaattgcaagtcatacaacacccgccagatttgaagtaagaatcgcaagtcacacaacaccgtcagatctgaaatagcaaatcctgtgggggtttctgcatttcttcaagaagcgtgatggactgatggccccttcccgtgagctgctgagcaccgggatatctggcaagacactcatcactgtatccactccactgggtcctgcggaggcaaacagctcgagattgtatatctgctgctagctgccgcccttcgttatgcataagcctactcttgccgttttactcctgtcgctccgtgattctagtgtaataatgtcatatttactgttgcttcaagtatggcccgtacggctgcggttgaacggcggcggcggctgctgagccacagtaccttgctgttgctgagactgcacccagccacagtgcgccgccgccgccgcagcttgtagctggacttgatttatgaaggtgccggaagagttcttggttgcgggt

SEQ ID NO: 681 - DNA, 1132 bp, Zea mays
  CDS (95)..(1012)
aacaaatctagggttccaagcgagcgaataccttcctccgcctgccgatctccccgcatctctcgggctaagacgattcgaggcacgagcgaagatgccgcagcggcattcgaaaaacaacaacgacctcgccttcttcacgtacgaggagaagcggaagctcgggtacggcacgcagcgggagcgcctgggaaaggactccatcaagcccttcgacgcctgctgcctctgcctcaagccgctcatcggcccgctctgctgccccaagggccacacattctgtaaggagtgcatcctcgagtgcctcctctcccagaagaaggacatcaagcgcaagctagcagcacatgaggcccagaaaaagcaggagaaagaagaggaggaagagaagctaattctgcagaaggctaaggagttggatgcctttgatcagcagaatcatggagctgttccccagtaccatgatcgcagtggttcccaatacaagaatgggtttcatggagcaaatagtgtgaaggtcacttcttttgaagaggaagcccttcgcaatatgaaggcattctggctcccttcagctactcctgaagctacggtcaaggtagacttgccctccaccgacactgtttgcccggaggggcaggagaagcttaagttgaaatcgctcttccctatctcgttcacagaggaaactgctgatcagaagagcagcaaggcaggaaactcctgtagctacatgtgccctagttgcaagtccactctcacaaataccatgtcccttgtggcggtgagcacctgtggccatgtcttctgcaagaaatgttccgacaagtttctagtgaaggataaagcttgcttggagtgcagcaaaccattcagggagaggaatctggttccattggagaaaggaggaactgggtttgctgcacatgatgaacgcctggaggcaagagatttcaagtatttgggtagtggctctgggttagggctagtgaagcctgccccaaaaacttactaaccttgaataattatagctgatgttgtgtattgtttaccatggtgtcatgaaattatgtaacctggagaattttgttttatggcatcaaaatcgttgtattcagaacagttcatcttc

SEQ ID NO: 682 - DNA, 1080 bp, Zea mays
  CDS (117)..(902)
cctcacttaaaccctcctccgctcgacgacaccacacgaaaatatacgtcagaataaaccgcagcaaatcttctccggcaccggcagcgcccaaatccggcaatccgctgctccgaatggactcaggttacaatccccggacggtggaggaggtgttccgggacttcaagggccgtcgtgccgggataatccgcgcgctcaccactgatgcggaggatttcttcaagcaatgcgacccggaaaaagaaaacttgtgcctgtatgggtttcctaatgagagctgggaagtaaatttgcctgctgaagaggtgccacctgacctcccagaaccagcattaggcataaactttgcaagagatggaatgcaggaaaaagagtggttgtccatggttgctgcacatagtgatgcatggttactttctgttgcattttacttcggtgctcgattcggtttcaataaaaatgacaggaagcgcctctacagtttgattgatgatcttcccatggcttttgaaattgttagtgggaagagtgaaaccaaggcaccagcaccaccaagcagtagtaaccacagcaatatcaaaccgaagtccaacaacaaaaagaaaccaccggagcctaaggtgaagcagccaaagccgcgtgcccctgcagaggaaggcgaggaggaagatggcagtgcaagcgaggacgagcacggggagacgctgtgcggcgcgtgcaaggaaagctacggccccgacgagttttggatctgctgcgacctctgcgagaagtggttccacggcaagtgcgtcaagatcacggcggccaaggccgagcacatcaagcagtacaagtgcccgtcctgcaccggcggcggtggcgtcagcaacagcggcaccaagcgagcccgcccatcatagctgcgacttttagtgatgtaaactgcttagaaaaactgttgcggacatagcgcccatcatagctgcgactttttaaatggtgctgtaaacttttgtagtgcgactaggccgtttgtcaccctatcatacttggcttcaagtaggttttttgtttttcagttttcaaaaaaaaaaa

SEQ ID NO: 683 - DNA, 1666 bp, Zea mays
  CDS (487)..(1428)
attcggctcgagcgcacgcaaagcacggacgggcgcatacagctttccctttcgcgagtgcgtgccccttctcttctctagttctcttctccgtcgcgtcagagatcagggagagaccagagcaaacaacaaccaccgcttgtttcatcaagaatcgtggaggagaaccgaaaggtgtagtagccttttccggtagggcatctgctagagccggccggttgaagcaggggagcgagaggaggagggcagccgagcaggagcatcgcagtggtggttaagcagcagcaacgacgacgacgacgacgctgagaggtttccccgttcccgacggcacgtccaccgaggcggcgccatcgcgatgggtcctctggcgccgctgaggtgtaacccgccgccgccgttctccaagtcgccggggtccctgctgctgctgtccaagtcgctcaccctctactgctgagccgagccccctcctcgatcggttccatgggcgccgtggcctcgtcggcgggtggggcccggggaggcgatggcacggtgctgggcgacctgccggagaactgcgtcgcggaggtgctgctcaggctggacccgctggagatctgccggatggcgcggctcagccgcacgttccgtggcgccgcgtccggggacggtgtctgggagtccaagctaccgaggaactacgcgcgcctcctcgccgttgctgcggccggcgatggggaaggtgggcaggccgccgcgtcggcgccgggggcagagctgctgcccaagaaggaactgtacgcgcggctttgccgtcggaaccgtttcgacggcggcaaaaaggagttctggctggacaagggcggtggaggtctatgtatgtcaatttcttcaagggcgctttcaataacaggcattgatgataggaggtattggaacttcattcccagtgatgaatcaagattccgcacggttgcgtacctctcgcaaatctggtggtttgaagtgagaggggaggttgaattcttcttcccagaaggcacgtacagcctattctaccgcattcatctcggccgaccattcaagcgtcttggccggcgagtctacagctcggagcacgtccacggctgggacatgaagccggtgcgtttccagatgtcgacctccgacggacagcatgttcagtccaagtgctacttgagcgatcccggtatctggatcaaccaccatgtcggggacttcgtcgtgaaggactcgagcaggccagtgaacatcaggttcgcgatgattcagatagactgcacgcacacgaaaggcggcctctgcgtggattcggtcgtggtgaaacctcagcacctctcgcagaaaaaaagcgccctggacttacgtgtagactcgtcgaacaagttgctgctgctgtctagggaggagggatatgatccatagtttccttttggattgttctactaccagatgtgcgttttgtttacagaagtgcggttttttacatttgcacttatacgcgtattttgcagtcatgtaatgtaattgaaggggtaagtgatttttttagttcctcttgtcccccctaggaacatgttggacctctgtaaattgttcgtttgaactttgaaatgtacatcggctgtgttctgcctatcacaaaaaaaaaaaaaaaagg

SEQ ID NO: 684 - DNA, 1419 bp, Zea mays
  CDS (227)..(1114)
agcgatttcgccgggggggagatcttgccattccgtggagcaccatccgcggtagcctagccgcgactggggatcggggcttgcgggccgtggagccacccagaaggtagccgggaaaagcttgatccggccggggacggggccttcggaggttcgtccctcgatcgggtgtcgtctgcgaaagccgggtcgaacaaatcgtcgcgactggaggcggcgcggggtcatgggggcgtgggtctcggtcctgctcgggatggacggagccgcggcggccgggcctgctgctgtgggcctgggcgacctgccggagctctgcgccgcccaggtgctgctccggctcgacccgccggagatctgcaggctcgcgcaggtcaaccacgcgttccgcggcgccgcgggggctgacttcgtgtgggaagccaagctgccggagaactacaactatctgatggagttcgtggggagcggcgacgaggggaagcggaggcggcggcgggccgggaagaaggagatctacgcgaggctcgccaggcctgtgccttttggcgacggcaagaaggaattctggttggacaagaacaaaggcatgatctgtatggcactgtcgtccaaagcactggtgattactgggattgatgacagaagatactggcaacacatgccaacttcagaatcgagattccagtctgtagcctaccttcagcaaatctggtggtttgaggtggttggtgaagtcgatttctgcttccctgttggaacatatagcttgtacttcagggtccatcttgggaagttctacagacgatttggccgccgccagtgcacctcagagcatgttcatggttgggacaagaagcctgttcgcttccagctatcgacctctgacgggcagcaggcattgtctcagtgctacctggaggagcccgggagctgggtcctgtaccatgctggcgattttgtggcctcaaagcctgaccagctgatgaagctgaagttctccatggcacagatcgactgcacgcacacaaaaggcgggctgtgcatcgactcggttcttatctatccaaaagggaaggggtttcaccaggagagggtggtcaggtctcagaaatgagggttgtagatgttgtggaggtattcacattaggatgttagagcaaatgcagcttgcagcctgatcttatttttactttgggctctagttcgcagcagaggtgaagtgtatgtggttgtagaactcaggtattgtgtggtcaggtgaccaccagagtgctctgtcagtcctttggcaaggtcgttttcgccccccttcagctgaatttggacagcgagatagccatgaaactgtactgaaatgagttcgaaggtgtcattcccagtttctaatttgctttctactgcttagtttcggaaaaa

SEQ ID NO: 685 - DNA, 1723 bp, Zea mays
  CDS (352)..(1410)
cagcctccaggcccatgtgaaacggtggatggcccgccctacgcgacccgggttctgcaccctgccgtttcttctccattattcccagcgggcgcgctcgctctctctttctccctcccctcctcgtggcgacgattgggggcagtcgctgccgccgtacgccaggtgcccagatcttcttcatgcccttctccagcgacgagtatcagaagctgtttgtgcttttaaggatgcataagcgtatggcggttttgatggtatccattgtttgaacgatgggaggatagaagaccattctctgcataaataggcttcataagtattattgctttattgctttaatattatcatatgattgagtgcacaatgccatcaaccttacttgatgatctccctaacgaagttgctctccagtgccttgcacgggtaccattcttgttccatccgacgcttcagttggtttgccgctcttggcgagcatcagtttgcagtggcgaacttctcaaaattcgtaaccagattggtacgacagaagagctcttgtgtgtgttggcgtttgaaccagaaaacatgtggcaactttatgatcccctacgagacaagtggataactcttcctgtcatgccatctcagattaggaacatagcccgctttggcgtggcctcagttgctggcaagctctatgtaattggtggtggcagtgatcgagttgatccgcttactggagatcacgacaggatctttgcaagcaatgaggtttggtcttatgatccgctgcaccgtgtgtggtcccagagggctcctatgcttgtggctcgagcgatgtttgcttgttgtgcactggatgggaaaataatcgttgcaggaggcttcactaactgccgcaaatcgatatcaaaggctgagatctatgaccctgaagctggcatatgggagcctcttcctgaccttcgtctggctcatagctctgcatgtactggacttgtcatcaagggtaagatgcatgtattgcataaaggtctatcgacagttcagattctggaagatggtggcagtcattgggctgttgaggatttctcttggttgcaaggcccgatggcgatggtcggtggagagctgtatgtgctgagtaacagctgtattatgaagcaacgtggtgagaacttccctgataagatggtatcgtgtgcatctgagttccagagcaggatcggtttcgggatgattggtgtgggtgacaacatatatttggttggaggagtgattggacctgggccgagaaaccaatgcatcaagctgctctctgatgttgatatcttgaacgtcacaagtgagagaccaacctggagaccagggtcgccgatgacgcattgccgagggagcatctgtggctgcgctttgttgaggatttagcgtcttcccagtgtgatagtgtgagtattccaccattgctgaactgatcggtgacgtcctaagttttattttattttcaaaagggttgttatttacgctttccttttggatcctttgtagcattgagggcatgactcaatgttggattgccaatgagatatatactatattgaccatgaacagtgttccagaacacactatatacttcatcattttcatttggcatttaaatattttggtggttttaaatgacatcttgctggtttgaataaaaaaaaaaaaaaaaaaaaaaaaaaaaaaaaaaaaaaaa

SEQ ID NO: 686 - DNA, 1938 bp, Zea mays
  CDS (96)..(1406)
cctccattcccttccctgctcctctaccccttcctctcccggcgaccagctggcctctcctttgttgaggcgagagacccccacccgatccggcgatggacgccgcgtccaggccgcctccgccccacggagcaggggtccgcgtccgcgccccgctggtggagtctgtctcctgctactgcagattagatacaggccttaaaactgttgttgaggccaggaagtttgttcctggcgcgaaaatgtgcatgcaacctgaagtcaaacaaaacaagcgcaagtcaaggggctcaaaaaaggaaaggtgcaggactcaagcaccacttttacctggccttcctgatgatcttgctattgcctgccttatacgagttcctcgacttgaacagcccaaactcaggatggtttgcaaaagatggaaccgtcttttgtctgggaattacttttactccttgcgtaagaaaattggagtggcagaagaatgggtgtatgtctttaaaagggaccgtgaagggaagatatcctggtatgcctttgatccactccaccagctatggaagtcactcccaccagttccacaagagtattcagaagcattgggctttgggtgtgccgttctgagtggttgctatctgtacttgtttggcgggaaagatcctttgaggggttctatgaggcgtgttgtattctacaatgctcgtacaaacaaatggcaccgggctccggatatgatgaggaaacgtcacttttttggttcttgtgtaataaacaattgtctctatgttgctggaggagagtgtgaaggaatacagagaacactgcagtctgcggaagtttatgatccaaataggaacagatgggcctgtgttactgaaatgaacaatgggatggtgcctttcattggagttgtatatgatggcaagtggttcttaaaggggctagattcccatcgccaagtaactagtgaggtctacttaccatcatccaatacatggtcagcaattgatgatgagatggtcacaggctggcggaacccaagtatttctttcaatggccgtctctattcagctgactgccgggatggctgcaagcttagagtctatgatgagaacacaggaacatggacaaggttcatggacagcaagcaccacttgggcagctcacgtgcctttgaagctgcagctttggtgtcgctaaatgggaaactctgtgtcatcaggaacaacatgagcataactcttgttgatgtctccaacccaacaatgagtgttgagacagatagtgcgcgcatgtgggaaactgttgttcggaagggccagcacaggtcgtttgtggcgaacttatggtcgagcattgcaggacggaacttaaagagtcacattatccattgccatgtgctgcaagtttgagggcaggttttgttagtgggaacatgatcaagttttttaagaagcaaaaggttcagatcagtgacagaaccctccatttcgaaggtagtaaggtttcattgcagaatcgcggggaaaaaggtcattggcgtgccactgctgcccccaaagtcccaaatagttatttgctctcttccagaactgaaaattccaattactttctggcaacatttgaagactcttatcattaatggataaggtttttcagattttgagtgcaaaccagaaagtgagtaggaacttccctagtgtaatgacattttccccttgctggcaggctgggaaatgtgtttggtggatatattggtctcttatcatatttatctatctttgcatcgtgtaatatgtggcatcttactgtgtaatgttggtgtatattgtagtggcggactagctagactccagggttagagtagtcaggattatgcctagtatgcttcaatttttttgttggtccgttcataaatatatgacgccattgacgtttttt

SEQ ID NO: 687 - DNA, 1841 bp, Zea mays
  CDS (436)..(1524)
cggctcgagcggctcgagccgatctggcccagctctgggttgcgcgaacagtcggaaccctaattccctccccggcgccggcgccggcgccccctagctgcgcccccacgaccagcagaatccagatcgaagttttgctcttgccgcggccccgcctaaactccaaaagtgcgaaccccctaactcatcgatcccagcctgcctccgcctacgcgcctcgtgacggcgtggacccctcccctatctgcgtgctgcgcgcatccgcctgcggcctgtcccgtgcagccgtgcctcctccgcgcacatctccagggtctagccgagagcagaccgccgtgacgccaccactcgcgctcgcgctcctgacatcgttgtctgccttctctgtctaagatcagagcagagctccatcgaaagcgtcgcccgcctgcttggatgatcaatcaccacgaaatagtgcagtttgggaagctgtacaatagagacatggaatcagctcctgctcatacccctcttatacatggtcttcctgatgaggtagctctcatttgcttggcaagagttcctcggcggtatcataatattctcaggcgtgtctcaaggagatggagagctctgttatgcagtgaagaatggcacttgtgccgcaagaggaataacttggacgagccgtggatctatgtaatctgtagggaagcaggcatcaaatgctatgtgttggctccagatcctccaagccggtgctttcgaatcatgcatgtcattgaacccccatgctcagggaggaaaggtgttaccattgaagctttagacaaaaagctatttcttctgggtggctgcagttccgtgtatgatgctacggatgaagtatattgttatgacgcatcctcaaatcgctggagctcagctgctccaatgcctacagcaaggtgctattttgtgtctgcatcccttaaggagaagttgtacataactgatggatacggcttgacggacaagtcaccaaattcatgggacatctatgacccggccacggactcgtggtgcacccacaagaacccgttgctcacccctgacatagtgaaattcgtcgcattgggggaggagctggtgaccattcaccgagcggcgtggcacaggatgtactttgccggcgtatacgacccgctggaacgcacctggaggggcagagggaacgagatcgctctctgctactcgagcccgacggtggtcgtggacgggacgctgtacatgctggagcagtccatgggcacgaagctgatggtgtggcgggaggacgccaaggagtgggccatgctcggcaggctctccgacaaggtcactagacccccctgcgcgctcgtggccatcggcaggaagattcatgtggtcggaagagggctgagcatggtcaccgtggatgtggacacggcggcaagggtggacgggttcctggttaccacctctgtaggcccgttggtggaggaagacctgaccccggagaggtgcgtggtgatcaccatctgaaggggtgggcgtgtccaagcttccttgacgccgggtgtattgtggtaactgtgactgactatcgtcgctggcgccgaacatttggctagctagcgtggatgatatatactgcgatgtgagtgaattcaataagaggcttggctctccatacagccaataactatagttagcatttgtatctcgtgttgtttgggctgcttttgtcgactgctggctgtaagaacaatatttgagcttcgtttgttgagtactgtgcgtcccagatggatgggattaatacaagctaatgtgatcctcgtcaaaaaaaaaaaaaa

SEQ ID NO: 688 - DNA, 1246 bp, Zea mays
  CDS (79)..(927)
ccacgcgtccgccgctcctccctccccgacaccgaccgacccctcgtccgctcgcctccctccccgatccccaccgccatggccgccgccgccgccgccgcgtcctcctcttcctcctccgaggttccgatcgccgcccgcacctgcgtctccgtcggcgaggtggcggtgggcgcggtggctacaggcagcggcgaccgggtggcggcggattgcggggtgtgcgccatctgcctcgacaggatagcgctccaggagacggccctcgtcaagggttgcgaccacgcctactgtgtgacctgtattttgaggtgggcatcctacaaggagaaccctctctgcccacagtgcaagcatccattcgaattcctcagcgtgcaccgctctctcgacggctgcctacatgactacctgtttgaggagagtgtttgcctccttctgagggcagcttggtttgaacctctgatcgtagaggctcacgaggaggctctggaagaagaagagtttctccaccagcagtaccaatacgatgatgacgaagatgatcttgacgaggaatcttattacatgaacaggtccccaagcatccgtattggtaacaggagatggggtgacaatgggtacatcaggggaggcaggaaagaggcgaggccagtgaatactgatgtggctgctggtccatccaggactccgaagaagaaagagaaagccgcatcctcttcggcgtcggtgtcagtgtctggttcggggtcaggatcggggtctgtatccaaggatgtcgctggaaggcgggcgaagagggcgcagaagcgagaagctgcagacaaggcagctgcagagaagcacctgaagcacctgcagaggttggggctgagaaaatcgccagagcctgtagtgcccgaggaggttgggccacaggtgaatgagtgacttaagccgccgcctagtgctatatggtgctgctaaaaacactgcagccctttgggccacaaaataatcttccactgtgaagagcttgagcgtggccttgtatcatggcagcttttcgcctcgttgtacatagtctagtttctcatcactgttttagattcagcacagaaatgcagctgctgtctgcacgactgttgcagctatgaagctgtatgtacctcactgttggtgcactattttagttattgctaatcacaggggatgcaatcggcatctgtgttgattactaaaaaaaaaaaaaaaaaaaaaaaaaaag

SEQ ID NO: 689 - DNA, 605 bp, Zea mays
  CDS (128)..(379)
gtcagggctgagtgtgccacaagtggatcattggaggggaggaagaagctgaccactgtgtctccatcggagtcgggcctagtgggttgatcaacatggttgtttgttagttggtcatggtagcactatgaaggtcaagattcttcagtggcatgcagtggcttcttggacgtgggatgcacaggatgagacatgtggcatatgcaggatggcttttgatggctgctgtcctgactgtaagttccctggtgatgattgcccactcatttggggtgtctgcaaccatgcttatcatcttcactgcatactgaagtgggtcaattctcaaacatccacacccctttgccccatgtgccgtagagagtggcagtttaagggctaaggtactatggacatctagaactgcaccaagcgactctcagttctcagagaagactgatgtttttctggtacttctgtgatgctttattttaactactacatattgttttccgtacttagtataaatcctgatgtcagcgcctgatcctgtgtatgcttccaagcttgtagtggaacaaatgaaattattgcttttcttagggctgatttcctaaaaaaaaaaa

SEQ ID NO: 690 - DNA, 681 bp, Zea mays
  CDS (77)..(442)
gagaaattgtacacatattccctgcctctcgctagcgccttccctccgcaaacggaaggctctcgtgaccaccgggatgtccgccatggagaccgacatcaacgcgccgccgccgcccgccccagctggcgagggatcctctgcggccggttcgtcctcctcccgcaagcccaacaagcgcttcgagatcaagaagtggaacgccgtcgcgctctgggcatgggatatcgtcgtcgacaactgcgctatctgccgcaaccacatcatggatctatgcatcgagtgccaggcgaaccaagccagcgcgaccagcgaggagtgcactgttgcttggggagtctgtaatcatgcttttcacttccactgcatcagcaggtggcttaagactcgtcaagtgtgcccattagataacagtgagtgggagttccagaaatatggccactagttcctgggcaccctcatgtgatgttggggcttacttctagtgactgctaccactcgagtgtatttttttctgccaaacagctccatcttttactgctttggatgcttgcatgtatcacaggtcaattatcactagtagtacgtccacctgggactgtatttggattgttcgttgagaggatagtagttccattttataaatgttatgtggattttcataagtgagcttgaattgtg

SEQ ID NO: 691 - DNA, 1997 bp, Zea mays
  CDS (166)..(1743)
cccactccactcgaattaaaaccctagcggcaaaaccttcgctctgcgccgccgtcgcctgctcccgtcccgccaccacatccgcccaggagctcgccgtcggggaggctgctcgaggagccgcgctgtctctcccgcgccgcgaccttcgccctcgccgccgccatgatctgcgcgatctccggtgaggtgccggacgagccggtggtgtcgaagaagtcggggcttctcttcgagcggcggctcatcgagcgctacattgaggaccatggcaagtgccccatcaccaaggatgagcttactatggatgatatcgtgccggtcaataccaacaaggtcgtgaagcccaggcctttgcaggctgcaagcattccaggactccttgggatttttcagaacgagtgggatgctctcatgctttctaattttgctttggagcagcagctacacacagcaagacaagaacttagtcatgcactctaccagcatgacgctgcctgccgtgttatagccaggttgaagaaggaaagagatgaggctagagcacttttggctcaagctgagagacagattccagcatcagttgcaggagctgctcctgcagctgttgtttccaatggaaaaagagcaatggaagatgaaattggccctgacggaaagaagattcgtcctggtatcaaccctgtcatgattgatgaacttacagagtgtaataccatgctttcagcacagcgtaagaaaagacaggttcctccaactctggcaccattagatgcactcgagagatacactcaaatctccagccatccccttcataagacaaacaaaccaggcattttgtccatggatgttcatccttcaaaggatgttgttgcaactgggggtatcgatacaaatgcagtaatctttgatcggtcatctggtcaaatcttgtgcacgcttactggtcactcaaagaagataaccactttaaagtttgttccacgggatcaactctttgtaactggatcagcagataagactgttcgcatttggcaagagaacgagaatggaaactataactgcgtccatacattgaaagatcatactgctgaggttgaagctgttacagtacatgcgactcagaagtattttgtgagtgcttccaaggataattcgtggtgcttctatgatatttcaacaggatcttgcctgacacaggttggcgaggcttcaggacaagagggatatacatccgcgtctttccatccagatggtcttatccttggaacaggaactactgatgctgttgttaaaatttgggatgtgaagactcagtcgaatgtcgcgaagtttgaggggcatgtaggaccagtcactgctatgtccttctctgaaaatggttacttcctagcgactgctgctcatgatggtgtcaagctttgggatcttcggaaattaagaaattttaggaccttctctccctatgattcagatacgccaacaaatactgtggaatttgattttagtggaaactatcttgccattggtggttcagatataagggtctaccaagtagctaatgttaaggccgaatggaatctcatcaagacattaccagatttatctggaacagggaaagtaacttcggtaaagttcggagcagatgctaagtacatagccgtaggttctatggaccgcaatctacggatatttggcctccctggagacgaccaaatggaggaatcaaccacagcggcagagtgaggaaaatccatggtacctaatttcctcctcctggtatactccgcaatatgttctgatgatgggtagactgagtgcaaatggatacatcacgagagaagggtcctcgcggcgatgaactggcttgagcttcggtcggtgtaaacaagctgtgacattattgtattgtaggcctcactaattcgtctgatggggatacaatttgttttgatgagtacgagtgtacgacgctaaacagccaaagttctatgcat

SEQ ID NO: 692 - DNA, 1757 bp, Zea mays
  CDS (262)..(1560)
ctaatttctcgtggaggcgagcagatagacaggagagagaacgcacgcaagaacgcgctctcctcgcgattggacagggcgcgaacaccccgaggacgcgcgcgatccccgaggacacgggggtgacagcctcgccgtcgccggggcggccgtttcgagctccgtcccgcctcggcccggctcagatttggtgggatccggccaagaaatcccgcagttggtgaggaggagaggaggggagaggaagggagggcggaggggatgggcgtcggtgcggagcccaaggatcaggcggcgacggccgctggggtgccggcagagcaggacgaggcgggcgggaaggaggacaaggccgccgcggtgtcctgctcgatctgcctcgacgcggtgctcgctgcgtccggggagaggtccaccgccaggctgcactgcggccacgagttccacctagattgcattggatcagcatttaatgccaaaggggttatgcaatgccccaactgccgcaaaatcgagaaagggaattggctttatgcaaatggttctcgatctgcccatgatgttagcatggatgaatgggcccatgatgaagacctttatgatgttagctactcagatatgccatttcgcttccattggtgtccgtttgggcgcttaacccaacttccatctttatttgaggaaggagaatcatcacctccagttacatttcatgacttcatgggacaacatgtgtttacggagcaagtagctgtatctgctgcagcagggacaactaatccttgcccctatgtggcatacttgcatcctcttacaccattgacgtcattgtcaagctcccatgtccctgacagaactatggatcgtcctgcataccatgatcattggaaccccatggctgggccatcagatgttaggtccatgcaaacaatgcaacctgctgattttcatcatagccattgggcacatgtgccccattcttatggtcaacccaacagcaataacgagcagccaggaatcccctttggagcaagggctgtacgggtcgatggtgatagccaacgccgagcatctgttgtctctccatcttacttcagtaatggatctggttccagatctagacctcccaatgttcctcctctgatgcctcagttcatgagggctcatggcagcatcagcgaacagtaccaacagaattcatcatctagcttatttgctggggcccataggtcaggaggcatgcgacctgccccaacacctctaccagagaaccccacctttaccttgttcccgccaggttcatctggccatagctcgatggagactgatgatgctgggggaagccggttctacgcctgggagggtgaccggtttgccccatacccgttgatgccggtagactgcgagacaagctggcggacctcacagcagcagtcccaccagagcacatcagagcctacatctgctccaaggaggctgtttgggcaatggctcgctgtcggcaggccatccccatcacccgaggggtcttcgtatcgtcaattgcactcaccgcggatgtagaccctcgccgctgaaagaaacgatgggaagcccattgtattaagttaagccgggctgtgccgtgaaactttgggacgatgctcgaggggacagaaactggaaacgatccggctgaggatatttcgatttggtttatgtgaattccatctcgtacatatttgaaatcaagttgggatgctgggagcttcgaatgt

SEQ ID NO: 693 - DNA, 1709 bp, Zea mays
  CDS (161)..(1498)
attcggctcgagcgaaaccgctagaggcagagggaggcgcagcacgaggaactcgttggtggcatcgagcgagcggtgcgagtggcacgagtgcgtgcgcgagcaagatcggagcttttccttcgtcgcagttgtggggaacgcggcgagcgcttccgtgatgggcgccggcgcccaggaggatgaggaggagataaccacggtggccgagggaggagtcggagaggaggagcaagcggcggctgagggcgcaggggaggaggagcagttggagcagggtgcagggggcgagggagagggtggggaggagaaagctccggcggtgatgttgtgctcgatctgcctcgacacagtggtcgccggaggcgaggagaggtccaccgcgaggctgcagtgcggtcacgaatttcacctcgattgcattggttcagcatttaatgccaaaggaatcatgcaatgccccaattgtcgcacgattgagatggggaactggctttatgcgaatggttctcgatcatcacaggacgtaaacaatgatgaatggggttatgatgacctatatgatcatggtcactcagagctggcaacctttgtgcctcttcgcattcagtggtgtcctattgggcgcctagaacttccatccttatttgaagaaggagagtccccagctccagctacttttaatgatttcacgggacaattcaactctgagcccatggtaccggtacctgccacacctcatcctggtccgtatctagcttattttcagcctgccccgacaccggtatcatcaagctcccttgtcgctgagagaacaatggatggtgctgcatatcatgatcactggaacactctggctgggctatcagatggccgacgaccctgggcgtactatcctcaacccaacagtgataatggtatagctgagcagcaaggactccctctgggggcaatggcggttggaggggttgatagtgaaagccaacaacgaggatctctctccttattttatggaaacgggtctggaagaccaaggatcccaggtgttcctcctatggcaccacaatttacaagagcgcatggcaacataaacgatcagttccagcagacagctagcttatttgctgggtcacagcaatcaggaggtatgcgtccattgggagcagtagggccttccgtgccaccacctccggagaacacctccttctgtctgttcccgccagcttcatccgtccccagtacaatggaggccgaggatgtcaacagagcaaaccagttctatgcatgggagagggatcgcctggctccttacccgctgatgcctgttaatagtgaaggtacctggtggagctcttcacaacagcagccccctccggagcctgctgcatctgcttcgaggaggctttctgggcagtggattggtaggttgccattgccaccaccagagaatagatcgccagacggctcgtccttccgtccactgcacatccctcggatgtagcgcaggaactggcaaggcgtaagttaatagtacaaacgtgggaaaccctgttggttgtaagtggtaacgccactgtaagaaagccccgtcggatggtaaaccttgtgataaaattcaggatgttgaagaaaccgaccctgaggtgaaaacatttttggcccggggtttatgcaaaaaaaaaaaaaaaaaaaaaaaaaaaaaaaaaggc

SEQ ID NO: 694 - DNA, 1230 bp, Oryza sativa
  CDS (121)..(939)
gcttctccaattttccaagcctgcctccaagcgcacgccacgatcttctagaagcgattcgcgcgcgccgccgcctcctcccctccccttccccggagcgaagccgccccgccgggggggatgtcgccggcggcggacagcgcggcgtcgaagcggcaggcggagctgctcaagcaggagggcaacgccttcttcaagaaggaccgcatcagcgccgccatcgacgcctacaccggggccatagctctctgcccaaaggttgcagtatattggaccaaccgagcactttgctacaagaggcggaatgagtgggttagggctgaggaagattgtagaacagctattcagcttgacagccactctgttaaggcacattacatgctcgggcttgcacttctcaacaaggacgaattggccgagggaataaaagaactagagaagtcgttggagcttggaaggggtgcacatccagcaagttacatggttgaagagatctggcaagagctttctaaagcaaaatacatagaatgggaaaatttatcaagcgaacgagtccgtcaattgcataagctgaaggaagcatgtaaagaagctcttaggaattataacagccttgacaatcctcctgcatatgtccccgaggaacagctaaatgagcttgaggaagtttttcggaatgccaggaagtctgatattccaacagaagttcctgatcatctctgctgcaaaattactcttgatattttcagagacccggtgataaccccaagtggaatcacgtatgagagggcggtgattcttgatcatcttcatagggtggggaagtttgatcctgtgacccgtgagacacttgaaccacaccaactggttcctaaccttgccatcaaggaagctgtccatgcatttttgagtgaacatggttgggcttacaggatgagatgactactttgaattacacctgggcttggagctttggaggcaacatttcagattgcaatatacatgtttcggttagtcaacttaaatgtgtcattttgtttatctttacatatttattggtggaaaaggttttacctgggatggctgtgtacagattccccttctctagctatccctcctctctactctgttcatgtgtaatgcttggtatcagattatcacttatccacagtaaaagaaaattaaagtggctgtcatactccttgttctctgattattggtttttggcgc

SEQ ID NO: 695 - DNA, 1117 bp, Zea mays
  CDS (168)..(857)
ctccaggttccagcgtgcgcgctctcttcccctctccgtcggcgacgactacgccgggtcttcttcagacccaggtcgttgccgcctacgccaggtgcccaaatcttcttagggcccttcgccggcgacgagcacacaagcttggttgacccccaacaaattgcaaaatgtcagccaatgtcggtgaatcaaccagcggtggcagcagcaatgatgcagctggggggagctttgaatgtaacatatgctttgagctgcctcaagagccaatagtgactctttgtggccacctcttctgctggccatgcctttaccggtggctgcacatccatgcacattcgccagagtgcccagtgtgcaaggctcttgtggaggaagacaagcttgttcccctttatggacgcggcaaggatcgtgttgacccaaggtcaaagaacatgcccgagggtgagattcctcaccgcccaactggtcagaggcctgccccagccccccaggccgatgctaacaacaactttgccaatgccaatccaaatgcgaatccatggttcatgggcacaggagtccctttggctaatgcgcgctgggggaactacgcattctcagctgctttcgggggactattccctatgcttagcttccaagttcatgggtttccagatgctgctgcttatgcgcagcctgctgggttccactatgggtatggccatgggcatggattccatggcggccatatgggacacgcccatggcgtccaccgacaagcaccattggggcaacagcagcaggcagatatctacttgaaggccctgctcttcatgattggaattctagtgattgcaagcctcattgcgttttaaaatttgttggcaacgtctaccaggaggcctgctcgtcacggctgggacgtggaattctgggaatgcaatcctcctgacatgtcagagtccgttgatagcttgacatttgtgatggcatattggcccatgaaccgccagaatttcagtgtgtttgtactatagcttggcgctgaatgttgcataagttattattctgtttgcatgaagtgttcatagaatatgtattaatgtctagataagtacctacgtttcgtaac

SEQ ID NO: 696 - DNA, 2623 bp, Zea mays
  CDS (195)..(2021)
gctccctcctccaccaccttccagtcctgtccagtgccgccgccttgccctgccctcccctcccttcccccgattaccctcgcggttgacctcgccaatccggtcccgcctccgtataaatccgcccttctcgcccccgctccgaccacaaaccctagcggcgcgccccggcatgggctagggttcccgcggcgatggagtgggacagcgattctgacggcggcgatgacgaggaggaagaagaggtccgccccgggggtggggacgcgggcccggggttctcgctggccatcgagggcgtgctgggcgcgtgcggcatggtggtctccgacgcgctcgagcccgacttccccatcatctacgtcaaccgcgggttcgagagctccactggatacagcgccgaggaggtgcttgggaggaactgccggttcctacaatgcagaggaccatttgctcagaggaggcatccccttgttgatgcagcagttgttactaggattcggagatgtttagatgaagggactgaatttcatggtgatctgttaaattttagaaaagattgttctccatacatggccaggctgcaattaacacccatatacggagacgatgaagtaataacacactatatgggcattcagtttttcaatgattctaatgttgacttggggccatcttctggctctgtgacaaaggaacttgcaagatctacatggattgcacctggcaacactgactcaccaactccagtaggcaagggtaatttgtgggaacattctagtctctttctgctgagtgatgaggtaatttgccagaagatcttgtccaaactgtcgcccagggatatagcatcagtaaactctgtttgcaagcgacttcatcacatgacaaggaatgaagacctttggaggatggtttgtcagaatgcatggggcactgaagctactcgggcccttgagactgtggcaggatcaagaagtttggcatggggccggctagcacgagagttaaccacccttgaagctgttgcctggaggaaattgacagtcggtggtgcagttgagccatctcgctgcaacttcagtgcctgtgccgtagggaaccgtgttgttctatttggtggagagggtgttaacatgcagccgatgaatgatacatttgtgctggacttgagtgccagcaagccagaatggaggcacatcaacgtgagcgcagctcctcctggtcgctggggccataccctgtcatgcctgaatggatcacggctgattctgtttggtggctgtggggggcagggtctgcttaatgacgtcttcattttggatcttgatgcacagcatccaacttggcgtgagattcctggccttgcaccccctgtaccacggtcatggcatagctcctgcactgttgatggaaccaagctggtggtttctggtggatgtgcggactctggtgttcttctcagcgatacctacctcctagatgtgacaatggaaagacctgtttggagggagatacctgcatcttggtctccaccttcaaggctggggcactcgctatctgtctatgatggcaggaaaatcctgatgtttggtggccttgctaaaagtggtcctctacgacttagatctagtgatgtgttcactctagatttaagtgaagacaagccttgctggcggtgcataactggcagcaggatgccaggagctggtaatcctgctggggtcggcccaccacctcgcctcgaccatgttgtcgtgagccttcctggtgggagagttctgatatttggtggttctgtggcgggtcttcactctgcttcaaaactttacctcctggatccaacggaagataagccaacctggaggcttctgaatgttccagggcatcctccacggttcgcctggggccacagtacttgtgttgtcggagggacaaaggcaatagttcttggaggacaaactggagaagagtggacgctaactgaaatacacgagctttctctagcaagctcattagtctgaagatgggaaggtcccagcaagctttccagcttccttgaagcaatgtctctggagacagctacctgttcatatgacttgaggcagattttttttccaacagtggtgtgcaagcacaagcacaaaagggttggtgaagtggacaaccagacctgattacttgtgccatgcctgggagtcagctggtctaaaagtaggaataagttacctctgctgctgctgttcgtatgatctgaaatgatggaatagctggcatccataagctaatctcagttcttatcatgtttcaaatgggacactggcattatgtcgctggagcccctgatgcaacaggtaccctgccttctggttgcgcctgccttcggtgacaactgatgctgtggtcttctgttttttgacccatcaactgctgtgaagcttctttgttatgcttttgcgccacttcgtgcttactcaattgctgctttctggagaagctgtaacacagacacacctgctgtatttaattttgcctttcgtatcactttgtgcttacctcagctgttagtgatacctataacattttctttttaatctgattatcaaaggatgaattatgaaaa

SEQ ID NO: 697 - DNA, 2028 bp, Zea mays
  CDS (77)..(1930)
cccgcacccaacccaaccacggacgcacgccgaggagggagaaagcgggtgtggaggggcggccggccggcctcgcatgtttgacgacgcgggggccgtggcggtgaagcggatgaggctgtgggaggaggacgaggtggaagtggaggaggaggggatggaggtggacgcggagccgggatggccgtggggaacgccggcggcggggctctccagggcggcggcgatcgtcgtggcggacgcggcggatcccgacttccccgtcatatacgtcaacgccgcattcgagtccgccacggggtaccgcgcccacgaggtgctcgggcgcaactgccgattcctgcaatttcgggatccacgagcccagaggcgacatccccttgttgatcccatggtcgtttcagagatccggcgatgcctcaacgaggggattgaattccaaggcgagctgctaaatttccgaaaggatggcgctccactttacaacagattaagtctcattccaatgcacggggatgatggctacgtgacacatgtgattggaatccaactattctccgaggcaaacatcgatctcagcagcgtgtcgtatccggtgtacaagcaacagaccaacaacaggcccatcattcaagatctgaactcagcttcccatgagcatgctccgaaagtccagagtgcagaccactgcggtatgcttcagttgtcagacgaagttctcgcacacaacattctgtctcgcctgtcacctagagatgtcgcatccattggatccgtctgtaccaggatgcatgagcttaccaagaatgatcacctgaggaagatggtctgccagaacgcgtggggaagggatgccactgtcaagcttgagatgagcaccaagatggtaggatggggccgtcttgcgagagagctaactactcttgaggccgcctcgtggaggaagttcacggttggagggcgcgtcgagccttcccgatgcaacttcagtgcctgtgctgttggtaaccgcttggtccttttcggaggggagggtgtcaacatgcagcctatggacgacacctttgtgcttaacatggaggctgcaaggccggaatggcgccgcgtgaaggtttccgcctccccaccaggccggtgggggcacactctgtcgtggctgaacgggtcatggctggtggtatttgggggctgcggacagcaaggtttgctcaatgatgtcttcgtccttgaccttgacgctcagcagccaacgtggagggaggttgcaagcgagggtcctccactgccacggtcctggcacagctcatgcaccttggatggttcgaagctggtcgtctccggtggctgcaccgagtctggcgttctcctcagcgacaccttcctgcttgacctcaccaaggagaagcctgcgtggagggaaattcccacatcttggtcacccccatcccgcctcggccacaccatgtccgtctacggtacgactaaactgctcatgttcggtgggctggcgaagagcggctcgctccggctgcgctccagcgacgcctacacgatggacgtcggcgaagatagtccgcagtggaggcagctggcgacgaccggattcccaaacgtcggcccaccgccgaggctcgatcacgttgcggtgagcctgccctgtggacggatcatcatattcggtggctccatcgcgggactccactccccggcgcagctgttcctggtcgatccagcagaggagaagccgacgtggaggatcctgaatgttcccggcaaaccccccaagttcgcctgggggcacagcacctgcgtggttggcggcactagggtcctcgtcctcggaggccacaccggggaggagtggatactgaacgagctacatgagctctgcctggcaagcaggcccgacgacgacgacgatgaccgctactgactagtttcgttgcacatggtgttttatatgcttcgtaactacatccagtctgttgttgggtaatcggtatgacaaaaaatagcggaaaattaatt

SEQ ID NO: 698 - DNA, 3247 bp, Zea mays
  CDS (78)..(3026)
cccattctctcacacccaacacccagctatcacaccctgatccccgaggccgcgcgtcggggtgaggaggaggggccatgatggagtcggcggcggcccagtcctgcgcggcgtgcggggacgacgcgcgcgctgcctgccgcgcgtgcagctacgcgctctgcagggcgtgcctcgacgaggacgccgccgagggccgcaccacatgcgcgcgctgcggaggggactacgccgctatcaacccagcgcgcgccagcgagggaaccgaggcggaggaggaggtggtggagaaccaccacaccgccggtggcctgcgtgagagggtcaccatgggcagccacctcaatgatcgccaggatgaagtaagccacgccaggaccatgagcagcttgtcgggaattggtagtgaattgaatgatgaatctggtaagcccatctggaagaacagggtggagagttggaaggaaaagaagaatgagaagaaagcctcggccaaaaagactgcagctaaagcacagcctccgcctgtcgaagaacagatcatggatgaaaaagacttgacagatgcatatgagccactctcccgggtcatcccaatatcaaagaacaagctcacaccttacagagcagtgatcattatgcggttaattgttcttgggctcttctttcactaccgtatcaccaatcctgttaacagtgcctttggtctctggatgacatcagttatatgtgagatctggtttggtttctcctggatattggatcaattcccgaagtggtatcctatcaatcgtgagacttatgttgataggctgattgcacgatatggagatggtgaagaatctgggttagcacctgtagatttctttgtcagtacagtggatccattgaaagagcctccactaatcactgcaaacactgtgctgtctattcttgctgtggactatcccgttgagaagatctcatgctatgtatctgatgatggttctgctatgctcacatttgaatcgctcgcagagactgcagaatatgctagaaagtgggtgccgttttgcaagaagtacgccattgagccacgagctcctgagttctacttctcacagaaaattgactacttgaaggacaagatacacccatcttttgtcaaggagcgtagggctatgaagagagactatgaagagtacaaggtgaggataaatgctttggttgccaaggctcaaaagacacctgatgaaggctggatcatgcaagacggtacaccatggcctgggaacaatcctcgtgaccaccctggcatgatccaggttttcctgggtgagactggtgcacgggactttgatggaaatgaacttcctcggttagtgtatgtgtcaagagagaaaagaccaggctaccaacaccacaagaaggcaggggctatgaatgctctggtccgagtgtctgctgttctgacaaatgccccttacattcttaatcttgattgtgatcactatgttaacaacagcaaagctgttcgtgaagcaatgtgcttcatgatggaccctactgttggcagagatgtctgctatgtacaattcccccagaggttcgatggcattgatcgcagtgatcgatatgccaataggaacgttgtgttctttgatgttaatatgaaaggacttgatggcctccaaggcccagtttatgtgggaactggttgttgtttcaataggcaagcactttatggttatgggcctccatctctgcccgcacttccaaagtcttcgatttgttcctggtgttgctgctgctgtcccaagaaaaaggttgaaagaagtgagagggaaatcaacagagactctcggcgagaagacctcgagtctgccatttttaaccttcgcgaaattgacaactacgatgagtacgagaggtccatgctcatctctcagatgagcttcgagaagtcttttgggctgtcctcggtctttattgaatcgacccttatggagaatgggggcgtccctgaatctgcaaacccatctaccctaattaaagaagccattcatgtcattagctgtggatatgaagagaaaactgaatggggaaaagagattggctggatctatggttcagttacagaggatattctgactgggtttaagatgcactgccgtggctggagatccatctactgcatgccggtgagacctgcattcaagggatcagccccaatcaatctttccgatcgtcttcaccaagttctccggtgggctcttggttctgtcgagatcttcttcagtcggcactgcccgctgtggtacggttacggtggcggccgtctgaaatggctccagaggctctcctacatcaacaccatcgtgtacccgttcacttctcttcctctcgttgcctactgttgcctgcctgccatttgcctgctcacaggaaagttcattatacctacgctgtccaacgctgcaacgatatggtttcttggcctcttcatgtccatcatcgtgacgagcgtgttggagctgcggtggagtggcatcgggatcgaggactggtggcgcaacgagcagttctgggtcatcggaggcgtgtccgcgcacctgttcgccgtgttccagggtatcctcaagatgattgccgggctggacaccaacttcacggtcacggcaaaggccacggacgacactgagttcggggagctgtacctgttcaagtggacgacggtgctgatcccgcccacaagcatcctggtgctgaacctggtgggcgtggtggctgggttctcggccgcgctcaacagcggctacgagtcctggggcccgctcttcggtaaggtgttcttcgccatgtgggtgatcatgcacctgtacccgttcctcaagggtctcatgggccgccagaaccgcacgccgaccatcgtggtgctctggtccgtcctcctcgcctccgtcttctccctcctgtgggtcaagatcgacccattcgttggaggaaccgagaccgtcaacaccaacaactgcaacacgatcatctgctgattcaccatcggtcagctgctgtcgtgccgcggcggacgtgtttctggtgttgcaaacgtgggttgcctgcctgatgcgggtctcctctgtctatctcgcatctgggcttttgccccaggatctgaagcgggtggtgtaggttagctttattttgcgtccaagtgttgattgatgttgtctgtgttatgaaaagttttggtggtgaaacctgaaatgtt

SEQ ID NO: 699 - DNA, 3860 bp, Zea mays
  CDS (193)..(3414)
gaattcggctcgaggcagcagcaccaccactgcgcggcattgcagcgagcgagcgggagggatctggggcatggtggcggtcgctgccgctgccgctcggatctagagggccgcacggtatccgccggcctcgtcggtgtcggtgtcggtgtcggtggagtgtgaatcggtgtctgtaggaggagcgcgaagatggcggccaacaaggggatggtggcaggctctcacaaccgcaacgagttcgtcatgatccgccacgacggcgacgcgcctgtcccggctaagcccacgaagagtgcgaatgggcaggtctgccagatttgtggcgacactgttggcgtttcagccactggtgatgtctttgttgcctgcaatgagtgtgccttccctgtctgccgcccttgctatgagtacgagcgcaaggaagggaaccaatgctgccctcagtgcaagactagatacaagagacagaaaggtagccctcgagttcatggtgatgatgaggaggaagatgttgatgacctggacaatgaattcaactataagcaaggcaatgggaagggcccagagtggcagcttcaaggagatgacgctgatctgtcttcatctgctcgccatgacccacaccatcggattccacgccttacaagtggacaacagatatctggagagatccctgatgcatcccctgaccgtcattctatccgcagtccaacatcgagctatgttgatccaagcgttccagttcctgtgaggattgtggacccctcgaaggacttgaattcctatgggcttaatagtgttgactggaaggaaagagttgagagctggagggttaaacaggacaaaaatatgttgcaagtgactaataaatatccagaggctagaggagacatggaggggactggctcaaatggagaagatatgcaaatggttgatgatgcacgcctacctttgagccgcattgtgccaatttcctcaaaccagctcaacctttaccggatagtaatcattctccgtcttatcatcctgtgcttcttcttccaatatcgtatcagtcatccagtgcgtaatgcttatggattgtggctagtatctgttatctgtgaggtctggtttgccttgtcctggcttctagatcagttcccaaaatggtatccaatcaaccgtgagacatatctcgacaggcttgcattgaggtatgatagagagggagagccatcacagctggctcccattgatgtctttgtcagtacagtggatccattgaaggaacctccactgatcacagccaacactgttttgtccattcttgctgtggattaccctgttgacaaagtgtcatgctatgtttctgatgatggctcagctatgctgacttttgagtctctctctgaaactgccgaatttgctagaaagtgggttcccttttgtaagaagcacaatattgaaccaagagctccagaattttactttgctcaaaaaatagattacctgaaggacaaaattcaaccttcatttgttaaggaaagacgagcaatgaagagagagtatgaagaattcaaaataagaatcaatgcccttgttgccaaagcacagaaagtgcctgaagaggggtggaccatggctgatggaactgcttggcctgggaataaccctagggaccatcctggcatgattcaggtgttcttggggcacagtggtgggcttgacactgatggaaatgaattaccacgtcttgtctatgtctctcgtgaaaagagaccaggctttcagcatcacaagaaggctggtgcaatgaatgcactgattcgtgtatctgctgtgctgacaaatggtgcctatcttctcaatgtggattgtgaccattacttcaatagcagcaaagctcttagagaagcaatgtgcttcatgatggatccagctctaggaaggaaaacttgttatgtacaatttccacaaagatttgatggcattgacttgcacgatcgatatgctaataggaacatagtcttctttgatatcaacatgaaaggtctagatggcattcagggtccagtctatgtgggaacaggatgctgtttcaataggcaggctttgtatggatatgatcctgttttgactgaagctgatctggaacctaacattgttgttaagagctgctgtggtagaaggaagagaaagaacaagagttatatggatagtcaaagccgtattatgaagagaacagaatcttcagctcccatctttaacatggaagacatcgaggagggtattgaaggttatgaggatgaaaggtcagtgcttatgtcccagaggaaattggagaaacgctttggtcagtctccaatcttcattgcatccacctttatgactcaaggtggcataccaccttcaacaaacccagcttctctactgaaggaagctatccatgttatcagctgtgggtacgaggacaaaactgaatggggaaaagagattggctggatctatggttcagttacagaggatattctgactgggtttaaaatgcatgcaagaggctggcaatcaatctactgcatgccaccacgaccttgtttcaagggttctgcaccaatcaatctttctgatcgtcttaatcaggtgctccgttgggctcttgggtcagtggaaattctgcttagcagacattgtcctatatggtatggctacaatgggcgattgaagcttttggagaggctggcttacattaacaccattgtttatccaatcacatctgttccgcttatcgcctattgtgtgcttcctgctatctgtcttcttaccaataaatttatcattcctgagattagtaattatgctggaatgttcttcattcttctttttgcctccattttcgcaactggtatattggagctcagatggagtggtgttggcattgaagattggtggagaaatgagcagttttgggttattggtggcacctctgcccatctcttcgcggtgttccagggtctgctgaaagtgttggctgggattgataccaacttcacagttacctcaaaggcatctgatgaggatggcgactttgctgagctatatgtgttcaagtggaccagtttgctcatccctccgaccactgttcttgtcattaacctggtcggaatggtggcaggaatttcgtatgccattaacagcggctaccaatcctggggtccgctctttggaaagctgttcttctcgatctgggtgatcctccatctctaccccttcctcaagggtctcatgggcaggcagaaccgcacgccaacaatcgtcatcgtttggtccatcctccttgcgtctatcttctccttgctgtgggtgaagatcgatcctttcatctccccgacacagaaagctgccgccttggggcaatgtggtgtgaactgctgatccagattgtgactcttatctgaagaggctcagccaaagatctgccccctcgtgtaaatacctgagggggctagatgggaattttttgttgtagatgaggatggatctgcatccaagttatgcctctgtttattagcttcttcggtgccggtgctgctgcagacaatcatggagcctttctaccttgcttgtagtgctggccagcagcgtaaattgtgaattctgcatttttttatacgtggtgtttattgttttagagtaaattatcatttgtttgaggtaactattcacacgaactatatggcaatgctgttatttatacgcaaagactgatacattcttcggattgtgagcaaacagtcagaacactgtaatctcttaggacaactatataaggcagctgttgtatcatctctaaaaaaaaaaaaaaaaagggcggccgc

SEQ ID NO: 700 - DNA, 1268 bp, Zea mays
  CDS (277)..(1059)
attcggctcgagcaacagtgtgcgtcttgtgccgcaggggcgtgggccttcttcctcctcttccggcactccactgctccgtctcccggcctctcgcctctcggcctctccatcgttcgacctcgcgacgcgtcaagtaggggggcggcggccttcgcggagatgaccaccttcctgatcaccggaggcgatttcccgcgacactcctcccccctccccgtgctctgctagacagatagatccgggctcttccttgatttgttcggtgaggacatcatgtggagttttgcatcaaatgccatagctggaagcttaaagaaaaaagcacaaccctcaaaatgcagcatatccaatgcagattattctgatgatgaagtttcttcatgtacaagcagagaggaaggccttgattgtccaatatgctgggaatccttcaacctcgtggagaatgttccctatgtcttgtggtgtggccacacaatgtgcaaaaactgcatccttggtcttcactgggcagttgtcaagttcccgtcccttcctatccagctgcctttgttcatctcatgcccctggtgcaacctgctgtctttccgcctggtttacaagggcaacctcaggttcccacgcaagaactactttctgctctggatggtcgagagcatgaacggtgggagagcaaaattccattccactaaccatgacgagcatcattccacgtggcattcaagtgccggcacaagctccagccatcaacagcgaagaaatgctgctgtaggatcagagagctcttctggcagagagacaggcgtaggccgcaacattttccacaccgacaacattagtgcttctctgcaaaagcttatggtgtgcttcatgcagctgacggccaagttcccactcgtgataatctttctgctgatagtcctttatgctgtccctgcaagtgctgctgttctggttctctacgcccttgtcacgtttttgtttgcactgccctcatttttgatcctctactttgcctaccccagcttggattggcttgtcagagagatcttcgcttaattcgtgctgtctgaaatgtccgcgcagtttgtatccctgcgacaaatgatatatatcggtatatgtattccatgggccacctgccctcgtaggccctgtatagtttcttcttattctctgtccttgtagcactctatttctgttgtaactaacagcttattaaaaatgctctgcaatgcttttatttgcaaaaaaaaaaaaaaagg

SEQ ID NO: 701 - DNA, 1159 bp, Zea mays
  CDS (218)..(1033)
tggcgtccgcccaaccctccaaaccaaggcggccaagccccttccatttgccaggcggccacaccatctgatccccaattcgtttccacctatcgagccaaggtgcgacgacggcggtcgcagcgtcccctccctccctccgtaccgctgccgccggtctaccaaacggtgaaatatttacgtaagcgaatcagggtcttgaagatagcttccagatatgtggggttttgcatcaaatgcttgggcatccgggctggggaagaggagtcccccaaattgcacctcttcgagtgctgcttgttccgatgacgaagcatcctcgtgcacgagcagggaagaaggcctggaatgcccaatatgttgggagtctttcaatatagtggagaatgtgccttacgtgctatggtgcggccacaccctttgcaagaactgcgtcctaggacttcaatgggccgtcatcaaagttccaactgtgccgatgcagctacccttcttcgtttgctgtccctggtgcaacctcctgtcgcttcgcatactttacaaagggaacctcacgttcccacggaagaattatttcctcctctggatggttgaggggatgaatggtgagcgggccagatcacgcccagctactcacagcgagcaacatactccatggctctcaagcagcagcagagcaaatggaaatgcaggctgttcaaatcccacaagacgccaccttccgctgccaccgccggttgacactacttcgcccaccaatgcaaatcatgccaaccatggggtccctgtccctctgctgaacgcagagagagtacaagcttcgctgcgcaagtccttgtcgttcctggttcacctgaccgccaagtttcccctggtgttcatcttcctcctcatagtgctctatgcgatccctgccagcgcagcagtcttgctactgtacatccttatcacggtgctgttcgcgctcccctcgttcctgatactgtatttcgcgtatccgagcctggactggcttgttagggaaatctttgcctgagatttccttgttcggtaaaatctcaatactgttgttgagtccttgtataactgaaccttccctagatcttgttgcaagcgtggatgctattgcaaagttttggtttttacaccaaaaaaaaaa

SEQ ID NO: 702 - DNA, 1115 bp, Zea mays
  CDS (167)..(754)
ccacgcgtccgcaccgagtggcgaccgcctgacgcgcccgtgtcggcaagccgccgacgacttgacgtggggcgggggaaacaaaacaacgcgggcagcgccacggcaagcgcgtccctgccacggcgcggacacagagagtggaaaccggaaggggggaagagagatggattcctccacctcggcggcggcggcaggggaggcggccgtgccgccggaggacgacgtctgctccgtctgccacgaccgcttccggatcccgtgccaggcgaactgctcccattggttctgtggagagtgcatcatccgcgtttggaattatggacctcctgtacaggcttgcaagtgtcccatttgtcgccgccttataaatctactggtgcctgctgcattatcagggcaggaggatggtccacaagctcaacgtattctaggagagattcagcactataactgtatatttggtggagcaccacgcagcctaactcagaggttgcaagacctacccttcttcatccgaagactgttcagagaactaatggacccccagcggaccctcccactcgtgttcagggcgcggatgctgatgatggtcgcactgagtgcaatttatgtgctgagccctgtcgacattcttcccgaaagcatgctgggcctctttggattcgtcgatgacctgctcatcctgctcatcgtgttcctccacctcgccgcggtgtaccggtcgttgctcctgtaccgccacgggggccagtagaagtcgctgcgcataaaccgtttgtttagctggtttccatgtggagttctctgagatcgcagcagcggatttggaagatcgccgactcgccgagtagatggcaacgtcacggacggcttagcctgtccctgctctgtaccattctactacgcctgtttttctgagactctgacacggtgaactgaactttggttggttgatgcaagtgaatttcccttcgttttactcgtcaggaaaagaaagggaaagagtttgcgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagg

SEQ ID NO: 703 - DNA, 964 bp, Zea mays
  CDS (62)..(814)
tttcctcacaacctcacccggctccatccacgcggctccaacgccagccacagcacgagccatggactcgcgcgtcgtggacggcgcaggtgggggtgccgacgcctccttgccggccgatccgccgagccccgtgcccgatccggccgcgggcgggatggatgcgcgcctcccatcggacctgcttcgtgcagtgctgcaaaggctgccgccgatcgacctcgcgcggtccgcctgcgtctgccgagcgtggcgcgcggttgcctccgaccgcgccgtggtcgaggccgccttctgtgcgccctggggagtgcggcgcgtcgtcggagagccggcgacgggggccttctggcgggccgcctcccttgggagatttgcgctgtcgcatgcgatccgccgcggggataccgtccccggtgtcgctctcaagtactccgtgcaggtgaccgatatcaaacgattcaacaacatgatgagtgaccatggcatctattcgagggagaggcttctggttccgatcagcaacccagaaatccttcttggcagcacctgctacatcgagatggaccataacgctaagagagaggttgcaatcttttaccccgagggacgcccaggtggcaaaactgactctgtggcaagcattgtctctgcggagaggagaaacaaaaggattctcgagtcggtgaggcggagcctgcacgtcgatgatggcactgctgcgtactacttatctgttactgagggtgatccgagggctgccatgacggagtactccgaggacctgaggtgggagcagcaacgcgcaggtcggtagattcatatatattccaatgacatatgttaagatcatggtgcttgatccttatcatttggtgtatatattgtacaatctggatggttgtaagtataaatacaaactttggtctaatgaatatagatgcatgtacgtgataataaaaaa

SEQ ID NO: 704 - DNA, 1651 bp, Zea mays
  CDS (266)..(1288)
cacattcctccctcagtccctcttccccccgtttcatcccttcacacccacagcccacctggtctgtcatcccctttgctacgctccccttgccctgtcccctcgccgcccgcgcccgtggagttcttcgatcgagtcctcggagcccggagcacctggtgcaacaatccggacccgcgcgaggaagggcggagagagagccgaatctgagcctcggcacaagttgggcacccgtcaagattctcggcccgatctgctgcggaacatggagctggacagcatcgagtgcatgtcctactccgacagcatgggggacgacgacaccgacgccgtcacctcgtcccagctccctcgccccttcctcaaatcctcctccaccgccggtactgccgccgtcaacgtggtcgtcgtctccgaccgcgtcggtgccgccgggccggtagcgggagcgggttcgctggtgatttcgccagccacgggcgtgcacgagctgctcgagtgccccgtctgcaccaattccatgtacccgcctatccaccagtgccaaaatggtcatactctatgttccacctgcaaaactcgggtgcacaaccgctgcccaacttgtcgacaagagctaggtgacatcaggtgtctggcattagagaaggtggctgaatcacttgagctcccctgcaaatactactctcttggatgttcagaagtcttcccatactacagcaaactcaagcatgaatcacagtgtaattttaggccatacaactgcccttatgctggttctgaatgctcagttgttggggatatttcttttcttgtggcacatctgcgagatgatcataaagtggacatgcactctggatgtacatttaatcaccgctatgtcaagtccaatccaagagaggttgaaaatgcaacttggatgctaactgtttttcattgttttgggcagtacttttgcttgcactttgaggcatttcagcttggaatggcaccagtatacatggctttcctccggtttatgggcgatgaaaatgatgctaggaactacagctatagccttgaggttggtgcaaatggcaggaagatgatatgggagggaactccccgcagcatccgggacagccaccggaaggttagggacagccatgatggtctaataattcagcgcaacatggctctcttcttctcaggtggagaaaggaaagagctgaaactgcgagtcacaggccgtatctggaaggagcagcagaatcctgactcaggagcctgcattcccaatttgttcagctgagctcagtaacaagaggatggatccaggtgtatattgatacggccgatgtgtttgtgtgagcgtgtgcctgtgctttgcgttttgtcctgccaagctgccattgcagcccgccctaaattagtcagggcgtatttactgttggcaggataatgaaaatactggcttactccttttgtgggctgtgactaagctcccatgaatctcacgataagcatttttctcgatccaatggtgtatactgtatcgttttgggctgaaggctgcagctttttttgctgttatgtttgtctcggtgtatttgtgtgtctgcaaataaagtattgaacagtaactgggtaccttgcataaggtttggttggc

SEQ ID NO: 705 - DNA, 1596 bp, Zea mays
  CDS (203)..(1402)
ctcgcgattactactgtaatccccaccacaccacctcccggatctcagggtgggtggagtgcttcttggcgacctttctttgcatgtcaacgcagacaaaaagaacagcgccgccgcctccacgaccacgaccacgccggtcgccgagcctccgtctcctcccgagagatctcgcagccagctagccgccgtacgtggccacatggaggcgccgcggccaaacaacggcaggaagcgcaagcccacgcctcccgccggcctgggggccctccacgacgacttgctcgagcgggtcctcgcgcgcctcccgccggccacctacttccgcctgcgcgccgtctgcagccgctggcgcgccgccgcggcgtccccgaccttcctccacgcctgcgctcgcgtcccctcccgggacccatggttcctcatgctctccgactccgactccgggccccgcccgcccgtcgccttcgacgccgccggccgcagctggaaccgctgccacgccgcgccgggggctgccgtgcccgtggccgcgtcggccggcctcgtcctctaccgcgcgccggccacgggcgcgctcaccgtcgccaacccgctgacaggcgcgtcccgcgcgctcccctcgccgccgcagcaggccgcgcgccagctgcaggccatcgccatgtacggcgccggcggtccctaccgcgtggccctcttcgcgggcgacctccccgacgacctctccatggcggtctacgactcctccagcaactcgtgggaggggcccctgccgctcgcccgcaagcccggggacgactcctgccccgacgcgccggcgcccgacgacacggtctacttcctcagcaagtccggggacgtcgtggccaccaacatgcagcgcagcgcgtctaagcagtactcctcctcagtggtcgtgcgccgcgacggcgacggcgacgccgcctttgcctacttcctcagctactcgggcacagtcgtcgcctgcgacacggcgcgccgcaccttcgcggagctgccccgcatcctccccgtctacttcgagtactccatcgacgtcgtcgcgtgcggcgcagcggcctacgccgtcgtgctttcggaatacctcggcacggccagcctgcgcgtctgggagttcgccgggggcgcgtggcggcaggtggccgccatgccgcccgccatgtcgcacggattccacggcacgcggcccgatatcaactgcgtcggccacggcgaccgcctcatggtttgcgtcacctccgccgaggccaacgcctgcttcatgtgcgacgtggccagcaaccagtgggaggagctgcccaagtacgtcaatgccgacggcgaggccagcgagttcctggccgccttctccttcgagcccagagtggaggtcaccgtataagcgcttatggttatagtgttactacaattaattgctttcttcattaaggcgccatagttttggttcggctcctactccgtgtgattgatttcttcgtgtgtgtgtgcatgtacttacggtaccgaattgtaatgtcatttttcattgacattatttgtcttcaataaaattgcagatttcgtgtgcagtcc

SEQ ID NO: 706 - DNA, 1348 bp, Zea mays
  CDS (103)..(1113)
caactcccgagggcccatttcgccgtctttcactccatcaccccctctcccccagtcccccgtccctttcccctcagccatctccttccccctcacctcgccatggcgttcttctctcaccaccatctccagcagccacacccgcagcaggcaccgcccccgaatcagcagcagccggtgcttccttccttcaggaacgcgctaccggtgcctgtggatggccagatcccagcgcccctcaccttcttcaacccgccgcctgccttcccggagcagcccgcgcagacaacgctggtggatgcggtggggctgacggcagctgctgggcttgggtggaggcagccgagggagcaggaactgcttggagaaaactcccagatgtcgtccatcgattttctgcagacgggctcggcggtatcgacggggctggcgctgtctctggaggaccggcgccacggcggcggcggggctgggaactcctccggcgattcaccgctgctcctgctgcccatgctggacgatgacatttcacgcgaggtccagcggcttgacgctgatatggaccgcttcattaaagctcagagtgaacggctgaggcaatctatactggagaaagttcaggcaaagcaatttgaggcactggcctcagttgaggacaagatattcagaaaaatacgggataaagaggcggaagtggaaaccatcaacaaaaggaactctgaactagaggaccagattaagcatttgggagtggaagttggtgcttggcagcaaagggccaagtacaatgagagcctgatcaatgcactcaagtacaacttggaacaagtatgtgctcaccagagcaaggacttcaaggaaggctgcggtgatagcgaggtagatgacacggcgtcctgtccctatggtggtgctgtcaatttgcaactgatgccaaaggagaacagacaaccgaagaatttaacggcttgcagggtctgtaaatcaagtgaggcatgcatgctcttgctgccgtgtcggcatctttgtctatgcaaggagtgcgagagcaagctgagcatctgccccctgtgccagtcctccaagatacttggcatggagatatattatgcatagaatataatttatgtatcacattagtatcgtacgagatactgctatgttaatacgtcaatctattgccgaagttcagaacctatgtaccactattgacttgccactggatcaaaaaaagactgccgtttatggtagatttaacgcagcaaatttctttgcgaaaaaaaaaaaaaaaaaaaaaaaaaaaaaaaaaaaaaaaaaaaaaaaaaaaaaaaaaaaaaaaaaaaaaaaa

SEQ ID NO: 707 - DNA, 1403 bp, Zea mays
  CDS (123)..(1184)
ctgcactgcacggtagtcgcgtcgagtcgacgcgcgattcctgccatttgggtgggccagcctttcctggcaatctcggggggcgtttcgcctcgctgcgtggcagaaaggtgtgacgtgtgatgcatcccaaggctcgaatccacgccgacccggtgcgcgaggtcgaccacttcgactgcctgccggattcgctcgtcctgctcatcctgaacaaggtcgaggacgtgcggtcgctcggccggtgctacgccgtgtccaagcggctctgtgggctcgtttccctcgtccatgatgtgtatgtcaagattgaccgcgtcgttgcggtcgacggcgacgccgagggcacgctcaacctgtcctcgccgaagcctcggagcatcttctcgcacttcctgaggctgatgctcttcacaatcatcaagccgttccacaacatgcgcagccctaatggtactgcgaggccattgttcccgcagctctcgcagcactcaccggcacaggtgctcaggaacttcacgcacgtcaggaaccttcggatcgagctcccctctggggatgtgggtactgaggagggagttctcctgaaatggcgagcagagtatgggagcacacttgagaattgtgtgatcctggggggtacccgggttgaccgcaagcctgttggtggagagcatgagccagctttggaggacaatggaagcatgccagagtctttctataccaatggtgggctgaaacttcgtgtcgtctggacaatcagctctctaatcgcggcatcaacaaggcactatcttctccgctcaatcatcaatggccatcccacactacagagcttggtactgacagatgctgatggccaaggcacattgtgcatgggggcaaagcagctggaggagttcagagagaaccagttgtcggcctcggcatgttccaacaggactcaggtcccagcctgcaacatgaagctcaagtacgctccatatgttgaactgcctggtggtatggcgttgcaaggcgctactttggtggctatcaaaccctcacctgagggaagcaatggaagccaccctaaccgcaaggaagccgaaggattcgtctttggagcattcgatgggccatttaaagctgctgtgaagacgctgatgaagagacgcacttaccttctggagatgaatggcttctaggaatcttgtccatcttggtatcgagcttgttggtgctatgcatggtacatttagctgagtgtctcatctgtgtaatattcaagaaggcaccatctctagttgatgcttgctgtctgctgttttagctctttgtacagtgttaacatttggttatataaagatcatatcaagtcctctagtgtaatagtgaatcttatctctctacagttcaccttc

SEQ ID NO: 708 - DNA, 944 bp, Zea mays
  CDS (42)..(803)
cacccgtttccgggaggagagagagggcgggggcgaaggggatggcaaagcgccggcgccacgagttggcgccggtcgtggaggagctgatttcgccgatgaacagcctggacgacggctgcctcatgcacatcttcagcttcctgagcccaatcccagataggtataacaccgccctcgtttgccacagatggcgcttccttgcatgccaccctcggctatggctgcgtgtcgagaggccaatcagagatgcgatggagcctggagtttatccagatctcgaggctgctgtttctgctgctaggccgggtgacaccattcttattgcggctggtggttcccatgttgcatgtaacatccaaataaagaagcctatttgcataattggcgggggcgatcttcctgatgacactgtattgacctgctcacgtggtttcgacaacgcactggagtttctatcaacatgcaagattgcaaatctgactattagagcagaactcggatgctgcttgctgcatcgaggcggtagattgaccatccaggagtgtctgctgcagtgcgagcaaaaccctttggaccacctgtccttcccaataatcagcacagcgatagagtacgatccattctcatccctcaaggagcaagggcacggagtaacggtcgtccgcaccaggatcgaaggaggcgcgagggccgtcaggacgaacggcacactcgcgctgcgccatgtgcgggccatctattcccgcagctctgttttcttctggttcgaagtaggagagaaagtagaagcgcctgtacactagcaaaaaaacccgtgttcgttcttgtatgtcagtgttggtatcaccctagcgtgcgtttggtgaactcggacggctgcctcgtgtctgttgtgatctctttataattataataccccactgatgtttgaaccaaaaaaa

SEQ ID NO: 709 - DNA, 1716 bp, Zea mays
  CDS (255)..(1280)
ccagactagcagatagagaggcggagccgcggaggccagcatatctccctcgttttggtttgcgcccaagcaagcgcctcacgcgagcaccgccgctgccgccgttcactttccccctgaacaccagccgccgccgccgccgccgccgtcgccgccgcatgcacgcacgctgcctctgcacgagcggcaagcggcgatccggcgatcctcgtcgatccccgccctaacgcgctgcggtggtccgtgcagacaagatgaagttcggcgccacatatgaggagtatctccgggcagagcgggacaaattcctagggcaatgctcccatgtagaatacaaacgcctcaaaaaggtattgaagaaatgtagagttggtcgctcactgcaagcagatggcacaaatggtgatgagcagcaggaggggagagacgaatcttcaaacatttgtgaatgcaactcatgcacattgtgtgatgagatgttctttacagaactcaacaaggaagcatcagaaatagcaggttgtttcagatctagagtacaacgtctcctccatcttcatgttccttcaggactacaacgctgtatatggcgttttaggcagtgtttcatagatgatcagcaaataatggttcaagaaggcagaatgcttctcaattatgtgaccatgaatgctattgctattcgcaaaattctcaagaaatatgacaagatacatggttctgtgagtggcagagatttcaagagcaagatgcaaactgagcatattgaactgttgcagtcaccttggctgatagagcttgctgctttccatcttaactgcgatgattcagatgctgatgaacctagagctggagagttcttcaagaatggattcttcaagaatttttcctgtgacctgagtggagcacagccactactaacaatgaccatttctgaaactctgaagtatgagtacagcctaacttgtccaatttgcttggacactttgttcaacccttatgcgcttagctgtgggcatctgttctgcaaagcctgtgcatgtggtgctgcttctgtctacatcttccagggtgtcaagtcggcacctccggaggccaagtgccctgtctgccgagcggttggtgtgtttgatcgtgctgtgcgtatgactgaactagaattgctcctcaagagaagggacaaagattactttctgcagagactgcgcgaagagcgaagtgtgatggtgaagcaggccaaagaatactgggactcacaggcaatgctatcgatggggatttgaaagctacaatgttcttaccagttcaattgttgtggctaattacatctgaaggttctctggctaattacatattttagttcctggcaagcgtcaatcaattaagttaactgcgctcacataacagaaattgacatagcagaagctgagcccatcgaagaagcaaacaaaatcagttgcattctatcattctccgcctgattcagatttggaagaatcgaacggatttaactaatttctttgttccttccgttctactacaagcttgaaatgacgaaactcatattgtatttacatatctactgattattgggttatttaccctatttactgattgttggtgtgttatttgcctgtaaaagtgaagtcaaatgttgtccagctgccctgaacctcttaagaccatctccaaagttcaacccccaaaaaaaaaaaa

SEQ ID NO: 710 - DNA, 1583 bp, Zea mays
  CDS (179)..(1291)
gagcgagttatctccggctcgaacccgtactcctcaagcaaaaccactggaggagcaccaagagttatctccggctcgaacccgagccaggtcctgactcctgatccgcaccgcacacggcaagggggcatcgccgacgggccgtcagcggcgagacccaagccaacacagcccagcgatgtcggcgcgtgaccgcgagacggccgaggcgctggtgcgcctcgccgcctcgctggacggggcggtgctcggcctcggcacggctgccgtcgccgtcgcgtcgtgggtcaagtacctcgccgtctcggggcagctacgcctcgtcgcctccgcggcgacggcctccatcgccgacgcccgctccctcctctcaggcgacggcgccgagccgcggatcgccgcggtgcggggctacgtgcgggcccatgacaagttcttccgggccccgttctcaggcgaggcgggcgtcgtcacgaagcacacccagatgtgtttgttcacagaatggagaggcatctttggatggacctttgatctgcatgctcttcttttcagatcatggaaagagcaaattgtgacgtcttttagatcggttccatttgttctggttagtactgaattaggaaatcctacgggagtggtacatataaatgtggataaggcggatcaaccgttgcctcttaccacagtgtttcataaacttatcccacttgagacgactccttacacattgtttcaaactattattggcaacggctatccgattgcgttgttggatgaagaaaaaatactaccgattggtaagaaaattacagcaataggactatgtcaagcaaaggatgcagaaagtgttgagataacatcgtgcccagagatcccctttttcttatctgaactaaccaaggatgagatgcaagctcagctggcttcacgtgctaggatactcttctggggtagtattgttttgggaaccttgtcggtttgcctagtgggccatgccatttacaggggctggacgagaatcaaactacgaagagaggctaggcatgcacgacagatgtttgaggaggctgaagatgctattcacagggatgactctagtgatgatgatgaaataggagacgggcaactatgtgttgtgtgcttaaggaagagaaggagggcagcttttattccatgtgggcatcttgtctgctgttccgaatgcgcattaacaatagagcgtacacctcatccattgtgccctatgtgtcgtcaagacatcagatacatgatgagggtttatgactcttgaggtatgctgctgataagatctacacgcttccttgctgacccatgcaaacctgaggagcacaactgttcgtcctgctgggcgttttcctagtcaaggtggcctaccctggatttgtgaatataatgtcttgaccctccaaattatgctcttgattgcctgggacaaatagcttagctgaagtcatgaactaacgtagagttattttttgtttgctttgcgcatatgtctatccatcatgtaaagcacagggtttactgcaaataggttaaagatttggacattttctgcc

SEQ ID NO: 711 - DNA, 1130 bp, Zea mays
  CDS (221)..(931)
ccagtctaagccaccacccaggcccagctcacctctttcctctcttctcatgcccacgcgctcgcccatctcatagtccttccccattccgcctctctagctggcctgtcgaggaccctcgccatcctccccaggcgcaccaccaaacggtccaaacccccagcggcggcgctaggatttgagtctcagcgcgccggcaccgccaccgccaccggcggtgatggcagggcaggagcgtaggacaatcgatctggaggagggatgggcgtttatgcagaagggtatcaccaagctgaagaacatcctcgagggcaagcccgagcctcagttcagctccgaggactacatgatgctctacacgacgatatacaacatgtgcacgcagaagccgccgcacgactactcgcagcagctctacgacaagtatcgggagtcgttcgaggagtatatcacctccatggtactaccttcgctaagggagaaacatgatgagtttatgctgagggagctagtgcaaaggtggtcaaaccataaagtcatggttcgttggctctcgcgtttctttcattaccttgaccggtacttcatatcaaggaggtcacttaccccacttaaagaagttggtcttacttgcttccgagagttgatatatcaagagattaaagggcaagttaaagatgcggtgatagctctgatagacaaagaacgcgagggtgaacagattgaccggggtctgttgaagaatgtattggatatttttgttgaaattgggctgggtcaaatggagtgttatgagaatgactttgaagatttcttgctcaaggatactacagagtactactctgtcaaggctcaaagctggattcttgaggtgcgttatggtgatttgcgtgcttatgggtcctgccacagcaagggctgctcgcatttgtaaattggccgttaaaatagacaatcttgacctgcattagatgatatgatgatgatatgaggaataggagaggcactcaagtacttgtttgccatctatgccaatgttttacctatatgtctgtatcaatgtttcagttaactgagatgagattatgcttgggggttgctttgctaaaaaaaaaaaaaaaaaaaaaaaa

SEQ ID NO: 712 - DNA, 1328 bp, Zea mays
  CDS (33)..(863)
ccacgcgtccggttttgctgctgattagacaaatggagcatagcaacacacaatctggagctgctaaggtttctattttaatgattggccaacaagctatcatggatgcatatctctgtctacttcacctgactgctgggatattggttgagtcactcttcaatgccttcgcaacggctgcattcttcaaatttgttgtattttctatttttgaaatgaggtaccttctcgccatatggaaagcaagtaggcctttaaacagtggagaaggttgggagataatgaggcgagagctgtctgttctttacagccgcttttatggcattctgttgggaggaatccttctaatgtatgagctgcacaatttcttacgcccacttctcctcctgatgtactccttttgggtacctcaaattgtcacaaatgtcatcagggatacaagaaaacctctgcacccacaatatattttaggcatgacagttacacggcttgctattccattgtatatatttggttgccctagtaatttcatgcgtatcgagcccgacaagaaatggtccatagctgttacagtattcatgggtatccaagcagcagtgcttctgcttcagcactatcttggttctcgctgctttattcctcgccagatactgcctgagaaatactgctaccataggaaggtagaggacagcacaaatcagcccatcgattgtgttatttgcatgactacaatcgaccttacccaaagaacaagtgaatacatggtggcaccttgcgagcatatatttcactcaggctgtttacagcgttggatggacattaagatggagtgccctacttgccggcgctccctaccaccagcttagatgaggctttgtatcatatataatagtgaacaagaagtaggtagctcagcttatacaaggtgggggaactgatgtacaataaggtgaggctgcaatcgtgtgaaagctatgaacagaactgtagaaaagttttatactattgatttcaagaggtcttgtgttgtgcaaactagcgtatcaagcatcccacgaagaaatcgtccttccccgctcatgcggttatcactgttgcatgcctttgcctgctaccagtatttcggcccagcgttttggtctgagctttgtgcaaagtttgttaacgccgtgaaagagttcgagatgtgcattcttgatttggtggacacattagtagcgtgtttggtttgaggaatgagatctctctcactcacttttttgtttggtttgtggaatgaaatgaattaatctatcaccatttcatttaaaaaaaaaaaaaaaaaaaag

SEQ ID NO: 713 - DNA, 1824 bp, Zea mays
  CDS (227)..(1492)
cagaaaaattcctcccaccgcgacggcgacgagcacggggaccctccaccgcctccgcctccgcctccgcctcgccgcgtgcggcctccgcaccgccccgacgtcgacccctccgccctccccctcggccaccgacgcggcgccgcccgccctccgccgccgccgccgccgcggcgggctcggtctcctctggaagctcccctacggccgcgcgccgtcccgcccgatggacgcgctgccgcctctgcagcgcgccacgtcgccgccgccccagccccggccccagccgcccgtgccgtccaggaggtacggcgtgcacttctcggcgtccagcttcatccaggcgccgctcaccacgctgctcgagtactccggcatcctccgccccgatccaggcggcggaacccagcaggatggggccggggctgggccgggcgaggtgtcgatccggattgtggcgcccggcgaggcggggacgtcgtctgagaggcccgaggaggtgatcgtggaggaggaggaagaggatggacacgcaacgagaacgcgcccggaggacccgtcacctgcggctggtggcggggagggcggcagggaatcctcctcatcgtaccagcggtacgacatacagcaggtggccaggtgggtggagcagatactgccattctcactgctgctgctcgtcgtcttcatccgacaacatttgcaaggtttctttgtgacaatttggattgctgcggtgatgttcaagtccaatgatatcctgcgtaagcagactgctctgaagagggagagaaaaattccagttcttgtcgggattacaatattatttgttgttcacgtatctgggttttattggtgttacaagaacggggaccttataagacctctcatgatgcttcctccaaaagaaataccaccattttggcacgcaatattcatcatcttggtgaatgatacaatggtgcgccaaactgctatggttgtcaaatgtttgctgctgatgtactacaagaacagcagaggccgtagctatcgtaggcagggtcagatgctgacgattgtggaatattttctacttttgtaccgcgcattattgcctacacctgtgtggtaccgttttttcctgaacaaggagtatggaagcttattttcgtctctaaccactggcttgtatctcactttcaagttgacatcagtcgtggaaaaggttcaatcatttttgacggcattgagagcgttatctcataaagacttccattgtggctcatatgcaacaagcgagcaggtggctgttgctggagatttgtgcgcgatatgccaagagaagatgcacgttcccatccttttgcgctgcaaacatgtcttctgtgaagattgtgtgtccgaatggttcgagagggagcggacttgcccgctgtgcagggcactggtgaagccagcagacctccggtcgttcggtgacggttcaacaagcctcttcttccagctattctaatctgagagagccaaaagagctgggcaagctggggcgctccaccctgtgcagatgttaggtgtgtgtgtgtgtgtgagtgttgctgctggcaacgcgtgcgagcagtgcggccctgatgcggtgctgggagagtgtacaccgagctgaagctgaaggcgtacatggttttgtattgtgattgtgcatattttcatcccatgtataggcactcgcgggatgcttgagcacctgaggatttttacctgaccttatacgcacaaactactacgtaaatagaaatggtgagtatatacaatggttccggatgcgtcgataaaaaaaaacgttaa

SEQ ID NO: 714 - DNA, 1672 bp, Zea mays
  CDS (68)..(1342)
gatcaaccgctcgaaattcgggggaagcaagcgagagcagcagtaagcctcatcgggaagtggagagatggaggcggcgggtcgcctcctcctcctcatcgtctcctccctcctcctgctcttctcgccggagcggccggcggaggccgcgccgccgcgaatccagccgctcgccaccgccgcgctgagccgcctctacgacacctccaactacggcaggctgcagctcaacaacggcctcgcgctcactccgcagatggggtggaacagctggaatttcttcgcctgcaacattaacgagacggtcatccgcgagacagctgatgcgctggtgtccacgggactggctgcgctgggctacaacttcgtaaatatcgatgattgctggtcatacgtgaaacgaggaaagcaggatcaattgctgcctgatccaaagactttcccttcaggcgtcaaagcacttgcagattatgtgcatggaaaaggtctgaaacttggtatatactctgatgctgggaaatttacttgccaagttcgacctggatcactcggtcatgaaaatgacgatgctgcgatctttgcttcatggggtattgattacctgaagtatgataactgctacaatttgggaataaagcctcagaaaagatatcctcctatgcgagatgctcttaattcaactgggcgccaaatattctactctttgtgtgaatggggccagtatgatccagccttatgggctggcaaagtgggcaatagttggcgtacaactgacgacataacggatacatggaaaagcatgacagacattgctgacaagaacaacaagtgggcatcatatgctggacctggtggttggaatgacccagatatgctggaagtaggcaatggtggcatgagcttagcagagtatcgctcacattttagcatatgggctctcatgaaggcccctctattaattggctgtgatgtcagaaacatgacttctgaaacaatggaaatactgagcaacaaagaagtaattcaagtaaaccaagatcctcttggagttcaaggaagaaaaattttaggacaaggaaaatatggatgccgtgaggtgtgggctggtcccttgtctgggaatcgtcttgttgttgctctgtggaaccgttgttcagatactgctaacgttacaatgaaactgccagcagtaggccttgatgggtatgctgcctattctgttagggatctgtggaagcatgaaactctatcggaaaatgtcgtaggaacttttggcgctcaagttgacgtgcatgacaccaagatgtacatcttttctcctgcaaccattgtcgcttcggtttgatcaggaccggtggatccaagatgacagcaccgctattgttcaaggatatgtcacgacaacaagcgccttcggttttcctgctgcattctgttccacccgactgcagaagtccacttcgtgcagaactgtctcagtgatgtttgtatttctcacggaatagctctatttatctcaagattgagcaagctcgcggcttactcggtgtaccggcgttgtatccttggggcatccaggatcttgtacgatttgaaacagtctgaaccaatgatgtaaaacaagatagtgaaaatacaacttcacaaattgcagccgtaaaaaaaaaaaaaa

SEQ ID NO: 715 - DNA, 1714 bp, Zea mays
  CDS (265)..(1431)
ccacgcgtccgcgcctgcaactgcaacgctaccacctcgactcgcccctgctagcagcatccgggaagctgccctgccactgccaggctgccacaccgaggtgctcccttgactccctctcctctcctcttctcgcgcacgtggtctgtgcccgtacgcggcggcgctgccgctcaccagaccggccgccgccacgtctgcttccgcgcctccccgcctcctcaccgtccgcccccttttacctgcctgatcattttattataaatgtggggcgagagaactcatcataagcactggcatcaaggtcatggtacctcggggaattccaacaacaaaaagcatgataagcggcagccaaaatttataccagacaattatagctccgtcgatgaggttactactgctctgcgagaagctggcctcgaatcgtcaaatctaatcctcggtattgatttcaccaaaagcaatgagtggtcaggcaggcattcctttagaagaaaatctctgcatgccattaatggcaccccaaatccatatgaacaagctatctctataatcgggcgaacgctgtcaccttttgacgatgataacttgataccatgttttggatttggcgatgcttctacacatgatcattctgtgttcagtttctacccagagaaccgaccctgtcgtggctttgaggaggttcttgtaaggtatcgacagattgtaccacatttgaacctttcaggaccaacttcttttgcacctcttatttatgcagcgatttctgttgttgaaaacagtaattggcagtaccatgtcctcgtgatcatagctgatggacaggtgactgccgcgaatataaatgatggaagattaagtccacaggaacaagcaactatacaagcaattgtcgatgctagctactatcctctttcaatagtaatggttggggtgggtgatggaccatgggatgcgatgcagcattttgatgactgtatccctgaaagagcttttgacaattttcagtttgtgaacttcactggtattatgtcaacaagtaaggatatgtcaaagaaggaggctgcatttgcccttgcagctcttatggaaataccttctcagtataaagcaacgcaaggcctccgacctccagaaaagcaagcacaaaggattggctctcctaggattcttcctcctccaaataaagttcttgaaaatgataatgccgccgccgctgcttcgcaccctcctcaaactgcaagctcgaaatcaactggtattggcaaaagtgctgctgacgagcaggtatgccccatatgtctaaccaatccaaaggacatggcttttcagtgtggtcatctgacatgtaaggaatgtggcccaacactatcaacgtgcccattgtgccgcgctctaatcaccatgcgtgtgaggctctactcctaagtcggttggtgtctggagggatgggaccaaacagaaaggagcaagaactttggggcgcaaggactgcgctacgatcttgagatatggtccatatggatgtcatgataacgatgcatgtacagaaaccttgtccgtgcctattcagtaatgtcgttgatgagtatcttccatcaatcacatgtaaaatttctaatgttatcttgtattagtagcaggggattgcttgttgagtggaataccaccagttgttcagcaacaaaaaaaaaaaaaaaaaaaaaag

SEQ ID NO: 716 - DNA, 2191 bp, Zea mays
  CDS (354)..(1397)
acgggcaattggtgcgccgtcttctccgtccgcggcggccatcttggtagcggcccgcatcccctcggccctccaaatcaacgaaccagcgcgtccccgctcctccccacgccacgggaaacttccagcaaaaggtcgcgccatcgataaggggagaaaaggagaagtgtcgccgtccccgtcagcgacggcgctggtaccgacggtccccgcgtcgtgtgccttcctcctccgcgagttcgacgacccgctgtgcgtctgctctcttccgcgcgcccaatcctcgtcgagtcgtcgtgccgctgattgacacagatgtgacagatctactttgttccttgctactttttggcatggtcactccctatttgccatcatcgcacaaccatcgccgaaggctgccaattctattgaaaataggatttttgttaatgatgggagaaaataaattgatgggcaaaagatgggaggacatggacactgatgtccttgtgaagatattcaaggaactaaatttggttgagttgtcaccggtatctcaagtttgtcgtttgtggcgcttggcctgttcagatccacttatttggggcactcttgactttggattgttaaaatccaattttattcagacaagagcatcaccatatatttgggttgatgataggtctgacaggagacttgcaagaatactacgggtggctatggcaattagctgtgggaacgtcaactgcatgatatttcattacaatttgttcatgaaagatgagcaccttcatttcatctcagaaagatctcctcatttaaaacggttggttatgccagcatggaaccgcatcaccaaagtgggaatatgtaatgctatccaaaggtggcaggcgctggagtccttgacaatgcctaccatcggacatcctccatatattatggaagagatagcaaggagctgcaagaatttcacagaacttaagatcatgggctcatttgatcaacaatttgcctcggcgattttgcagttccttccaaagctgaaagtgctgagccttcgttgctcgaaggtgtccatggatgcactgcaatgtttgctgaactcgatggagtatcttgaggttctgaatatttcacactgcctgctgttggttgtggcggcaaatgggcggaagcaagtggttcatgaactggacagccaaattctcgagagagcttcacggctgcgtgaattccactactgccaaagtaggttgtgcgtcgcgtgccagcggatggtggtggatgaaggcatcatgcgctggtacaggtacgaggattggttttggcgtcgggatgaggtgaggtcccttgatctgcaagattatgggaagctgtttgatgttggttgcgagaggttgacgtctgtggattagatgctaataataggggagcaaaacctgccctcctcagtctagaaacttgtttattggcattcataaaacatagcaagtgacgaggggtaacagtagattaataatatcgataacaatgtgcgtgaatggtgtgcgcgtgtttagctactgtaaatccatgaatagttcgtgttgtttggagaagtttgttatagccagtatggtgtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaacaaaaaaataaaaaaacaaaaaaagaaaaaaaaaataaaataaattgacaaaaagtttgcccgcgcttttaatgggaaaaacccttcttgttacccaatttagaacatcttgcctttttttaccgtgttcccacaaaataaaaaatccgggccaaggcccccacccaacgactttgcaaaaacttggggagcctcaaaattaaattgtagcgccccatttacctttttataaagggggaggaatgagaagggtgccccccacaataccccttccccttagacgcggccccaagagccggggaagttgccccccctttctttcctttttaaaacatgtcggggggtttgccactcacgccggtaaccgcgggcttccttaagggccccaaacaccgcttttaggctctttctcccttaaaaccaagaagggggtggttcccccgacgggtataagcgggtttccctcg

SEQ ID NO: 717 - DNA, 1472 bp, Zea mays
  CDS (113)..(1282)
tcatcaccgcaagcgtgcgcgcaacccagctcccaccgacgactgcaccggccgtcgctgccgcgctacttcggccccttttccggcgacgagcaccaccaggtagctgctaatggagattgacagcctcagagaaggatttgatcgagttgctgagaaacgttcattatcttctgctaaagctctggaagttgttgatcaaatagtgaatgaaattgagcaggctattgtgaagctgcagatgatgaatacagattctactggaaatgttgaccacccatccatccttgcagaactgaaagctaagctcaatgaaatggcaccactaaaccagcttgaaggcagccaaaaggagctcaatgttgctctgagcaaatatctcaaactccttgagaagtctttcaatccagatatatctaaggcatacagaaatgtggattttgaggtccatacagtaaacaatatcatagcgaatcatttctaccgccaaggcctctttgatcttggtgacatgtttgtccatgagtgtggggaactaggcggagcttccttgaagctaccgtttcaggagatgtatgctatccttgaagccatgaaagcgagaaacctcgagcctgctctcagttgggctgccaaaaaccatgatcagctgttgcagaatgggtctatgctggagttcaagctttatcagcttcagtttgttgaaatattgtccaaaggcagtaggggtgaggccaaagatgaggctcttttatatgctaggactcacttggtcccctttgcagccgtgcacaaggaagaattccagaagctaatggcttgccttctatgggttggccggctcgatcaatccccatattctgagttaatgtcatccgcgcattgggagaagctagctgaggagctcacccatcaattctgtagccttctgggccagtcgagggagagcccgctgagtgttgcagtgtcagctggttttcaaggactaccaactctgctgaagctgacgcaagtcatggctgcgaagaagcaggagtggcaagttatgaagcagcttcctgtccccatagacatcgggccagaattccagtatcattctgtctttgtgtgcccggtgctcagggagcagtccagtgacgagaatcccccaatgcggatgccttgtggacatgttgtctccaagcagtccatcatgaagctgtcgaaaagcagctcgagggccttcaagtgcccctactgcccctcggaggctatggcgtcgcattgcaagcagctgcatttctagatgtgttaatcttttctggctgcgcaaaactgcaaacctgttggtacatgtttcccctcctgttccatgttgcaccagtccaataactgtctctctgtaatataaacatctacgtccggataaacatgtagtttcgtctgtattactgatatgtacagttgcatctttgatctaaaaaaaaaaaaaa

SEQ ID NO: 718 - DNA, 1070 bp, Zea mays
  CDS (293)..(997)
cccacgcgtccggaacaatccagcgagctcgaaaaaagggtacgaatacgaaccccaatccagggccggaggagggcgagcgaactcaaaagcaagccgttccagtccaatccgcctcagtccaaatctaatcgccgggtttaggcagaaggggcgggacgcggcgaggtttaggcggggtttgttttgtcccttccgtgcgattctgctctccgcgcgggaggcaagtactgacggaagcgaaggcgaaggcggaggagggggtccccggcggtggaagtggaacgcgccgatgcgcaagtttcaggactccatcaaggccctccaggccgacatcgatcacgccaatgcgatggcgtcggaattcctgagggactacgacggctcggtcatccagatgcgggtggcgtacagcgccgtcgcgcatttcctcctgcagtggaccgactgcaagctcgccggcgcgctcggcctcctcaaggttatgctatacaaggtgtgcgcggacggctcgtcggcgcttcctgattgggagatggaggccagcatcagggagttctacggcgtcattttcccgtcgctgctgcagcttccgagtggcatcaccgagctggacgacaggaagcagaggaagctctgcctgaagaaattcaggagcagggatgagcagctctcggaggtggacacggagagggagctcgagtgcgggatctgcctcgaggttagccccaaggtcgtgctgcccgactgtgcccacatgctctgcatgcggtgctttgaggattggaacgcgaaatcgaagtcctgccccttctgtcgcgcctgcctggaagaggtgaagccgggcagcctgtggatatacaccgacggcagcgacgtggtggacatggataccttgactagggagaacatcaggcggctgttcatgtacataaataagctgccacttgtagtcctacatgtagttgaccttgacgtttacaagtaccgcatcaagtaaaatgcaactgatccttccttggtgaaaaaaaaaaaaaaaaaaaaaaaaaaaaaaaaaaaaaaaaaaaaaa

SEQ ID NO: 719 - DNA, 1154 bp, Zea mays
  CDS (104)..(829)
gcggcggtcggccaggttcgggagatcacttcgtcgcggcgaggagggagggggtcgccgttagcgcgcggcacttggatgagaagggcagcggtggaggaggatgcggaaggcgtacagggactccatcaaggtgctcgaagctgacatccagcacgccaacaccctggcctccgagtttccccgggactatgatggtgcgtgcctgcagatgcggctgtcgtacagtcccgcagctcatatattcctcttcctggtgcagtggacggactgcagcctcgcaggggctcttggtctgctgagaatcctcatatacaaggtttatgtggatggcacaacaaccatgtcgactcatgagaggaaagccagcatcaaagaattctatgctgtgatatttccttctttgctgcaactgcaaagggggatcactgatgtcgaggacaagaagcagaaggccgtatgcatggagaagtacagaaagaaagatgaggatggacgggacaccttatctgatattgatgttgagagggaagaggagtgtgggatttgcatggagatgaacagcaaagttgtgttgcccaactgcacccatgctatgtgtatcagatgttaccaggactggagttcaagatcgcagtcctgcccattctgccgtgacaacctgaagaagacctgtcctagtgacctgtggatatatgttgaggaccaagatgtggtcgacatggagacggtgtcgagcgagaacctcagacggctgttcatgtacataagcaagctgcctctgattgtcccagacgtcatcttcagcgtgtatgattcccacatcaaatgatttccgacgcgaccttctcgacgaccttcagccagtgcccagctccagttaatcttatgcccccatgtcctccattttcatgctttgctcaagcttttggaagtgcctgaactgatttggaaccgcaagccttccggtggtgctttagaaagttgtttagtgcctgcatgcatccttaatcatatgcagccactctgtacatatctgacttcgctcagttaataggggactgtgcttgccccaaatggaggcagggccgtttgtgtctttctcatgtttccattagcgaagcaacgcaaagttctgggcattggaaggtttc

SEQ ID NO: 720 - DNA, 1560 bp, Zea mays
  CDS (47)..(1303)
gaaaaattctttgttacgtttttgttgatagcgttgagtgccaaaaatggagcttctccctgttgaagtcgttggcaacattctttcccatcttggtgttgcgcgtgatgttatgattgcctctgcggtatgccgcaagtggcgagatgcatgcaggaggcatctccgtttgctgtccttcaactccaatgactttccacgggacatgactacacgtcagttggagattgtcatcacacagactatatttcagactatggggctgcaacgcctttcgattcacattgataacacccatgagttctctgcagcaccagtgattgcatggctcatgtataccagggagaccctccgaagcctgtcttacaatgtcaggacaatacccaatgtaagcattcttgaaaagtgtggtaggcaaaagctcgaagtgctagatttggaattggaccataacaccatcacaggtgtcgaaccaagctatcagaggttcacttgtctgaaatccctttccctgaggcatgtcagcattttggccttggatttgagccttttagttgctgcttgcccaagaatagagtcattagcacttgatgtccttgaggttgtcacttcagaattacagtctacgatggagctcacaagccatacattgaaaagtctatttgcaaaatcggtaggtgtagataagatcatacttgatgcagataatttggaagttctgcacctgaatgctttaaatctcgatctgtttgagcttaacgggaaaggaacactaaaacattttaagattgatgatgtcagtgttactcatttggatattggggacaatactgatcatttggaggcagtagacgtgagcaacttcacaatagtctggccaaaattctatagcatgatatccagggcatctaatttgcgtatgctacgattttggggtgttgtgtttgatgacgaggatgagatcgtggattcagaaactatagctgtttcatttcctcttcttaggcatctttcattgagttatgaattacgagatgggttacttcactacagccttcagggatcatcattactggagaatgtctcagttctggaacttggttggacagtaataagtgagcactttggaccctgggtgtttggtatgattggaaggtgtccaaatctcaagaaacttgttattcatggtgttctttctgagacaaaaacgcgagaggatcgccagatgttagcaagctttacctcattcatagtctgtgtcatgaggaagtatgtgcatgttgatgtacaatttgagtatgagtgacagctactaggttgggtgggcatcttgtcattgttcagatgaagctgtgccatcaggtaacctcttgcttattgtggcttcaaaatattttattcagcatggtcttattacagattctcagttctctttgtgttactagctttttataaatggtttcttttgggtctaatgtatgtcctgtaagagtgttactttgtatgcaaaacccttggcaccatagttattaaggcggtaaggcgacataatgcgatcgc

SEQ ID NO: 721 - DNA, 1460 bp, Zea mays
  CDS (195)..(1199)
cttcttcagtctcccgtcttcttctggtgccaacacatcctcattctcagggtcgccctctcgattctccctcaagtccagtccagccggatcagtccccttcccctcctccacaaggcgccgcctcccgcagatccgaattggaatctgggccttcgtctccgcaccacaaatccgggaagggaagggaagtgatgggggagtgcgaggacggcaaggagtacaggtgctgggaggagctgctgccggacgcgctggggctcatcttccgcaacctgccgctccaggaggtgctcaccgtcctgccgcgggtgtgcaagtcctgggggcgggtggtcgccggcccctactgctggcaggagatcgacatcgaggagtggagccagcagcagagcaagcccgagcagatcggccgcatggtggagctgctcgtcggccgcagcggcggctcgtgccgccggatcagcgtctccgggctgccctgcgatccgctcttctcgttcatcgcagacaatgcgcgagctcttgggaccttggagatccccaggagtgagatcagcgactccgtagtggaagccgtggcgccgcggctatcgaacgtgacgttcctagacatcagcagctgcacgaagatcggagcccgcgcgctggaggcgttcggcaggcactgcaggtccctggtggggctccggcgggtgatgcacccgatcgacctggcggacaaggtgtgccagcacgacgaggcgcacgccatcgcgcgcagcatgccgaggctgcggcacctggagatggggtacatgctggtggcgacggaggcggtgctggagatcctggggcagtgccgcgagctcaagttcctggacctgcgcggctgctgggccgtggacgaccggttcctgcgggagcgccacccggggctgcgcgtcctgggcccgcgcgtcgtcgacgactgctacgagaacagctactgggaggagtgctccgactactactcggacgaggacgaggactacgacgacgacgtcgtctcgtgggggttgttcgtggacgacgacgacgactactactacgccgtcggcagcgacgacgacgaggctatctgggacgacgcgcagggcctggagaacctcgaggtgaggttctacggcggcggtggcttcggcgagagcttcgccggcttcgactggccgccgtcgccgtgacgtggcccgcgagagccgctgctgcgcttgcgttgcgcggaccgtttgcggctcttgcttatataccgcgtgcgtgcctgagtcgttgtttgttgttcgtcccaagctttgtttgcagatgtgtgctttcaatctttaagctctagcttgcagatatgtgaagtggactgctagtagtagtacactctagctgtaaaactccggtgtttacctgaagcaaaccagcatgcactggtgagatttcaccggcgccaaaaa

SEQ ID NO: 722 - DNA, 1330 bp, Zea mays
  CDS (63)..(1142)
tcgcattccacccgcccccttttcgcgtgaacgcgccggcgccgcggatcctgccgtcacgaatggaggcgtggccggacgatttccgctgccccatcacgctggaggtcatgacggacccggtcatcctcccctccggccacaccttcgagcgccgcagcatccagagctggctcgacggggggcacctcacctgccccgtcaccaacctcccgctgccgccctccccgccgctcatccccaaccacgcgctgcgccgcctcatagccgccgtctcgccttccgcggcggcgtctctcgtccctgcggagggaggggcgcacgcgaggcaagaagcggtgtcggcggcggcggcggcggcggtgccagcccggcccgcgtcgcccgtgccggcgctgctgaggctggccaagtccggcgccgcagggcggaaggaggtgctggagtccggcagcgcggcggtgctgctgcggcacgcggaggccggggacgaggcggcggccagggcgctgctgcacctcagcctggacggcgacgacacgcgcgtgggcctcgtggcggacggcgccgtggacgcgctgtccgccgcggtgtcccgcggcggcgcggcggcggcgtccgcggccacggcgctgaccagcctcgccaccgtggacgtgaacaagtgcaccatcggggcgcacccctcggccatcccggcgctggcggggctcctccgccgcggcgggccgcgggagcgccgcgaggccgccacggcgctctacgagctctgcaagctgccggagaaccggcgccgcgcggtgcgcgagggcgcggcgcccgcgctcgccgacttcgccgccgccggctccgcgcgcgccgtcgaggtgctcggcctccttgcccggtgccgggaggggcggcaggagctgtgcagggtccccggcgtcgtgtccgtgctcacgggcgccgccgggagcggcaacgcgcgcgcaatcgagcaggccctgctcgtcctcaactggatttgctccgagagcaacgagttggcggtggaagcaatcaagctgcaggctttcgacctctgcgaggctctggtgaacgacgacaactgcaagatcgccaagaacgcggtcgacttggcccggacgctcgagaaagcgtagaattggattgggctgtctcccccaaaacatgagatgagattcgccatgggttttgattcaacacctgctcgattggtcgggtgttggcctcattgtacagaggtagcaacagcaaaggtgaaccttttatctttcttctcttactccgtttcatttccaagttgtagctgcgccgaaaggaggac

SEQ ID NO: 723 - DNA, 2067 bp, Glycine max
  CDS (19)..(1878)
agattgttgaatcatcacatggctgtgacaaaagagaaagaggatgttcggaacactgggaagagattgaaatgcatgaggaatgaagaagaagaagtttatgaagaagaagagagtgagcttcctttaaagccaggatttttcttctacccaacaacacccacttcctttgttgtatctgatgctcttgaacccgattttcccatcatatatgtcaacaaggtctttgaaatctccactggatatcgtgctgacgaggccctcggtcgcaattgtcggttcttacagtatagagatcctcgagctcagaggaggcaccctttggtggatcctgttgttgtgtctgagattagaagatgcctcgaggaaggtgttgagttccaaggtgaacttctgaatttcagaaaggatggtactcctttggtgaacagactgagacttgcgccaattcatgacgatgatggaactgtgacacatgtgataggtatccaactcttttctgaggcaaatatagatctgaaccgtgtctcatatccagtcttcaaagagacttgcaatcaagattttgataagactggtaaatataatcctaagagtggacaatcattgtacagtcagcaccaagagatgtgtggcattcttcagctttctgatgaagtcttggctcacaacattttgtcacgcttgacaccgagggatgttgcatccattgggtctgtatgcaggaggatccgtcaattaacaaagaacgagcatgtcaggaagatggtatgtcaaaatgcgtggggcaaagaagtgacgggcacattggaactgatgaccaagaagttaggatggggtcgtctgactcgggaacttaccactctcgaagctgtttgttggagaaaactgacagttggaggtgcagtggagccttcacgctgcaatttcagtgcttgtgctgcaggaaaccgacttgtattgtttggaggtgaaggagtggatatgcaacctatggatgacacttttgttctaaatcttgatgctaaaaatccagaatggcgcagggttagtgtgaaatcatcccctcccggaaggtggggccacacgctctcatgcttaaatggttcttggttggtggtttttggtgggtgtggtaggcagggattgctcaatgatgtgtttgtgcttgatttggatgctcaacagccaacatggagggaggtttgtggtggaacaccaccacttcctagatcatggcatagctcttgcacaattgaagggtccaaattggttgtctccggcgggtgcacagatgctggggtacttcttagtgacacatatttactggacctcacaacagataatccaacatggagagaaattccaacttcatgggctcctccttctcggttggggcactcactctcagtctatgggaggactaagattctaatgtttggaggacttgccaagagtggacacttgcggctacgatcaggcgaggcttatacaattgacttagaagatgaacaaccacaatggaggcaactagaatatagcgcattcacagggttagcgagtcaaagtgctgttgttcctcctcctaggctggatcatgttgctgtcagcatgccttgtgggaggatcattatatttggaggttccattgctggtcttcactcaccatctcagctctttctgttggacccctctgaagaaaaaccatcctggaggatcctcaatgttcctgggcaaccgccgaaatttgcttggggtcatagcacttgtgtggttggagggacaagggtgttggtgttgggtggacacactggggaggaatggatactgaatgagttgcatgagttatgcttggcaagtcgacaggactctgacctgtgaagtgcataaaaccagaccctcttctctcaagacaagattttggttgcaaaaaggttttgggtggctttcctttagcagtttggtttttgtatatgagccactattacatgattgttatatgaaatgacgtgtgtattaccagtgtttttgaatgatatatgatgtcatctggctcctctgtaaaaa

SEQ ID NO: 724 - DNA, 2511 bp, Zea mays
  CDS (70)..(2115)
atcatttatttttgtcaggctagtcgatccaaataattccatactataacgtcttgtagtagttattttatgattgcttgtgccaaccttaaatttgctaacagtgccaaacttgacagagggcctatcgaagcatctcacaaactgtgttcactcaaaattgtctttcccggctccatttccccccgcaccaaaccagccaaaccactggcgcacgccgaggagagagaaagggggtgtgcggggcggcgaccggcctccgacgacgcggggcgtcgcggcgtcgtggcggtgaagcggatgaggctgtgggaggaggaagacgaggaggggatggaagtggacggggaggcggaagatgagccggggtggccgtgtggggcgccggaggcggggctcggcgagacgaggccggcagcgatcctcgtggcggacgcggcggaggtcgacttccccgtcatctacgtcaacgccgccttcgaggccgccacggggtaccgcgcgcacgaggtgctcgggcggaactgccgattcctacaattccgggatccacatgcccaaaggcgacaccccctcgttgatcccatggtcgtttcagagatacggcgatgcctcagcgaggggatcgaattccaaggcgagctgctgaatttccggaaggacggtgctccacttcacaacagattaaggctcgttcctatgcacggcgatgatggctatgtgacgcatgttatcggaatccagctattctctgaggcgaacatcgatctcagcagcgtatcgtatccggtgtacaagcaaaagtccagcagcaggcccagcattcaagatctgaactcatctccccacgagcacgctccgaaaatccagagtgcagaccactgcggcatgcttcagttgtcagacgaagttctcgcacacaacatcctatcccgcctgtccccaagagacgttgcgtccatcggatcggtgtgcaccagaatgcatgagctgaccaagaacgatcacctgaggaagatggtctgccagaacgcgtggggaagggacgtcaccgtgaggctggagatgagcaccaagatggtaggatggggccgtcttgcgagagagctaacaactctcgaggccgcctcatggcggaagttcacggtcggagggcgtgtcgagccttcccggtgcaacttcagtgcctgcgctgttggcaaccggcttgtccttttcggaggggaaggcgtgaacatgcagcctatggacgacacgttcgtgctcaacctggaggccgcaacgccggagtggcggcgcgtcaaggtttctgcctccccgcccggccggtgggggcacactctgtcgtggctgaacgggtcgtggctggtagtgttcggaggctgcgggcagcaaggtctgctcaacgacgtcttcgtcctcgacctcgacgcccagcagccgacgtggagggaggtcgcgagcgagggccctccgctgccgcggtcctggcacagctcatgcaccctggacggctcgaagctcgtggtctcaggtggctgcgccgagtccggcgtcctcctcagcgacaccttcctcctcgacctcaccaaggagaagcctgcgtggagggagatccctacgtcctggtcgcccccgtcccgcctcggccacaccacgtccgtctacggcgcgaccaagctgttcatgttcggtgggctggcgaagagcggctcgctccggctgcgctccagcgacgcctacacggtggacgtcagcgaggacagcccgcagtggaggcagttggccacgacgaccgggttcccaaacgtcagtccgccgccgaggctcgaccacgtcgcggtgagcctgccctgtggacggatcatcatattcgggggctccatcgcggggctccactcccccgcgcagctgttcctgatcgatcccgcggaggagaagccgatctggaggatcctgaacgtgcctgggcagccccccaagttcgcatgggggcacagcacctgcgtggtcggcggtaccagggtcctggttctcggaggccacactggcgaggaatggatactgaacgagctgcatgagctctgcctggcaagcaggcccgacgaggacggctgatgacttcttttcgttgcacttgcacacatatggttcgttcgtctctctctgttttacgtcctatatatgcgcgctatgtcttgtttgtgtatcatctactttcagtctgttgctgcgtcgtgtcggtccgtcggtatgagaaaaaaaaaagcggaaattgattttttaaaaattagtctggatgagtttagtctattttattgtcattggagaagttctctttcatcggtctaggataagattctatggtctatatgtatgtatattttcatgtctcagaaaacacaaaaaaaattattgaaggtccaatgtcttgtactcgtattttttaaaaacaaaaaaaaaaaaaaaaaaaaaaaaaaaaaaaaaaaaaaaaaaaaaaagggcggccgc

SEQ ID NO: 725 - DNA, 608 bp, Zea mays
  CDS (83)..(391)
ggctcgagcgtttaccgccgccgacttctgattctaccaccacccgcctcctctcgagttcgatctgtttgctcccccagacatgtcgggccgcggcaagggaggcaagggcctgggtaagggcggcgcgaaacgccaccgcaaggtgctccgcgacaacatccagggcatcacgaagccggccatccggaggctggctcgcaggggcggcgtgaagcgcatctccgggctcatctacgaggagacccgcggcgtgctcaagatctttctcgagaacgtcatccgcgacgccgtcacctacacggagcacgcccggcgcaagaccgtcacagccatggacgtcgtctacgcgctcaagcgccagggccgcaccctttacggcttcggcggctagggcgctaggctaggccatgctcgacccgccccccactctccgctctggcgtcgtcactggttccttgacccctgtgcgggtcggtcggtggtgctagggtcagcagttgtctggtgtctgtagcctctctggctatccgttctttggtgtgaaatggaattccaatcgtgtgggaatggatctctgttcgattgttcaaaaaaaaaaaaaaagg

SEQ ID NO: 726 - DNA, 775 bp, Zea mays
  CDS (29)..(661)
ctctaggaagcaagggaatcacatcgccatggcagccaagatgtttgcattgtttgcgctcctagctctttgtgcaaccgccactagtgctacccatatcccagggcacttgtcaccactactgatgccattggctaccatgaacccatggatgcagtactgcatgaagcaacagggggttgccaacttgctagcgtggccgaccctgatgctgcagcaactgttggccttaccgcttcagccgtgccagatgccaatgatgatgccaggtatgatgccaccgatgacaatgatgccgatgccgaatatgatgccatcgatgatggtgccgactatgatgtcaccaataacgatagctagtatgatgccaccgatgatgatgccaaacatggtttcaccaatgatgatgccgagtatgatgccttcgacgatgacgccgagtatgatgccaccgataatgatgccaagtatgataccaccgatgatgatgccgagcatggtgtcatcaatgataatgccaaacatgatgacagtgccacaatgttactctgattccatctcgcacattatacaacaacaacaattaccattcatgttcagccccacagccatggcgatctcacccatgtttttacagcagccctttgttggtgctgcattctagatataagcatttgtgttgtacccaataatgaagtcggcatgccatcgcatgcgactcattgtttaggaataaaacaagctaataatgacttttctctcattataaaaaaaa

SEQ ID NO: 727 - DNA, 924 bp, Zea mays
  CDS (1)..(921)
atggagggaaccgctgcggcccggaagaggtcccggccggagacggcgaacggggctgccgccgccgggaagcgctccaaagacacggagtcatttcaaactggtctatcaagcaaatcgaagccttgcaccaagtttttcagtacgattgggtgcccgtttggcgagggatgtcattttctgcactttgtccctggtggttacccggcagttgcaaaaatgctgaatctaagtagctctgctgtatctgcgccatcaagaactcatgtggatcatgccgcccttaccggtgcctctcatccagcttctacggtcaagacacgcatgtgcaccaagtacaacactacagaaggctgcaagttcggtgataagtgccatttcgctcatagcgaaagagagcttgcgaagccagcctacatgtctcaagaaggacctcctatgggtggtcgatatggacgagctgaacctatgcaaccagctgccatgggccctccagcaggaaactttggtgcctcggcgactgccaagatcagtgtggacgcctctctggccggtggcataatcggcaagggtggggtcaacactaagcagataagtagaattacaggcgtcaagctctccatccgcgaccacgagtctaaccccaacctaaagaacatcgagctggaaggcaattttgaccagatcaagcaagccagcgacttggtgcgtgatctcatcgcaaccatcagcgcaagcatgccagcgaaaaatccatctgctgccgcggcaccagcaggaggaggccgaggcggtggtccagggggcaagagcagcaactacaagacgaagctgtgcgagaacttcttgaagggtgcctgtacttttggtgaccggtgccacttcgcccatggcgagacggagcagcggagaggtgctgcatga

SEQ ID NO: 728 - DNA, 2031 bp, Zea mays
  CDS (1)..(2028)
atgaggccggaggagagagatgctgccgtggggagagtcagggaccagttccccgtcggcatgagggtcctcgccgtggacgacgaccccgtgtgcctcaaggtgcttgagaacctcctgcgccgctgccagtatcatgtgacaacgacgaatcaggctgttgtcgccttgagtatgctgaggcaaaacagggacctgtttgatcttgttattagtgatgttcacatgccagacatggatggctttaagcttctagagcttgtggggcttgaaatggacctccctgtcattatgttatcggtgaatggagagacaaaaactgtaatgaaggggataactcatggtgcctgtgactatctcttaaaaccggttcggctggaagagcttaggaatatctggcagcatgttgttaggaggaaattcagtaactgtgatcgtgctaacaatgatggctatgaggagtgcaataggccatcaaatgcagattttgatcttgctcacagccaaattacagctgggccacctgaccaaagtgggaggcccagcaaaaagaggaaggaatatcatagtgaagaggaagatgaaggagaagagagtaatggccaagataacgatgatccttcagctccaaagaaaccaagggttgtttggtcagttgaactgcaccgaaaatttgttgctgctgtcaatcagctaggaattgacaaagctgtgccaaaaaggatacttgagctcatgaatgttgagagactcaccagggaaaatgttgcaagtcacctgcagaagtatagactctaccttaaacggctaagtgctgtggcatcacaacaggctagcattgttgctgctttgggaggcaacgacccctttatgcggatgagtgcatttgaaggactccatggttatcaatcttttgtctcttcagcagctctgccatctttcagtccacagggactgttaaatagaaataatccagcatcatttgcgattcaaggggtgtctgcttccaggccaattcagattgcaaccggcaataccacaatgagtcattccattggcgatccaaataataaatatcaccttagcttaccaggcactagtagcctacaaggaaatctagcacaaggtttgccaactccagttgggcaggtccagctgccacagaagtggatacacgaagaaaccgacgatctatctactatcctttctgcgagtggccaggctaataatggtgttcctggcacactccaaagtgtcacgaacagtcacttgctgcagcaaggctttgttgaacgtagacaagacaaagttgttatccagccatcttcatctgcaagttcagatcgtcctgaaggcactgttggagtttcctccagtctgatggattcctgtgcatcccatcagagggttgttccattgtctgccttctctagcagtgcagcgccaatgaatggctcgttttgcagcaacggtgtagctgagttgggtgctgcatcctctggaggtacaagtattttcccctccaatgacctgaggatagaaagagacagcaaagtgggagctagctctttcggtagtgtgatacttctgtctccagacactgtgccaaaccaaaaatacttgaacttcggcggtggaagcgatttgagaccgaacatggagggagggaacgcaggcaatctgttgaatcccaagctactatggagttgtttgccggcctctcagccgcctaatcttatcggaagtcatcatcccatgagccaaagactgaaccttggcggctcaatggtcagacagacaacagcaagtgcttcggcagctgccccacagacgaggatcgacatgtttatctccggagacgctccgaagagcgcgtcggatttgagcttccctaaggtccacagcgagcttagctctagcagctgcagcttcgacggcctcctcaactccataatcaaagtggagaaggacgatgcttccttcagcgatgacctgggatgcgacttgtactccctgggtgcctgtatatga

SEQ ID NO: 729 - DNA, 2050 bp, Zea mays
  CDS (364)..(1782)
ccacgcgtccgacatgagttcccgttttgctcccgagttctctctcacgtccatccctctctctcgtctcgttctttagcagggccggctggagcgcccactcctccctccagcccggccccagccgcgccgccgcgccggtcgtagacccaacgcccgccgcccagcccagcgcgccctccggccgtgaggcggagaggatcgggcgggcctcggggcgagcgccacgcgtagacggcggttgaggagcctgagaaaacaacggtcctccttcaagatcctgatccctacgcgcaggcgtaggagattgtattccgtctgattaatcggcggagagcaagcgggtgttgcggctgcgcgagcatggcgggcgaggaggctgcggagggcagcggaaccaggaggcacatggatctaaacctgtatctcggcctccctccattgccgcggcctccagtctggctggacccgacgttgatgcccaacttgaccggtgctgcgccagaatcctcaataactggtgagcctgaggaatcgttggccctgggggcggcagcctattctccgtcgaatgcactttccaccccggaggagcacccaatgcttgatcccatagtttattcctggctcgacggcaacaggaccgatggtgaagaggacactgatgctcctgagccggggccagtggatggtgccaatgtctctaggtcgcagcttgtggtagctgccacaggattggaaggggatgatgatcttcctctagtaaggtttgtgcgccctagccagatggttgttgctggtggaatggagacggtgaacacaagtatacttcagcagtccattcaaagggctgctgcaattgaggccaggactcctgaactccgctttcagagggtgatacagattagccagcagcatagaattgtgaggccagcatcagtgaaccgcagtcaaggggcagctagtacagatgcggataggcttgtctgggcaatccagcgcactcataactctttagaagcaacaaggcggcaaaaactagatgacaacaacttgtgtggaaacggttctgctaagaaggatgagtcctgtgactgcaactccagctttgagtgcaatatctgtcttgacccagctaaacagcctgtggttacaccctgcggtcacctcttctgttggccatgcttgtaccagtggcttcatgcacattcaccccactctgagtgccctgtatgcaagggtgaggtgctagaactgaatgtcactccgatatatggaagaggcggtgaagaagggaattccaccaaccctgacttcccacctaggccacgagcaaacagaagggagagcctgaggcaacagctgcaaatgacagacacaagaggaattgcaacagtggtgaggcagttgatacaaaaccagggtataattagcgttctcccaagcccaacagggatcgagatgtcggtggttcctgcaggccggcaaagggctagggctcggagacagcaaaggcaggataataatgcatcatcttccatacacgttgtagcgcagaatatgggcaatgttgcccctgagagcagcaaccaaatccagttgtcacattctaacggtgacaatgctgcacagatggttcttgcagctcctcagcagtcatcatctgtcgaacagctgtcaacttctagcaccacagctgttatattgggcgagcctgggtcaagtaggcggtcaaggccttcggagtctccaaccataagaagaacgaggaggaggccacagtaggtactcgagtgttgtcactcccttcagtaaaatctacagaccatgccccagtgatagttattaccatgattatctccaataacatctcaaggttaataatgtagaaatgtatatgccatcactggtttctgcctttctcttacattccatgtatcatctattatgcaaaacgagtcgaaatatcagttccagtatctatgataatcttgacctttgtatactgggaatataaaaaaaaaaaaaaaaaaaaaaaaaaaaaaaaaag

SEQ ID NO: 730 - DNA, 2000 bp, Oryza sativa
  CDS (23)..(1936)
aactcagtgcagtagtagtagcatgcaaaggatttgccctgctcactgctcggtcactcactcactcaccatgaagtccatgaggctttcctacatccctcctgctgcttctgctgctccacagagccccagctatggcaggaagaagaacgcctccgccgctccgccatcggctgccgcctccaccaccgttctcacctccccgctggtgaccaccacccgcactccgaagcagaccgagcaagaggacgagcagttggtagccaagaccaagactacgagaactgttattgctacgacgaatggcagggcggcgccgagccagtctcggcctcgccgccggcctgcccccgccgccgcggcgtcggccgcttcgctgccgatgacgttctgcaacgcgctggaggaggtgatcaacacgttcatcgacccgccggcgcttcggccggcggtggacccgcggaacgtgctgaccagcaacttcgtgcccgtggacgagctgccgccgacgccctgccccgtcgtgcgcggcgccatcccgcgctgcctcgccggcggcgcctacatccgcaacgggcccaacccgcagcacctcccgcgcgggccgcaccacctgttcgacggcgacggcatgctgcactccctcctcctcccgtcgcccgcgtcgtccggcgacgaccccgtcctgtgctcgcgctacgtgcagacgtacaagtacctcgtggagcgcgacgccggcgcgcccgtcctgcccaacgtcttctccggcttccacggcgtggccgggatggcgcgcggcgccgtcgtggcggccagggtcctgaccgggcagatgaatccgttggagggcgtcgggctcgccaacaccagcctcgcctacttcgccggccgcctctacgcgctcggcgagtccgacctcccctacgccgtgcgcgtccacccggacaccggcgaggtgaccacgcacggcaggtgcgacttcggcggccgcctcgtcatgggcatgaccgcgcaccccaagaaggaccccgtcaccggcgagctcttcgcgttccgctacggccccgtgccgccgttcgtgacgtacttccggttcgacccggccggcaacaagggcgccgacgtgcccatcttctccgtgcagcagccgtcgttcctgcacgacttcgccatcaccgagcggtacgccatcttcccggagatccagatcgtgatgaagcccatggacatggtggtgggcggcggctcgcccgtggggtcggaccccggcaaggtgccccgcctcggcgtgatcccgcgctacgccaccgacgagtcggagatgcggtggttcgaggtgccgggcttcaacatcatgcactcggtgaacgcgtgggaggaggccggcggcgaggagctggtgctggtggcgcccaacgtcctctccatcgagcacgccctggagcacatggagctagtgcactcctgcgtcgagaaggtgcgcatcaacctccgcaccggcgtcgtcacgcgcaccccgctcgccgccgggaacttcgacttccccgtgatcaacccggctttcctcggccgccgcaacaggtacggctacttcggcgtcggcgaccccgcgcccaagatcggcggcgtggccaagctcgacttcgaccgcgccggcgagggcgactgcaccgtggcgcagcgcgacttcgggcccgggtgcttcgccggcgaaccgttcttcgtggccgacgacgtcgagggcaacggcaacgaggatgacgggtacttggtgtgctacgtccacgacgaggccaccggcgagaaccggttcgtggtgatggacgcgcggtcgccggacctggagatcgtcgcggaggtgcagctgcccggacgcgtcccctacggcttccatggcctgttcgtcacgcaggccgagctccagtcacagcaccaatgatacaaaccaacgtagcaatgtatagaattcacgtatacattttccatacgaaattacgagt

SEQ ID NO: 731 - DNA, 2100 bp, Oryza sativa
  CDS (220)..(1947)
tcgcagtttacaggcggaatctgtaatttgttttgttattagtctacgtttaatacttcaagtgtgtgtccgtatatctgatgtgacacgctaaaattttacatctctgaatctaaacacagccttactctggcgatctatatatagttgcatacattgtaatattattgctgaattcatattcccatctgagccaaccatgcattggtgttttgcataatggaggtacccattgctgccatgacttttgcccacccagccaatgttatgactctggcttcaaggcagccaaagagtaaaaggtcccatatctcccctgctaccacggctcaccgtaatctacagactcgcctggctcaccaccaccatgcaacaccagcttcattgcctatggcaatctgcaacacagtagacaaagtgatcaataggttcattgacctgccggagcagcgaccaacggtggatccgcggcgtgtgctctctggcaacttcgctcctgttgatgagctgcccccgacaagctgccatgtcatccgcggctccatcccaagctgcctcgccggtggggtctacatccgcaatggtcccaacccacagcaccggcttccccagcgaacacaccacctcttcgatggtgatggcatgctccactcccttctcattccctcggcctcgtcaacactgttgtcggagcctgtgctttgttcacgctatgtgcacacgtacaagtatctcttggagcgtgagaccggaggaccggttttaccaaacttcttcgctggcttccatggagtggccggcttggctcgtgcagtggtcatgatcgcaagagtgcttgctggtcaaattaacctgaacaagggcttcgggctggccaacactagcatcactctttttgcagattgcctatatgcgctatgcgaatctgaccttccctactccatgcacatcaacccagccaacggagaagtcaccacacttggtcgatgtgactttggtggtgatctttcttttaggatgacagcacaccccaagaaggacccggtcaccatggagttgtttgcttttcgctacaatgtcttccaaccattcataacatacttctggttcgatcgagcaggcagcaaggtcgcagatgtgcccatcttgtccttgcagaaaccatcggtgatgcatgactttgcaataacagagagatatgcaatctttccagagtcacaactcatcgttaatcccatggacatggtcatgcgggggagctcgttggtaggattggaccgtaccatggtgccacggattggcgtgcttccaaggtacgccaaggatgagtcagacatgagatggtttgaggtgcctagatttaatatgttgcacacgacgaatggttgggaagaggctgatggagaggagattgtgctcgtggcacccaatatcctatctatcgaacacatgctaggaaacatggagctcatgcgagctcgtgtcgacatggtacgtatcaacctctgcaccggtgacgtgtcgtgcactgcactctcaccggagagccttgagttcggtgtcatccaccaaggttatgttggtcgcaaaaatcgctatggctactttggtgtaagtggtccgttgcccaagatcaaggggataagaaagcttgactttgatctcgtcggctctggtgattgcacggttggacgtcgtgactttggtctagggtgctttgctggggaaccattttttgttccagacaacatcgacgggtatggaaacgaggatagtggttatgtggtgtgctacacccatgaagaggacaccggagagagttggtttgtggtgatggatgcaaagtctccagagctagacattgttgcagaagtgcaacttcctagtcgtatcccctatggctttcatggtatttttgtcaaacaggccgaacttctcgcacaacaataagcatgtttgtgaaaaaccttacccactactctacgtataaagataatacttcataacttcataagcgagatctgctacaaatgtactttccagcatttgatttagaatggtcataagagaagtattatagtctggttgtcatttcacatc

SEQ ID NO: 732 - DNA, 401 bp, Synechocystis PCC6803
  CDS (54)..(221)
accgcaaacggactcagcagtggtctgtaaactatatttatgaggaacaaacaatggcaaaacgtcgtaatttaaagaaggaaaaagctgaacgtaatcgtgcttatgcccgtcagtttcgctccgccagtcgcacccaaaaccgccgctattccggtggccaaagacaacaaggtgactccaatggctccagcaataacggtgccgccagcgacgtttaatctatttttagcgctcctaagggtggctaaaactttgcataaaaaacggcgatcggtgggtttcggcccgccgtttgttgtctggggtttttggagactggggctagtagtaaattttccttgccatggttgagttagaccggagtcgggtaatccattggctccaagaaaatgtttccc

SEQ ID NO: 733 - DNA, 501 bp, Synechocystis PCC6803
  CDS (242)..(457)
atctcaaaatctgtactgaaagccctgtctgagaacggcgatcgcttctgtcggctactaattccgcttgtgggccccatgaaaaagcaataggagaaatttacgtctgctggatttaggctcccagagggaaaacattatctgccaacgccgggaaaaacgttaaaatcacaaattgtaactgttgttacttaaaggtaaccaccgttgtgttttttgcaatctaagggaattgaaaataatgtttaaacccagcttacttttgtctttgcttgttgtgggctgtttgctaacggttaccggttgcggtggtggcaatcagagggaggaaggtcaacccactcaacagaacatcgaacagcaagaaaataacaacgggaatgccaataccaatgatgatgataatgacaataacgacgacgatgaggaagatgacaacaaagatggagatgattaaggcggtttgattccaactaccccagtgaagattcttttcattag

SEQ ID NO: 734 - DNA, 729 bp, Arabidopsis thaliana
  CDS (1)..(726)
atgggaagaggtagggttcagctgaagaggatagagaacaagatcaataggcaagttactttctcaaagagaaggtctggtttgctcaagaaagctcatgagatctctgttctctgcgatgctgaggttgctctcatcgtcttctcttccaaaggcaaactcttcgaatattccaccgactcttgcatggagaggatacttgaacgctatgatcgctatttatattcagacaaacaacttgttggccgagacgtttcacaaagtgaaaattgggttctagaacatgctaagctcaaggcaagagttgaggtacttgagaagaacaaaaggaattttatgggggaagatcttgattcgttgagcttgaaggagctccaaagcttggagcatcagctcgatgcagctatcaagagcattaggtcaagaaagaaccaagctatgttcgaatccatatctgcgctccagaagaaggataaagccttgcaagatcacaacaattcgcttctcaaaaagattaaggagagggagaagaaaacgggtcagcaagaaggacaattagtccaatgctccaactcttcttcagttcttctgcctcaatactgcgtaacctcctccagagatggctttgtggagagagttgggggagagaacggtggtgcatcgtcgttgacggaaccaaactctctgcttccggcttggatgttacgtcctaccactacgaacgagtag

SEQ ID NO: 735 - DNA, 756 bp, Zea mays
  CDS (1)..(753)
atggggcgggggccggtgcagctgcgccggatcgagaacaagatcaaccgccaggtgaccttctccaagcgccggaacgggctgctgaagaaggcccacgagatctccgtgctctgcgacgcagaggtcgcgctcatcgtcttctccactaaggggaagctctacgagtactctagccattccagcatggaaggcattcttgagcgttaccagcgttactcatttgaagaaagggcagtacttaacccaagtattgaagaccaggcaaattggggagatgaatatgtccggttaaaatccaaacttgatgcacttcagaagagtcaaaggcagctgttaggagaacaattgagttcactgaccataaaagaactccagcaactggagcaacaactggacagttctttgaagcatattaggtcaagaaagaatcagctcatgttcgattcaatttccgcgcttcagaaaaaggagaaagcacttacagatcaaaacggtgtcctgcaaaagttcatggaggcagagaaggagaaaaacaaggctttgatgaacgcgcagctccgggagcagcaaaatggagcatcaacaagctccccatcactttcaccaccaatagttccagattccatgccaactctaaatatagggccatgtcaacatagaggggcagcagaatctgagtctgaaccgtctcctgctcctgcacaagcaaacaggggcaacctgccaccatggatgctccgcactgtcaagtaa

SEQ ID NO: 736 - DNA, 1404 bp, Glycine max
  CDS (346)..(1077)
gtgagactcacggtcatgactcatgtaaattcgtctcccacaacaacactagctctcacgtacataaatataaagatgttgatagcatattataaatcatagagttcattccatacacagaaagaagaacaacactaagaaagcagaatagggaaaaatacatcgatagaggaaaattaattgaagggtgctactactacgaccttctatatcattaatgattgaaattcgtgttggaattgtcttgtaggtgtagtagtgataataagagaggatcatatatatattagtagtgctagaaattaattgaagtgtgtaatagaatagagtgtgatagagagagatatggggagaggaagggtgcagttgaagaggatcgagaacaagatcaataggcaagtgacgttttcaaagagaaggtctggtttgctcaagaaagcacatgagatctctgtgctttgtgatgctgaagtggccctcatagtcttctccaccaaaggcaaactctttgagtactccagcgatccatgtatggaaagaattcttgaacggtatgagaggtattcatatgcagagaggcagcttgttgcaagtgatcaaccacaaactgaaaattggactctagaacatgcaaagctcaaagcaaggttggaagtcctacagaaaaatcaaaggaattttatgggacaagatttggagggcctaagtatcaaagagcttcaaaatttggaacatcaacttgatagtgctctaaaacacattagatcacggaagaaccaaatcatgcatgaatctatttcagagcttcataaaaaggataaggtcctacaggaacaaaataacactctcgcaaagaagataaaggagaaagagaaggcactagcccagcatgcacaaatggagcagcgtggtgatgaaatggatcttacttcctctgccctagtacctcatccattggagacatcaaacattagagagtcctcacaaataaggggtgaaggagataatgaaggaaccccaactccaacccgagcaaatgccattcttccatcttggatgcttcgtccttcaaatgaatagaagagtattaacgacctaaaattttaaattacatatgaatatggcgaatacaaagcttaccctataagatgtaaaatggtctatgtgttgaattgtgaacaccacccaatgagttcaattggaatatcatagatatgtaatgtgtctctgactactacatttcaaggatgctaagtaaattatatggtatggcctgtctagatatagacctgcaatacatatatagtgtcaattatgtatgcttggttcttatcaaaagtttaagttggactttacatgcctctcttcctagaaattcggaaggtaaacataatttcagtacac

SEQ ID NO: 737 - DNA, 1054 bp, Glycine max
  CDS (147)..(863)
gaaaaaagccttgactaatagtccataccataattttcctctttcctctgtgcctcgcttcttcttgaatccatgcgcatgagtttgaagaattgtgttagcggtgaggtgagatatttcaatatttgataattgatagtatatatatggggaggggaagagtggatttgaagaggatcgagaacaagatcaataggcaagtgactttctccaagagaaggtctggcttgcttaagaaagcgcgcgagatttctgtgctgtgcgatgctgatgtggctctcatcgtcttctccactaaaggcaagcttttcgactactccaacgaaccttgtatgaaaagaattcttgaacggtatgagaggtattcgtatgcggagagacaacttgctggagatgatcaagcaccaaatgaaaactgggttatagaacacgaaaagctcaaggctagggtggaggtactacagcgaaatcaaaggaattttatgggagaagatctggacagcttaaatcttagaggacttcagagtttggaacaacaacttgattctgctctcaaactcattagatcacgaaagaaccaagccatgaatgaatctatttctgcgcttcagaaaaaggataagtcactccgggaacacaacaacttgctctccaagaagataaaggataaagagaaggagctggccccacaagagcaagatggactgcaaaataacatggatgtgacctctgtccttgtaactcaaccaccggagtccctgacaattggaggcttcccagaagccaaatgtaatgaagaaactccaacgtcgagtcgacctaaaaccattcttcccccttggatgcctcttcctacaaatgaatagaaagcctgttaactcttgttaaatacgaataccacttgtacaaagactagctatatacatcatcaggggcatttgatggtgactataccacctggattgtaatctctgtgtgacgtttctgactgcattttaatgcagctgcaaggtatattaaatgtactacatataaatataaatgatactgatat

SEQ ID NO: 738 - DNA, 738 bp, Zea mays
  CDS (1)..(735)
atggggcgcggtaaggtgcagctgaagcggatcgagaacaagatcaaccgccaggtgaccttctccaagcgccgctcggggctgctcaagaaggcgcacgagatctccgtgctctgcgacgccgaggtcgcgctcatcatcttctccaccaaagggaagctctacgagtattccaccgattcatgtatggacaaaattcttgaccggtacgagcgctactcctatgcagaaaaggttcttatttcagtagaatctgaaactcagggcaattggtgccacgagtatagaaaactaaaggcgaaggtcgagacaatacaaaaatgtcaaaagcacctcatgggagaggatcttgaaacgttgaatctcaaagagcttcagcaactagagcagcagctggagagttcactgaaacatatcagaaccaggaagagccagcttatgctcgagtcaatttcggagctccaacggaaggagaagtcgctgcaggaggagaacaaggttctgcagaaggagctcgcggagaagcagaaagcccagcggaagcaagtgcaatggggccaaacccaacagcagaccagttcgtcttcctcgtgcttcatgataagggaagctgccccaacaacaaatatcagcatttttcctgtggcagcaggcgggaggttggtggaaggtgcagcagcgcagccacaggctcgcgttggactaccaccatggatgcttagccacctgagcagctag

SEQ ID NO: 739 - DNA, 801 bp, Zea mays
  CDS (1)..(798)
atggggcgcggcaaggtacagctgaagcggatagagaacaagataaaccggcaggtgaccttctccaagcgccggaacggcctgctcaagaaggcgcacgagatctccgtcctctgcgacgccgaggtcgccgtcatcgtcttctcccccaagggcaagctctacgagtacgccaccgactcccgcatggacaaaattcttgaacgctacgagcgatattcctatgctgaaaaggctcttatttcagctgaatctgaaagtgagggaaattggtgccacgaatacaggaaactgaaggccaaaattgagaccatacaaaaatgccacaagcacctgatgggagaggatctagagtctttgaatcccaaagagctccagcaactagagcagcagctggagagctcactgaagcacatcagatcaaggaagagccaccttatggccgagtctatttctgagctacagaagaaggagaggtcactgcaggaggagaacaaggctctgcagaaggaacttgcggagaggcagaaggccgtcgcgagccggcagcagcaggtgcagcgggaccagcagacacatgcccaggcccagacaagctcatcatcgtcctccttcatgatgaggcaggatcagcagggattgccgcctccacacaacatctgcttcccgccgttgacaatgggagatagaggtgaagagctggctgcggcggcgcagcagcagccactgccggggcaggcgcaaccgcagctccgcatcgcaggtctgccaccatggatgccgagccacctcaatgcatag

SEQ ID NO: 740 - DNA, 801 bp, Zea mays
  CDS (1)..(798)
atggggcgcggcaaggtgcagctgaagcggatagagaacaagataaaccggcaggtgaccttctccaagcgccggaacggcctgctcaagaaggcgcacgagatctccgtcctctgcgacgccgaggtcgccgtcatcgtcttctcccccaagggcaagctctacgagtacgccaccgactcccgcatggacaaaattcttgaacgctacgagcgatattcctatgctgaaaaggctcttatttcagctgaatctgaaagtgagggaaattggtgccacgaatacaggaaactgaaggccaaaattgagaccatacaaaaatgccacaagcacctgatgggagaggatctagagtctttgaatcccaaagagctccagcaactagagcagcagctggagagctcactgaagcacatcagatcaaggaagagccaccttatggccgagtctatttctgagctacagaagaaggagaggtcactgcaggaggagaacaaggctctgcagaaggaacttgcggagaggcagaaggccgtcgcgagccggcagcagcaggtgcagtgggaccagcagacacatgcccaggcccagacaagctcatcatcgtcctccttcatgatgaggcaggatcagcagggattgccgcctccacacaacatctgcttcccgccgttgacaatgggagatagaggtgaagagctggctgcggcggcgcagcagcagccactgccggggcaggcgcaaccgcagctccgcatcgcaggtctgccaccatggatgctgagccacctcaacgcatag

SEQ ID NO: 741 - DNA, 1929 bp, Oryza sativa
  CDS (1)..(1926)
atggccagcggcggcggcagcagcaactggttaggcttctcgctctccccgcacatgccggccatggaggtgccgtcctcctctgagccatcgactgctgctcatcatcatcatcatcatcatccacctgctgctgctgctgctgccggagccatgtcgtctcctcccgacagcgccacgacctgcaacttcctcttctcccctcctgcagcacagatggtcgctccttcacctggctactactacgtcggcggcgcctacggagacgggaccagcaccgccggcgtctactactcgcacctccctgtcatgcctatcaagtccgatggctccctctgcatcatggaaggcatgatgccgtcgtcatcgccaaagctcgaggacttcttggggtgtggcaatggcagtggccatgacccggccacctactatagccagggccaagaagcagaggatgcaagcagggcggcctaccagcaccaccagctagtcccctacaactaccagccattgacggaagcagagatgctgcaagaggccgcagcggcgccaatggaggacgcaatggcggcggccaagaacttcctcgtcaccagctacggcgcctgctacggcaaccaggagatgccgcagccgctcagcctctccatgagcccagggtcccagtccagcagctgcgtcagtgcagctccccagcagcatcagcagatggcggtggtcgctgcagctgctgctgctggtgatggccagggaagcaacagtaatgacggtggcgagcagcgtgtcgggaagaagaggggcaccgggaaagggggccaaaagcagcctgttcaccggaagtccattgacacgtttgggcagaggacatcgcagtataggggcgtcaccaggcacaggtggactggaagatatgaagcccacctctgggataacagttgcaaaaaggatggacagacaaggaagggaaggcaagtatatctaggtggttatgacactgaagataaagctgcgagggcttatgatctggctgcgctgaaatactgggggctatctacgcatataaatttcccgttagaaaactaccgagatgagatcgaggagatggaaaggatgacaaggcaagaatatgttgcgcacttgagaaggagaagcagcgggttctctcgcggtgcttccatctaccggggagtaacaaggcatcaccagcatggaagatggcaagctcggattggcagggttgctggcaacaaggacttgtatctcggcactttcagcactcaagaagaagcagcagaggcatacgacattgctgccatcaagttccgtggcctgaacgcggtgacgaactttgacatcacaaggtacgacgtggacaagatcatggagagcagctcgctgctgcctggtgaggcagcgcgtaaggtgaaggcgatcgaggcagcgccggaccatgtgccaataggccgcgagctcggtgcgaccgaggaagcgagcgctgctactgtcacgggcaccgactggagaatggtgctccatggatcacagcagcagcaagctgcagcgtgcaccgaagcaacggcagatcttcagaagggcttcatgggtgacgcgcactcggctctccacggcattgtcgggttcgacgtcgagtcggcggcagctgacgagatcgatgtcccgggagggaagatcagtggcatcaacttctcgaactcgtcttcgctggtgactagcctgagcaactcgagggaggggagccctgagaggcttggcctcgccatgctctacgccaagcatcatcccaccgccgtcagcctcgccgccatgaacccctggatgccgatgccggcgccggccgcagctcacgtgatgaggccgccgagtgccattgctcatctccctgtttttgcagcctggacagatgcttaa

SEQ ID NO: 742 - DNA, 1508 bp, Zea mays
  CDS (202)..(1200)
gcccgccgaaaccctagcccgccccgcctcgccgacggcgatgggcgctgcatgatcggtgcgtccccttggaaccgcctgccttctggcatcgccaagcccgctgccgcggctgccgtcgtcgtagcggcgctcgcgtcctccttcctcgccctcccgcgtcctcgcgccgccccgcccccagcgggatccgggcccctcatgtcgaaggcaaaggtctacaccgacgtcaacgttctgcgtcccaaggagtactgggactacgaggcgctcaccgtccaatggggtgagcaggatgactatgaagttgtcagaaaagttggaagaggtaaatatagtgaggtctttgaaggcatcaatgttaacaattatgagaaatgcatcattaagatccttaagcctgtcaagaaaaagaagatcaaaagggagatcaaaatacttcagaatctctgtggaggtccaaacattgtgaagttgcttgatattgtcagagatcagcattcaaagactcccagtttgatatttgaattcgtcaacaacacagacttcaaagtcttgtaccccacattgacggattatgacatccgctactacatatatgagctactcaaggctctagattactgccattctcaaggcatcatgcatcgagatgtcaagccccataatgtcatgatagatcacgagcttcgcaaacttcggttgatagactggggcttagctgagttttaccatccaggcaaggaatataatgtccgcgttgcatcgaggtatttcaagggacctgaactccttgttgatttacaagactatgattattctttggacatgtggagtcttggttgcatgtttgctggaatgatatttcgcaaggaaccattcttttatggccatgacaaccatgaccaacttgtgaagattgcaaaggtccttggaacagatgggttgaatgcttatttgaacaagtatcacattgagctggaccctcaacttgaagctcttgttggaaggcatagtagaaaaccctggtcaaagttcatgaatgctgataaccaacatctagtatcacctgaggccatagattttctcgataagctcctgcgctatgatcaccaagataggctcactgcacgtgaagctatggcacatccctacttcctccaagtcagagctgtggagaacagtagaacgagaccacaataatcgttgtctacaccctcgaaatgaagttgttgctaatttctggaacatcataggctaaaaccgttcaataagcatctcgctccaggaatctgggccatgactccgtggcagtgaatcagatagtatgggtcgcatcatgtgggcaaccttggcagatgtttttattgttgtctttaatcttgggactactgtagctttaaacctacaggctgtgcttgaatgacatgatattcatatcatatcgtctcctgtggtgggatatgaaattgtatgttatctttaaacataaacatactggttgtatt

SEQ ID NO: 743 - DNA, 1201 bp, Saccharomyces cerevisiae
  CDS (2)..(1120)
tatgaaatgcagggtatggtcagaggctcgtgtttatacgaatatcaataaacaaagaaccgaggaatattgggattatgaaaatactgtaattgattggtccacaaatacaaaggactatgaaattgaaaataaagttgggcgaggaaaatactccgaggttttccaaggtgtcaaattagactctaaagttaaaattgttattaagatgttgaaaccagttaaaaagaagaagatcaagagagaaatcaaaatcttaacggatttgtctaacgaaaaagtgcctccaacgactttgccatttcaaaaagatcaatattacacaaatcaaaaggaggacgttttaaaattcatcaggccctatatctttgatcagccacacaatggtcatgcaaacataattcatctatttgatataataaaggatcccatctcaaaaactccggctttggtcttcgaatacgtagataatgtggacttccgtattctttaccctaaattaaccgatctcgaaattaggttttatatgtttgagttattaaaggccttagactattgtcattcaatgggaataatgcatagagatgttaaacctcataacgtaatgattgatcataagaataaaaaattgcgattgatagattgggggcttgctgaattttatcatgttaatatggaatacaatgttcgtgttgcgtcgaggttttttaagggtcctgaactactagttgactacagaatgtatgattattctttagacttgtggtcgtttgggacaatgttggcttctatgatctttaaaagagagccatttttccatggaacgagtaacacagaccagcttgtcaagatcgtcaaagtacttggtacaagcgattttgagaaatacctgttgaagtatgaaattaccttaccgagagaattttacgatatggaccaatacatcagaaagccttggcatagattcatcaatgatggtaataaacatttaagcggcaacgatgaaattattgaccttattgacaatcttttgagatatgatcatcaagaaagattaactgctaaggaagcgatgggacacccgtggtttgccccaataagggaacaaattgaaaaataagaaataaataatgaatgaaataaaaaaaaaaaaatcactgacaaacgatataacgattacttttttttaccatctgtacaa

SEQ ID NO: 744 - DNA, 4201 bp, Oryza sativa
  CDS (29)..(363), (471)..(600), (1034)..(1228), (2564)..(2721), (3082)..(3172), (3250)..(3315), (3657)..(3739), (3821)..(3884), (3967)..(4035), (4124)..(4159)
cccatccctcgcgccggaagagaggtacatggcctggtgcgccgcgcgcagccgcctcctccccctcgccaccgcgccgcagctgctccgccgcctcctcctctcctccgctgcggccccgcgctacgcgcacccccaccaccaccacagcaacagccgccgccgccgccgccccctcgcccccaccgtctacgccgctgccgcggcagccgcagccgaggcgccgctccccatgccgccgcgcatcggccgcgccacgcggcaccccgggggcgccgcctccgtggcgcgcgtctacgccgacgccaactcccagcggcccaaggagtactgggactacgagtcgctcgacatcgaatgggggtatgtatgagccatggtggtggcgggggagctgatctcgaacctccagatttgggggctagggtttgtgctctaatggggatgcactttgttgtgcgtgtgtgtagggagcaggatgggtacgaggtgctgcgcaagcttgggagggggaagtacagcgaggtgttcgagggattccggcccgggggtgacgagaggtgcgttattaagatcctcaagcccgtcaagaagaaaaaggtaggctttgccctcatcaaaatgtagtatgcctctgcggtggaactttcaattgtatggtccaaatttagcttccccacagatgtctcagtaatatttgtcatttctgttagacttacattgcctgcttgaggaatctagggtacacatgagcattaggaaatgcagtttaggctgattcctcagctggtcgtaggagtttgggatgatgtggctccatgagtgttattttgccttgtgtgataaacaaaatcagtagaaaaacttgtcactttcaaatcttatcgatgttaagtcttattagaggaaagtgtagttcaatgaggtaggtgttatgttttttgcttggttgcatagtgttctcgttgcatcttttactatagttcatgtgtattcttagcaatccttactgaattcttttatgatgatgcagataaagagggaaataaagatacttcaaaacttatatggcggaccgaatattgtaaagctacttgatgttgtcagggatgatgaatcgaagacacctagtttgatctttgaatatgtcaacaatactgatttcaaagtactctacccaacactattggattacgatatcagatactacatttacgaattattaaaggtaataatctgaattgcagaatcctatgtctgtaataatcaatgtttttatttatgctatcttgtctatggaacatttctttgtactgatggtattttgagaattttacatgcttggttctaatttctaagaatgtatcatatcattaggagtttggtaccaacttgtcagatataatccactgcttatgtatttttcttcaaacatcacaatggatcgtaggaggttacggagtaaaataatgggactgaaatctatgctcatgtatactgtatgctgataaataattaatttaaattgtcatggtagtttttattcctagatacctttcctgtttaaagctcatatgcatagaaagtggtatgatggatgggtcgattgcgtcaatatgacttggacaaggtttggaagataaaacgatagtttgcctacatgacaatgatgtaacacatctgttcgggaagttggggttatgttcctatcgattgaggcgcgtgtgcaagcacccagaaagaagttttgcttaaaaaaaatgtaaaaggggaacaatcttcaatggccgtgcgagcaatcatcattaataaacctctggttgaattaatcatgacattttgaataacatgtctattggagccagccttgtaaattctagcgagttcaaattaattaaatcaatactagagaataaatagtagtaaataagattagcacggggtatctactacacaacatcaactacattacttcttaatttttcttcgaaatctattctgtagcattttctgacctgtaggttatctgtccgaccagtctctttagtaatgtaagcatgacatttggcaggcttttaccgtgatgtcttttggccaaagtttgcatcgtgtaaacttaacttgccaacgataaggacaatcacagtgcactatgcagacatttgagtctattgcaaattatctgtaatgcttcttggttctcctgttttgaaactttcaaagagagtgaacatactaccgtttatatgtattttataactgtgatagatatcagaagagaccatatttcacatattcataagcagtgagaatgaaattagttcacttgatttattttggaagaaccataaaaggcaacagttgatgttgtcaagttttggtatttttcacatctattttgttctgtgggactacttctgccagattaaattctgcaaaccagattcccatgttctcgattaatgtgctaacgcggtttacaatcaagccctcatcctatttacatcagagatcagactaccttcattttgatggtctttaacttatccaggtgtgtctgtaggcactagattattgtcattcacgaggcatcatgcatcgagatgtcaaacctcacaatatcatgattgatcatgagaaacgccagctttgtcttattgattggggtctagcagagttctatcatcccaagatggaatataatgctagagttgcttcaaggttagtctcccttgcattggaagttcaatgtttcagacttgttcagcttattaagaaggaacttcacttgcatgcctaaccctctgagatccttttatgttggatctgtatttgaggaaatttcaagatctcttttccataactcaatggaaagggtcatgcagggagtgagattcacttcattgtatggtaccattcacatatagttataggataatttcatttacagcaagctttcttaataatttcattattccccactcaagctgatccagtcggttgctattctatagtatcttctgtaaatttcccatccttgacttactgcatgtgtgtgctctcgtgctgtgttattgacagatcttataagggccctgaacttcttgtggatttgctagattatgattactcgttggatttgtggagccttggttgcatgtttgccgcaatggtaagtgcaagtttagggtcagccatttatctttgataacagaaccttattgatatacattatggtaatcttaacagatattccgagtcgaccctttctttaatggtcaggataactacgaccaattagtcaaaattaccgaggtatgtctgtccgtagcttcttaaacttctaagtatttctggcagctttcttgtgttgatttatgcttgacttgtgctttgggacatgtttagctagggttatctttaaatttagtaagattttctgttatagctctaacagaaatgctttagctacctactgaattgaagtaggaactttttctatttggtaactgtgaccaaaccactacgtatacagatgtttacctgccttgtgcaaagaagcaaggcttcgcagtgcatttctcagaactgaagcagctactgattacaaaaaaatgtttattgtgaatgatatatgcaatatgtcattatcgtaggttcttggaacagaagatttctacaattaccttgaaaagtatggtcttgagcttgacccgcagcttgaaagacttgttggaaggtcatgcattactttggataatcttaaatatacatcattctcataacttagcatgatctaactgaatattatttgctgcagacataataggaagccatggtcaatgtttgttaactcggggaacagacacctagcaagccctgaggtgatttgcgttgcctttcaatcaacctactggcttagtcatctcttatttgatgtattttgacatgtttctacctatataggctattgattttgtagacaggttgcttcgctacgatcaccaggaaaggcctacagcaaaggaagccatggtgacaatccctctcctactttatagaagcatatgccatagaaatcctaaatatatgtgctctaaatgcatatatttgctgtgtgcaggctcatccatatttcaatccagtgagaagcacttaaaacggcaggaagagtgcccaatagtggtatgcggcatatttg

SEQ ID NO: 745 - DNA, 1313 bp, Glycine max
  CDS (129)..(1127)
attcggctcgagcacccctgacttgaacctcttaccgtgcgcatcttctcaatccataacaacttcgccaccgttgcaccgaaaccaatcgccacaaactcgggatctcagattcgacgcgccaaaccatgtcgaaggcgcgtgtctacacagatgtcaatgtccttcgccctaaagagtattgggattacgagtctctcacccttcaatggggtgatcaagatgattatgaggttgtgcgaaaagtgggcagggggaaatatagtgaagtttttgaaggcataaatgtcaatagcaatgagcgctgtataatcaagattctgaaacctgtcaagaaaaagaagattaaaagagagataaaaatacttcagaatatttgtggaggcccaaatattgtcaagcttcttgatattgtcagagatcaacattcgaaaactcccagtttgatatttgagtatgtcaacagtacagattttaaagttttgtatccaaccttgactgattatgacatacgctattacatatatgagctccttaaggctttggattactgccattctcaaggcattatgcatagggatgtcaagcctcataatgtcatgatagatcatgagttacgaaaacttcgcttgatagattggggtcttgctgaattttatcatcctggaaaggaatataatgtccgtgtggcttcaagatactttaaggggcctgaacttctagttgatttgcaagactatgactactcattagacatgtggagccttggctgcatgtttgctggaatgatatttcgcaaagaacctttcttttatggtcatgacaaccatgatcagcttgtcaaaatagctaaggtgcttgggactgatgaactgaatgcatatcttaataagtatcatctggagcttgatcctcaacttgatgcacttgttggaagacacagtcgaaaaccctggtccaaatttatcaatgcagataatcagcatcttgtgtctcctgaggcaattgattttcttgataagctccttcgatatgatcaccaggacaggctaacagctagagaagcaatggcacatccatatttctctcaggtaagggcagctgaaagtagcagaatgaggacacagtaacttgatcacatatggatccataaacttgagttaatatatttgggatttgttttatgataccctaacacgcaccttcgttaccgtctgtttattacagagattagttttcctgtggagtgtattgacattatgttgcagttgaggaataatgttattgccagttattgaaaaaaaaaaaaaaag

SEQ ID NO: 746 - DNA, 4501 bp, Oryza sativa
  CDS (52)..(262), (2992)..(3213), (3477)..(3586), (3679)..(3844), (4365)..(4498)
ggttgcgagagagcggaggctgtggcaggggcgcgccgccgtaggtagggtatgagcggcgcgtacagggatcgggggttcggcggcgcggcggcggagatggaccggaagcgcatcaaggacgtgctcgagaagcacctggacaggtcgtccccgtccacatccaggggggcggcggtggccaaggagagggaccgcctcgccgccgcaggggggaagctgcccgcgccgctcggcaaggccgggaaggtctccgatggtggtaaggatctggtggtttgtttgttccgcgcgaggggttgtgtgctgtttgttttgacggtggttggggttggtggcgtctggtgctacattgcctcaggtctttgcctgctttggttagatgatgatgcagcttctgtttgtttctcgggtagaatcttagggtgaaatttggtgcgctgtcgtgataacgtaggcttctgtatactttctccgatggatgaaatgggatgtaagagtctggatgttcaccgcattaactggagctgaagtaagcgaagttctacatttctgtttgaacttcacgtgaataccatcccacgtactgcattaattgatgttatgacttaaatatgttcacgaaacatcggttagttctaaacaatgttttaaaaagcggtatgtagttttgtgcggtcaccccatattgtagcacttatgcggcatagtcagacgcttatgcggtataatcgaccacttgtacggctaagcggtacaaggttggggcacctgttccttgtatgtggcgaccttctttttagatgctggttctagaagcagtaacaattactaaataaataaacgtgcactggaagtttatgagaagccggtcaaagtagggtcttaatgcagtcaaagcatgcaatggtgaaagaatcagatgacagaagctacaataaacgtaggcaagtatgggttagggcaccttatgatatagaattcttaggcaagttggtttttgcgaggcattagggtaactggccacatggaatggaattttggactggtagttattctaccatggcagtggctgtttaattaggtatgcatgagacacaattagagcaatgtatttttgttgcagtggcaattaatgcgatgagttaaagaggtagcgaagagtttgagacgcgtgaatgccattttgcatacagtcgtcttaacaggataatattgaatttatcgaatgtttagcagccccctttatatgttgatgtactgtaacataggactgaactggcaacggcatccatatgtagccctaacaaatctcagaagagaaaactaacatgtccaattgaaggaccttctatatgagatgacccaatgtcttgaatagtttcagtcatattgtattgtttgtttgtctttggggccagtggagatctgaagaatttctctatctgtgagactaacatgatattgaaggcaaagagcaattgctaaaagcattaacatgatgtcatgatgttatattagtgccttgataggttactgctttatgaggaactcgtttggcatgaaaaatcctccatttgcttccttactttattggtttttgtctctgtagaacatttattttgctttcagatgtcaattactctattggaattttgggcatgtcattagctgtaatatatacagtgttgaaataactttcagctgtgtagtgacaaatgataaaaactcgacccaaggggagagacatcccgaaggcattacacttaaggtcgaagaaaaggccctgaaagccggctcttgcttgtacaagggctccattgccacaagccgtatcttaacccatactttagggaccacacaccgagggtccttttgtttgtgagaaccagggttgaaaccctggttgacaacttcacaactggaggacttgctgccgtgctataagcatgttctcaaaaacttgaccaacctagggggaactaggtgccttttttatttaagaagaaataggcacctgaattcgcttcgatgaggacttgaacttgggcggtctgggcatcaatgtcctcgaccaactgataatgtctttatacatttcacagctcatgttgaaccaaaaaaggggcataattgcaagcttacagttatatctgtagccagtgggcagcggtaattaattgtagtttttgagtgatcagtttccataataagaaccgggaggaaccaaatgtgatggcatagcacttggggagttggggtataggcagcattgattgatctcaactcttttgtttccatttgtgtcatacattccagtttgaccgatgtttgcacgtgtagagccgtcatgatctgatcacacaggaagactctctttttgtttgaattgaaaagggaactattccagtgcctccactgatgactcactgaacatgctgcttcactttgaccattttgtttgtcaatttcgcttgatatgcaaccagggcggtaacacacctattgtgtggttgatgtgaacagaaactggtacatcataatagcaccaaaagaagaggatagattgcacaatagataagtagagcaccagcaagcagaagattgaacctaggactagcatcttagtactccaacaacaccttctttaatgagttatgaaggagggggtaggaggttactttgacttggaaaccatagaaactcttggggatgttatatcaaactacactgaacttagttttacagtgatatgaatgtttgtgcagtgatatgaatgtttctttaatttctctgtgcatcgatatgaatgtttgtggtttttcaatctgtaagaaaactgcttgcttttattatacacttgaaattcataatattgtttggcagggtattacttgtgactattgctttactgcagtaactgcaattattaatatgtaattttttaatcatcattaggtgcctctaatcccttttttcttttgggtgcagcagaagaatttgaaactgacagtgaagattcagatgtcagtggttctgagggagaggacacatcttggatttcatggttctgcagtttgcgcggcaatgagttcttctgtgagatcgatgatgattatatacaggatgatttcaacctttgtggtctgagcaatcaggtgccatattatgactatgcacttgatcttatcttagacatcgagtcttctaatggtgagattatttttctcttaagaaagctactaattcattatttgcagtaaaatacactgttcatataccatttatgaatgtcactagctgcaacctatatttttcataccactttgtatcctaacatacttttttatgttcatcaatctcattttctaaaggagccatttccaataacctatttataaacattccacagttcaaagtctgaaacatgtattgtatacacatacacccttctaagtcagaccatttgtatacaggtgatgtgttcactgaggagcaaaatgaattaattgagtcatctgcagagatgctgtatggattaattcatgcaagatatatcttaaccagcaagggtctggctgcaatggtaatctgctagcagtttgaccatatttgataggctatgcttgcttccttgactacttgaatactaaattattctgcttttgccttctgcagttggagaagttcaagaactatgactttggaagatgcccccgggtatactgttgtggccaaccctgtcttcctgcagggcaatcagatattcctaggtctagcacagtgaagatatactgtccaaaatgtgaagatttacattatccaagatccaagtaccaaggcagtatccttttgattgtttgtcttagatgtgttttatatgaactgctttttttcttaataaattgtactcatatatggagttaaaaacgaggtgatatctgatagggcataaattagaaattgtgatttcctaagcagaatcagacttattattcgcaacagctaaagcaaagcacaacacgaacataggcagaattatgaatacatgacccatttgtgctgctctctaaaacacatcctttaaaaaatcaaactactgagtttttatgccacctgtaatggatttcaccactctcagtttctccaagttataggttggtttttaggcagcacttgaaaaggggctctgtgtagaggattctcattcaaacatggttttcctttattttttttatgcgactcatacaatttgattagatttgtttggaacataaccatgggtaaacaaacattgattttgtgctatcatgaatattgtgttactatttttcttgcacttgtatctcctttactttgctaagacattgacggagcgtactttgggacaacattcccacatctcttcctgatgacatatccacacttgaagccacaaaagccatctcagcagtatgttccaaaagtttttggcttcaaacttcacaagcagtcatgacaa

SEQ ID NO: 747 - DNA, 1239 bp, Saccharomyces cerevisiae
  CDS (286)..(1122)
ttctcctatttcaatcaactagacgtagttcaaggattgcaaactgtcctgctttcttttatctggtctttttatcccgaggtattgttgtatataccactactctgtgattttttttcactcttgggaaggaaagaaaaagtgaaaacatcaactggtaagtgtctaatgacaaaaacaggaggtagttggtacgtgcaaaacacgatagtgacgttaatccgaatctgtaaattggtgaattggtatttagaagcgaccattagctaaaagagagagaaaactatgtcgcaagagtttgtggaagactattcacgtacagggtcctcagacgacgaggatagtggagcttatgacgagtggattccatcgttctgttccagatttggtcacgagtacttctgccaagtcccgacagagtttatcgaggatgatttcaatatgacctcgttatcccaagaggtaccccactaccggaaagctctggatttgatattggatttggaggctatgagtgatgaagaagaggacgaagacgacgtggtggaagaagacgaagtggatcaagagatgcagagtaatgacggtcatgatgaaggcaaaaggagaaacaagtcgccagtggtgaacaagagtattatcgagcacgcagcagaacagttatacggattgatacatgcaagatttattctgaccaagccaggcctgcaagcaatggctgaaaaattcgaccacaaggaatttggaacgtgcccccgttactattgtaatggcatgcagttgctgccttgtgggttgagcgatacagttgggaaacacaccgtaaggttgtactgtcccagttgtcaggacttgtatcttccccaatcatctagattcctgtgcttagaaggtgcattttgggggacaagcttccctggtgtgttcttgaaacatttcaaagaattggaagagtatgtggaaaggaaaagtaaagagtcctacgagttgaaagtttttgggttcaggataaatgatgaggcagtatctggtcctagaatgaagtggttgagacaatatccatccacggaggaggactgggaagaatttgccaaatgcgagttcgagacaccggcggtttaacccttgatttattttcctctttgccctaccatatacatatgtactttacctatttacattgtttcagtttttatatcaccactattattattattactattaccactttggagtact

SEQ ID NO: 748 - DNA, 1342 bp, Zea mays
  CDS (231)..(1055)
gccgctccaaagcagcccgtggttacgtcagcgcccgcgtactgctcccttcttcctcgttgctccgcccccttttgtcgtcgcgtcctcctctcgaggcctcggcagtcggcacgaggacgcgcgatcccgtcaccgctcacctccttctccaaacactgactccgcttcccgtccccatcccgctgcgcaagatcgggaggggacgaagagaggtcgaccgggaggagatgcaccgagaccgaggcgtctctgcggcagcgatacccggtgaccggaagcggatcggcgagcctatggacagatcgtctccatctacgtcgtgggggttctccggagggcgcgagaaggagcggatcggcgtgggcaagcagccggagatgcctcgctccggcggcggatccaccgccatgtccaagagcaagctctctgacgaatcagaaactgacagcgaagaatcagatgtgagtggttctgatggggaagatacttcgtggatttcatggttctgtagcttaaagggcaatgaatttttctgtgaggttgatgatgactacatacaagatgatttcaacctctgtgggctaagcaaccaagttccatattatgactatgcacttgatctgatattagatgttgaatcttcccatggtgatatgttgacagaagagcaaaatgaacttattgaatcagctgctgagatgctctatggattgattcatgttcggtatattattacaagtaaagggctgtccgcaatgctggataagtacaggaacgttgagttcggcagatgccctcgagtgaattgcagcggccaaccatgccttcctgttgggcaatcggatgttcctcgttcaagtacggtgaagatttactgccctagatgtgaagacatctacactccaagatccaaatatctaagcaacatcgacgggacttactttgggacaacattcccccacttgttcctgatgacatacccgcatttgaagccccagaagccgctgcagcaatacgttcccagggtatttgggttcaaaatccgtaagccatgacaaatttgaaggttgaatgtataaaaggttcaaatagcgccctgttatctgctggccccgcagtgttcacacgacacgtcatcggaatacacctgacccgcggctgacctccctagtctggtttcttgctctggcctgaaattctgattgatgcttgtggtttctttagcctagtgaatcaatccatatttttttacgatcatacgtattatggctttaatggtttaacaaccatctatatttttgttggcacggttcatattcgttttttactctgattgttt

SEQ ID NO: 749 - DNA, 1284 bp, Zea mays
  CDS (178)..(993)
tcgcagcgtgtctcgtgctccccccaggctcctcttcctcgctttccctccaccccgggcgcaaaccctaaccctaccgtcgctcgccccgcggcgtctgccaatggcgcgccccgtgtgagtgtgcgcgagagaggggtagaccttgaggccgctacccggggaggagagcgagagatgtataaacaggggggagcggggggaggggctgggctggaccggaagcggatcaacgacgcgctggataagcatctcgagaaggcggtcgcgtcgccgtccacgtcgagggggtcggcgggcggcgggcgcgaccaccaccgcctcgtcgtgccgtcctccgtgtcgtccatccccaagggccgctgctccgaaggggagtctgattctgatagtgaagcatcggatgttagcggctctgatggagaagacacctcatggatttcatggtattgcaacttaagagggaatgagttcttctgtgaagtcgacgatgattatattcaagacgacttcaacctttgtggtctcagcagccaagttccttattatgattatgctctcgatctcattttagatatcgagtcatctcatggtgatatgttcactgaggaacaaaatgagctcgtagaatcagctgcagagatgctttatggtctgatacatgcacgatacattctgaccagtaaaggactggctgcaatgctggagaagtataagaactatgactttgggcggtgcccgcgtgtttactgctgtggtcaaccatgcctgccagttggacaatcagacatccatcgatctagtaccgtgaagatatactgccccaagtgtgaagacatctactacccacggtccaagtaccaagacatcgacggcgcatactttgggacaacgttccctcatctgttcctgatgacatacgagcacctcaagccacagaagctctcgcagcgctatgttcctcgtgtctttggcttcaagctccacaagccatgaacctcatgtatttgtcttttaaactcctcaagacgtggcactgggggcatgcgggagttttgcaatccttgaagacttgcatataagagcgccattggcaggtcagtggattggtaaaattctatcatgctgcagcgtgcttgtaccttagctggctggcacctatccaacatttgaatgtagctctaaggatatcaatgttgtaacctaactgctattgttctttgattagtaaaccaggagccccccctacaatgtagaatatggcaattatttatggctttgcag

SEQ ID NO: 750 - DNA, 1861 bp, Zea mays
  CDS (54)..(1394)
cccacgcgtccgagtagcaacaggagcgcaggcagaactagagcggtcttggtatggcttcttccctcgcgcccgcgtcgtgggcactgccgctgcagatgggcggggctggggcggcagcggcggggccttcctgccgcgcgacgctagccgtcgtcacggagccccgctgggccgcgtcgctgcgccgggcaagggttctcgtggcgctggcgccccggtgcgtggcgctcgacgggcccggcgccagcggcgaggaggaggcgcccaagatcgaggacgagaggaagaagagcggtgagacgaagaagccggcgcgcggccggccggtgtggagccggatcctcttcgcctccaagaagacacgaagtatcatcatcctcaacgccctcacggtcatctatgcaagtgatattccggttttgaaagaggtcgaagccctgacagagcctgcggtcttcaacatggtgcggttcgttgttgcagccatccccttcgtaccattcgcgctccgttccttcggtgaccgcagtgtacgctacgcgggactggagctgggagtctgggttagcttagcttacctttctcaagcaattggattgctctcatctgatgctggccgagcatccttcatcacggccttcacggtcgtagttgtgcctctaattgatggtcttcttggtgcttcgatccccagactcacatggttcggagccatcatgtctctgttcggaattggcctgctggaatgtggtggatctcctcccagtgttggcgatattttgaacttcttcagtgccgtgtttttcgggatccatatgcttagaacagaacaaatatcaaggagtacggacaagaagaaatttttagctcttcttggcttcgaggtccttgtggttgctttctcctccgttctctggtttatgttcaaagatggctacgttgataccagcggatccagctttgaatcttggacgttcgggatgctctgggataccacagtttcgtttccttggataccagcattgtacactggagttctttctacggtgttatgcatgtgggcagagatggtggcgatgggcgatgtttcagcaaccgaaactgcagttgtttacgggttggagccagtttggggagctgcttttgcttggttcctccttggtgaaagatgggatgacgctgcatggaccggagctgctctcgtattatgtggcagtttgacagttcagctatttgggtcagctcctgagaagtccaagaaagtcaaaaaacgcagcagcaatgctttagaaactccggtgaaacgacgagactacttatcgttgtctcccataccagttgattccgggaagatcataggaaggcaattagaaaggaagaacaaagcagtataggtagcccaactacaaggcaagaagaaaggaaacgctgcgatggtaggggcgcgcatgtaccaaatcattgtcctgaggcatcatctgtttggctccgtcaatatggggatgctgctcgattgctcctcatggggtttttttcctttgtccatattgaaaatggtcgtatttggatttctgttgtctcagttgaccgtgctagagtacctcatgcgtattaggaaatgaggcattggtagtggcaactcgaggagaatactgagacacatctactggcgtagtaatggcgttcagtgagataacttagtgtgttttgggcactgttaaccgtacaggttcatgtaaatatagtggctaaatggttctagagtactgagctgagcacaccattgtatagtactgaaataacaaataccacgcatggtattatttggctaaaaaaaaaaaaaaaaaaaaaaaaaaaa

SEQ ID NO: 751 - DNA, 1282 bp, Zea mays
  CDS (30)..(1112)
ggcagacgccagcggccagccgcagcgccatggacgtagaagcgcgcaaggacgcagcgcccgcgcgcggcaaggcggtgcgccgctttctggtagcactaaactgcgggatgctggcgctgggggccatcggcgggccgctcctgagccgcctctacttcagcaagggcgggcaccggcagtggctctccgcgtggctcgagaccggcggctggccgctgctgctggttcccgtggcggcgtcgttcggcgcccggcgcgcgcgcgaccggggcgccccggtgctgctcaccccgccgcggatcctgctggccgccgcgggcctcggcgtcgccacgggcgtggacgacttcgtctacgcctacgggctggcgtacctccccgtgtccacctccgcgatcctgatctcgacgcagctggcgttcacggtgttcttcgcgttcctggtggtgcggcagcgcctgacggccgcgtccgtgaacgccgtggcgctgctgacggtgggcgccgtggtgctgggcctgcacgtctcgtcggaccggcccccgggcgtcaccaggggccggtactggctgggcttctcgctgacgctctgcgccgcagcgctttacggcctcgtcctgccgctggtggagctcgcgtacaggcgcgccgcgggcggtggccgcgccgtgacgtacgcgctggtggtggagatgcagctggtgatggggttcttcgccaccgccttctgcacggtaggcatggtcgtgaacaaagacttccaggcgatcccgagggaggcgaggcagtacgagctgggggaggcccggtactacatggtgctggcgtgggcggcggtgctgtggcagtgcttcttcctgggcgcggtgggcgtcatcttctgcgtgcacacgctgctggcgggcatcctcatcgccgtgttcatcccggtgacggaggtggcggccgtcatcttcctgcacgagaagttcagcagcgagaagggcgtggcgctggcgctctcgctctggggcctcgcgtcctactcctacggcgagtggagccaggccaaggccaagaaggagaagaagagcgaggaggacgacggcgaagtggcccaggcagtcccatgatccgtgccccacacacacaaacacaatggtctgccccgttgtactctctgtctgtgtgtatgtaaatgttgtgttgattgcggccgtgttggtcctgtgaatggcgtcctgagtcgtcggttgtcagtgatgtttgatttccagggattaatcttttgtctcaaaaa

SEQ ID NO: 752 - DNA, 2246 bp, Zea mays
  CDS (62)..(1324)
ccacgcgtccggggcggaagagttgcgggaggaggaggagggtggcgggcagcggaagaaaatgggcgggatcccaagggagccgtcgttctcgcggtggtgcagggacccctctgccgcctccgcctccaataccgccgctgctgcggcgaccagtgacagcgacgcctcagaggagttcgagctgccgcttctgccatcctcctcgggcggcggcggctcaccgatggacattgaggtgggggcaacggcgagatctgatgatctgccgatctcgccgaggttgcttgcgaaggtcatcgggttgatagcgtgttggtacacactgagcacgtgcttgacgctgtacaacaaggagatgctgggaaagcacatgtggaagttcccggcgccattcctgatgaacacagtgcatttcacgatgcaggccgtggcgtcgagggccatcgtgtggttccagcaacgaggtctagagggagggccaagtaaaatgtcgtggaaggattactgtttacgagttgtcccaacagctttggctactgctcttgatataaatctgagcaacatttcacttgttttcattactgtgacatttgctacaatgtgcaaatctgcttctccaattttcattcttctgtttgctttcatgttcaggcttgagaaaccgagctttagccttcttggaatcatgctggttgtttcatttggagttctactaacagttgctaaagagacagaatttaatctatggggatttatgtttatcatgcttgctgctgttatggctggtttccgctggtctatgactcagattcttctccagaaagaggaatatgcattaaagaatccttttaccttgatgagtcatgttgccccggtgatggcaatagtaacagcaattatttccatcgtgatggatccatggcatgacttcagagcaagtcacttttttgatagttctactcacataataagaagcagtttgttgctgcttctaggtggggctttggcctttttcatggttttgacagaatatgtccttgtttctgtgactagcgctgtcacagtgactgtagcaggaattgtgaaggaagctgtcactattctggttgctgtgctattctttaatgatccatttacatggttaaaggcgcttgggctggcaataataatatttggtgtcagtctattcaatatttacaagtataaaaggttcaaaaaagggcatcacagtgaagatgctgggacaaatatccaatcttacaatgggacttcaaagtacgttatccttgatgatgatactgaagatcaggatgattcaggctgacctgaatatggtaggtaagaatgcagactactatatgcactggcgtttccagagaagcaagatcttctggtgcctgcatagacttacttccacaggctaactgatttcatactattttttgagttgatcaaccgctgtggccagtcatgcacgagcgtgacgcttgcagccgtgtgacaagttgagaagactacacgctcgtacatggaacatacaagagacaggctgataatcagtacagatgttttctcctttcgttcaaaacaaagaacggtgcatatatctgaacgaggcattctgcagtatgtccacgaagaaaatgttgcatcaattacaattagaaacacaggtaacacacttaactttatggatgaggatagggttcggttttgtagtgcattctgattgttgaagggagattcagcatcggaacatagctttcttttctttagttctttctttttttgagatgaaaaataaatagtactaacaatcttatatgtaataatgttgtatttacgggaatgtgtaccgtttcacgtaggagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 753 - DNA, 1491 bp, Zea mays
  CDS (174)..(1271)
cccacgcgtccgccgccgcccgcccgggtcgcatcgcatcgcctggtcggccggggactcggggcaggcgagcgacactagctataaaagacctcccgccgcctgcgactgggccgtgtgcaagcaaattaaagcgcaaggccgatccgagggtggactgtggagggccggccatggtgatgatgatgcggtcgtgcctcggcggtggcctgctgccggtggcggtcatgctctgcctcaacgtggtggcggcggtcatggtatcgctcgtcaaggtggccatggacggcggcatgaaaccgctcgtgatcgtcaccctgcagcagctcaccgccgccgtcttcctcgcgccaatcgcattcttcaaggagaggaagtcgaggccaaagctgacgctggagatcttcgcctacatcttcgtcagtgcggcgctcggggcagctcttcgtcagtacatgatcttcgtggccctgcgctacaccacggccaccttcgtgaccgccttctccaacatcgcccccgtgctcaccttcctcctggccgtcgccacgcggtccgaagcgctggacctcaagagcaggacggggttggcgaagctgctgggcacgctggtgtcgctggccggcgccatggtgctcaccctctacaagggcgtggcgctcacccacgcggcggcagcctcgcaggaccagcagcagcactcccacggccggttgccgccgagcgccgccgacagccgcggcaagtggacgctgggcaccgtggccatcctgggcaactgcgtctgcctctcctgctggttcctgctccacggccgcctcgccaagaagtacccgcacgtctactcctgcaacgcgctcatgtccttgctcagcttcctccaggtcgccgtcgtcggcctctgcacccagcgcagcatctccccctggatcgtcaccagcaagttcaacatcctcaccgtcctatacgccggcatcgtcggctgcggcgtctcgttcgtgctggtgacatggtgcatcgagaagagaggagccgtgttcgtggccgccttcataccggtggtgcagatcatcgtctccgtcatcgacttctccatcctgcacgagcagctctacctcggaagcgtgctgggatcagtgctagtgataggtggcctttaccttctgctgtggggcaagaggcaggaggccctgcactgtcctcctcctcctcctccaaaggttgccgaagaagaccctgctgacaaagagcagcagcaagtgcagcacaactgaagacggacagcatcctctgactgttggtcgtttggttgtaacagtgccagcaataagatccctctgcctccttttcttttcttttggtgtctcaggggggtgggcaatgttccttccttctcagatcgatcaccaacaaagtgtttagattctaatccaaaacagtagaatggtcttaaatacagtactcctgcttactgatgataaaaaaaaaaaa

SEQ ID NO: 754 - DNA, 1205 bp, Zea mays
  CDS (5)..(1072)
ctgtatgcttgtggaaatgggcagcagagcagctttcgtggtcgcgtttctcctgagggctatatatgcaggcacgcagatactcaccaaggctgccttcgatgaaggcatgaacacgtcggtctttgttttctacaggcatctgactggtatcctcttcttggtgcctattgcttttgtgcttgagaggaaaactgcccctccactgtcattcagagtctctctgaaattgtttttccatgcactatacgggatctctggagcaataaacatatacggcctcggtctcagctattcttcagcaacatcatcgtctgcgatatttaacctcctgccagctgtggctttctttctggctgttcttttggggatggagacactgaacttgaagcggttccacgggatcgcaaaggctgcaggcgtgttgttcagcactgctggcgtgactgtgctggcgttctaccaaggccccgcattcagatcgttcatccaccacaccgctttctcccatcacaacgtccacgctggggtcgttaccgccgctcatcctaaaagcgtctggatactggggattttcctgacgaccttgtcgactgcatcgtgggctctctggacggttcttcaggggccaatgctggaagcgtacccatccaagctgctcaacacgaccctccagatgatcttcgcgacggtccagtgcttcttcatcgccctagcggccgagagggacttgtcgaggtggaagctggcgctggacatacgcctttacgctgtgatctactctggaatacttgtctcgggagtcgcttactacatgcaagtatgggtgatcgagaagagcgggcctgtcttcttggccatgacgatgccgataaccttgcttgtcaccatcattctgtccctgtttctcggagagccggttaccctgggaagcatcttgggtggactgatcatggtcggtggtctgtacagtgtgctctgggccaagaggtctgagcaggtgcatgccagcaagcagcaaatggcagcgcctactcctcctccagcaggcgacacaagtgtaggccgagcttagcttgtttattttgcagtgactgagatcgagagaactgtgaagttctgtttttagataatggaaacctgaatgagcacatgcatcaggcccctaaggactctcctaacagctgctaaaaaaaaaaaaaaaa

SEQ ID NO: 755 - DNA, 1580 bp, Zea mays
  CDS (113)..(1261)
gtgagctagctagctctagctaggccacgcactgctgcctccttcatcatcaggtcgtgctagctagctagctatagctgggccgggggacgtacgacatcagcgcgcggccatgggcgtggggaagctgatgaacgacgtgaagccatacctggcgatggtgctgctgcaggtggggttctccgggatgtacatcgtctccgtcgcctccctcaagcgcggcatgaaccacttcgtcctcgtcgtctaccgcaacctcgtcgccaccgtcgtcatggcccccttcgccctcctcttcgagaggcgagtgaggcccaagatgacgccgctcatcttcctcaagatcatggggctcgccgtgctcgagcctgtgctcgaccagaacatgtactacctcggcgcgaagctgacgtccgcgaccttcgcctcggcgctggtcaacatcctccccgccatcacgttcctgctggccctcgccctgaggatggagaggctgaggctccggagcctccgcagccaggccaaggtggtcggcacggtctgcaccgtcgccggcgccgtgctgatgatcctctaccacggcccggtggtgccgttcccgtggtccgcgggtcgtcttcaccaccacgtccccgcggcggcggtggagagccagagcagcgcctcctggctcaacggcatctgcatgatcatcggcagctgcctgtgctggtccggcttcttcatcctccagtcgaacacgctgcagagctaccctgcggagctgacgctgacgactctgatctgcttcctgggctcggtgctgaccggcggcgtggcgctcgtggcggagcgccgcgacatgagcgcctgggtcattggcttcgacacccgcctcttcaccgccgtctactccgggatcgtgtgctccggcgtggccttctacgtgcaggggatcgtgacgcaggcgcgcgggccggtgttcgtgacggcgttccagcccctgtgcatgatcatcaccacggttcttggctccaccatactgaaagaggagaccaccctgggaagcgtgattggcgcggcgatcatagtggtggggctctactgcctcatctggggcaagagcaaggaccacctcggcagcaacggcggcaagcccggcgccgcggccgtcgccgagctgcccctgacctcgtcggctcctgcttggtccaacggcaagcaagctctggccgtcgtcgagacgacaccgccttcgtctttgcccaacaagtgcgttcactgacgcgcggatcggagctccatgcatgatgcggaccgtacaccaccgcacactactagtagtgcattgccagtgactgtaagccgccggccgtgtatgatcatgcatgcataccgtcataccgatatgatgtcccatactcccatcgttgcgtttaacactctcgagtttttgataacgtacttgcgtgtgctctgctgtgtgccactgccagtgccaccacaaccaatagtctaatactactacgacaattaagctttgtttagtttgtgcaaggaaagaagagaattaattactactattcgagtcaaaaaaaaaa

SEQ ID NO: 756 - DNA, 1294 bp, Zea mays
  CDS (48)..(1127)
cttttggttattttcctcttgctgtggcttaacttgacaagaagaagatgctacgtcggcaaggccgaggtggaaaatttctggaggaggtgctcatcgtcggcgggctcctgctggtgcagtgcgtgctctccggctacgtggtcttcaccgaccacctgctcgccctcggcgccgacccgctggccgtcgtcgtcgtcgccggagccgcctacgccgccttctgctttcccttcgccgtcgccctcgagaggaagcgatggccttccacggtttcggggactctggtggcgcaatacctgctcattgctcttggagggacaaccgcgtttcaagcgctgatgctgctggggatcaagaagaccacgccggccatcgcatccgccatgcccaacctcagccccggcctcatcttcatcgtcgcagcctgtttcaggctggagaggttcgacagggcgtgcaagtacacgcaggcgaagatggcggggacggtggtgtgcctggcgggagcgctggccatgggcttcctgcacagcccaacttctacctcctcctctctgcaggcggcagtagctgcggaagcagcagcaggagggggcgactactactacgactggatcctcggctgctgctgcctcgtcgccgccgtcaccgtcttcgcgctcgtcaccgtcctgcaggccgccacgctcgccgccttccccgcgccgctcaccatgtgctgcgccacctccgcgacgggcgccgctctcaccgccgtcctgcggctcgtcctggaagggaggttcctcggcatggggtcgcccaggatcgacgccacgctcgtcgcggggatcgtcgtcctcggcggggccgcggtgggcgcgtgcatggcgttccaggcgtggtgcctgggcaggaagggcccgcttttcgtctccgtcttcgggcccgtccagaccgtctgcaccgccatcctctccgcggctctcctccgccaagtcctcagcctgggaagcctcgcagggatcgtgctcatgttcactgggctctacattgtcctatgggccaagagcaacgagatctcggctgacgacgaggaacagtcgttgcagggtggcgacgacgccgagaaggcactcctagcctagcctagcaaaatccagagcgaatatcactgcacgctctgtatttgtaaaaatggaatggtgtctacgtacctgtatacatactcgagaggatttagagaaaaaggacatggctacgtttgttcataatatgtatatactggaaatactccctcccaaaaaaaaaa

SEQ ID NO: 757 - DNA, 1490 bp, Zea mays
  CDS (112)..(1290)
ctcctctctgcttctcggcctagctagctagctcggtgcctcggccaaccgggcgtcgcgcgctggccggccggcctgccaggcgagaactagctagcagcgcaagcaacaatggcagattcaggggaggggcgtcgggtgtgcggcatgccggagaaggcgcagctgcacgtggcgatgctgctgctgcagttcggctacgcgggcttccacgtggtgtcgcggctggcgctcaacatgggcatcagcaagctcgtcttccccgtctaccgcaacatcatcgcgctctgcctgctcgtgcccttcgcctactttctcgagaagaaggacaggccgcagctgaccctcaacttcgtcgtccagttcttccttctcgcgctctgcggcatcacggcgaaccaagggttctacctgctgggcctggacaacacgtcgccgacgttcgcgtccgccatccagaactcggtcccggccatcaccttcgccatggccgcggcgctgcggatcgagaaggtccggctggaccgccgcgacggcgtggccaaggtggcgggcacgctggcgtgcgtggcgggcgcgtccgtcatcacgctctacaagggccccaccatcttcggtcccagcggcagcggcggcggcggcggcctcgagctggcggcggtgggcggcgacaagaactggacgctggggtgcgtgtacctgatcgggcactgcctgtcgtggtcgggctggctggtgctgcaggcccccgtgctgaagaagtacccggcgcggctgtccgtcacctcctacacctgcttcttcggcgtcatccagttcctcgtcatcgccgccttcatggagagggacgcggaggcctggaagttccactccggatccgagctcttcaccatcctatacgccgggttcatcgcgtccggggtggcgttcgcggtgcagatctggtgcatcgaccgtggggggccggtgttcgtggcggtgtaccagccggtgcagacgctggtggtggccatcatggcgtcgctcaccctgggcgagaagttctacctggggggcatcatcggcgccgtgctcatcgtcgccggcctctacctcgtgctctggggcaagagcgaggagagggcgcgcgtcgccagggacgccgtctccggcggcgaccgcgaggggctccttgtcgcggcagccgccggaggtggtggcggcggcatcatcaggagcgccggcaataaggtggcgtcggccgcgacgcagcctctcctgctgccgtcctccacctccactgacaacgtctgaccgatccatggatggatgaatcgtcatccatgcttgcttggtgcgtggagatctgaggcagcatgcagaattaccagttattagtcatttctttgaggttttcccctgttgattttcacgcatgtatgtatgctgctacctacgtgtacgtacgtatatgcatgcatcactatggttgttttacgccaaaaaaaaaa

SEQ ID NO: 758 - DNA, 1774 bp, Zea mays
  CDS (197)..(1327)
gacttccctggctgtcatggacaagcgcattatgccctcacgagataagttaacagggctagctgctaggtggttgctgcatactggtcttccctctttctcttgccacctcgggcatcctctctggcttagaaaaaaaatatgcgcttcatagtccatacctagatcttttggtgttcagttttggtttcaagccatggcgaattctcggattggacgttacaagatgtctactctctcagacccctcaaaagaagatacttcacctgagggttcaggtactacccagagaaatggagcctggagtaacacattgaacactcttctgcagcaagcctcagtatatggtgtggccgctgggtattgtttatcagcgtccctgctctcgatcatcaataaatgggcaatcatgaaatttccatatcctggagccctgacagctctgcagtacttcactagtgttgctggagttctcctatgtggacagctcaagctcattgagcacgatggacttaacttgaggacaatgtggaagttcttacctgctgctgtgatgttctacatctccatcttcacaaatagtgaactcctgcttcatgccaatgtggatactttcattgtgttccgctctgctgtgcctatatttgtcgcgatcggagagacgctgtatcttcatcagccatggccatcgctcaagacatggctttcactctccacaatacttggtggaagtgtgatctatgttttcacagacaaccaattcactgtgactgcttacacctgggcagtggcctacctagcaagcatgtccattgatttcgtgtacatcaagcacgtcgtaatgaccattgggctgaacacatggggccttgtgctatacaacaatctcgaggctttgatgttattcccccttgagctccttataatgggagaatttgatcagatgaaggtcgacagctccaaggtgtcaaactggctgtcattcgatgtggtcctccctgttgctctttcatgcctgtttggactatcgatatcattctttggattctcctgcagacgggctatttctgctaccgggttcacagtgcttggcatagtgaacaagctcctgactgttgttattaatttgcttatctgggacaagcatgcctcttttgtgggcaccattgggctcttgatatgcatgtcaggtggcgtgctctaccagcaatccaccatgaagccgaaggcgcccaaggttgagccgaaggaagagaacgacaacgacgaggagcagcagaaattgctgcagatgcagggtgttcaagagagcaatccaactcagaaataaagctcttcataaaccttacaacgaagtaatgctttgatggattaccttctttgcaacagcctcacctgaaacgtttttgtattggctaatacttggaaaaaagcatatggatgagtagtcatgaattaggagctacaaaatatcatgtttttgatattagaagtcgtgaggggacctaattatcactatgcaattctttattactgtattaccacttacatttgtaacgcaaaatcgttatgataggataccaggtactcggcaaatacctgcattgaatacttcctatacaaaagcatccgtctcatacagttcgggggtgacagtggtagtatgatctgtttttaggcatttctctgctggagttagcctatatgttctgtaacttattgttggtgatgaagacattggttcttgtgctaaatagagttttcttatcaaaaa

SEQ ID NO: 759 - DNA, 1467 bp, Zea mays
  CDS (111)..(1142)
cggacgcgtgggccagcagcagcccatccgaccccccgcctcctcctcctcctcctcccgggttcgcgtgaggctgtgtgctgctgggaggcggcgccggcgccggcgccatggaggcggagaagaagccgccggcggtgtccgacgtgggcgcgtgggcgatgaacgtcgtcagctccgtcagcctcatcatggccaacaagcagctcatgtcctcctccggctacgccttcgccttcgccaccacgctcaccgggttccacttcaccgtcacggcgctcgtcgggtggatctccaacgccaccggctactccgtctccaagcacgtcccgctctgggagctcgtctggttctcgctcgtcgccaacacctccatcaccgggatgaacctcagcctcatgctcaactccgtcggattctaccagatctccaaactgagcatgattccggtggtctgcctcatggaatgggtgctcaacagcaagcactacaccactaaggtcatatcggcagtcaccgtcgtggccgccggtgtcgggatttgtactgtcacggatgtcgaggtcaatgccaaggggttcatctgcgcttgcgtggcagtgttctgcacgtcgcttcaacagattacaattggctcctttcagaagaagtacaacattggatcatttgagctgctgagcaaaactgcgccaattcaggcactttcactcattatactgggcccctttgtggactactatctaaatggacggtcattgttgaactaccctttttcaggaggggcaactttcttcatactgctttcctgctccctggccgtgttctgcaacatgagccaatacctctgcatcgggcggttctcagcgacctcgttccaggtcctgggccacatgaagaccgtgtgcgtgctgatcctgggctggatcctgtttgactcggccctcaccgtgaagaacatcctcgggatgctgctcgccgtgatgggcatggtggtctacagctgggccgtggaagcggagaagaaggcggcagccccgatcccccggaacaagggcggcatgctcgacggcgaggacgtgcccctcaaggccagggtgagcggcgtgcccgcggtcgacctcgaggacggcgacgtgaagggctagccgctgatccgttcattcttctcgttcttttgtaactgtgcgcgcgcggtcgctcgatgcaaagttgcttgttcgtcggttctcagctatcgacactacactgttaattttgttggccccttgttggggggagtctgctcgtaggtgaccccccccccccctcccccgggttcgacgtagatgaaacacacgcgggcagattgttaggatttttcaggcggggaggtggcgacatgctgttatagatggtgacaagactttatataatggaaatgcaggtgtttttgaaaaaaaaaaaaaaaaaaaaaaaaaaaaaaaaaaa

SEQ ID NO: 760 - DNA, 1269 bp, Zea mays
  CDS (6)..(1097)
tagcaatgtcggggatggcggcgcgcatcggcgagtggaagccggtgatggcgatgctcatcttcgacctcatctccgccgtgacgacggccctgatcaagaaggcgctgcaggaggggctggaccgcctggtgctcatcacgctgcggcagctcgtggccaccgtcttcctcgcgccgatcgcctacttcagagagcggagcacgaggcctaagctgacactggagatcctagtctacctcttcttcagcgcagcgtttggcgccgctctctcccagtacaccttcttctacgggctgcagtacaccaccgcgacgttcgccataactttcaccaacgtggctcctgtgctcactttcctcattgcagtcttgctaagggtggagtcactgagcatgaagaacaaggcaggagcagcgaagatcgccgggacgctgacgtcgttcgccggcgtcatgctcctcaccctctacaagggcgtctcactgacgcaccagcaagctggagaagcgagcccggaggatcacaacctcggagcagcagcagcatcgccgtctgacaggaagagctggacgctgggcaccctggcattgctcgccaactgcctgtgcttctccttctggctcctgctgcagtccaggctgaccaagaagtacccggcgctctactccagcacggcctacatgttcctcatcagctcgatgcagggaggggccctcacggcggccattcagaggcgagcgtcggtgtggcttctcacaaggccgatagagatcgtcacggtcttatatacaggaatcatggggtccggagtgggctacgtgctgatgacgtggtgcgtggagaagcgagggccggtgttcacgtcagccttcatccctgtcatccagatcatggtcgccatggtcgacttcttctttctccatgagaatctctatctcgggagtgttctgggatccatactcttgatcctgggcctctatattctgctgtggggaaagaagagggatgcctcatcatcagcggctgccaaggaagaggaagatggagagaaagaagatgaggaggaggaggacaaagagaagcaagtcagatcatgaggaccagaccactctcatatatatatatggattaggaccaaattaaagatacagttcttcggactgtgtgatgatctatacttgacagagatatatatatatatagtatttgtttaatatataactctgctagtatatatagtatttgttctgaattcaaaatcaaaaa

SEQ ID NO: 761 - DNA, 1622 bp, Zea mays
  CDS (149)..(1375)
cccacgcgtccggcaagcacactgctcctccctccccagccgcagcacagcagagcagagccgagtttgctgctgctgacctgacaccatcgtgtgcccctctctcggtccagaaggacgcgaaccgcgctcgtagagtgtggcagcaatggcggtcgtcgccggagacagcgagtcgctgatgcagcggtgcaagccgtacgtggcgatgatctcgctgcagttcgggtacgccggcatgaacgtcatcaccaaggtgtcgctcaaccacggcatgagccactacgtgctcgtcgtctaccgccacgccttcgccacgctctccatcgcgcccttcgcgctcgtgctcgagcgcaaggtccgccccaggatgacgctctgggccttcctccagatcttcgtcctcgcgctgctcgggccggtgatcgaccagaacttctactacgcggggctcaagttcacctcgccgaccttctcctgcgccatgagcaacatgctccccgccatgaccttcgtcctggccgtgctcttcaggatggagaaggtgaacctgaagaaggcgaggtgcgtggccaaggtggtaggaacgctcgtgacggtggccggcgccatgctcatgacgctctacaagggccgcgtcgtcgagttggtctggaccaagcacatacacctccacggcccgcacccggacgccgccgctgctgccgccgccgccgacaaggactggttcaccggctccattttcctcatcatcgctaccctcgcctgggcgtccctcttcatcctccaggccgccacgctgaagaggtacgacgcgccgctgtcgctgaccaccctcatctgcttcgtgggcaccctgcaggccatcgtcgtcaccttcgtcatggagcgcgagccctccgtgtggaggatcggcttcgacatgaacctcctagccgccgcctacgctggcatagtgacgtccagcattgcctactacgtgcaagggctggtgatccagagccggggccctgtcttcgcctccgccttcagccccctcatgatgatcatcgtcgccatcatgggctccttcatcctcgcagagaacatctacctcggcgggatcatcgggtccgtgctgattgtcgccggcctgtactcggtgctgtggggtaagcacaaagagaacgaggagaaggagggagaggcggccatggagatccccgtggcgatcaaggccgtcgacggcaatggcaggatcatggagatcgtggagctggacgaggtgcagctggagaaagcccaggccaacaccaacgccaacgccaacgcggccgtcgccgtcacggcggtccccgcggcggaggcccggatgcagggcaaggacgaccaggcttaagctacaggagatgcgccgatcgacgggtcgatcgcgcgcgtgcgtcatcttagccctcctgtgctgtgcttttgtgcgtcctcttctcccccggccggcccatgatagatgtgttgtagtgtggggcgacctgatgctttaagctagcgacgggcagtagtagtgctagctgtagtagtgaagtggtgccaagatggaagctgaggaggatgcaatataatgatgatggggagttttgtaaaaa

SEQ ID NO: 762 - DNA, 1272 bp, Zea mays
  CDS (153)..(1193)
aggtcaccagttcggtcctgcgctctcgagtcgagactccaccttccattcatttcatctgctccatctctctctttgttcgccggcgtataataagcttcccctttctgcaactgatctgatccgggctgccgtgagctctgctcgccctgatggagttcaagagggatgtatggagcctgctcctcgtgctgctcctcgggcagctcgtcgccttctccatggccgcctcaagctttgcctcctccctcattgctaatcttggagtcgatgccccactgacacagtctttcttagcctacctgttgctgaccttagtctatgtaccaatcgtcctgcgtcgacggcagaagctgcaaatagcttggtactggtacctagctctggccttctttgatgtacaggggaattatcttgttgtgaaggcgtaccagtactcatacattaccagtgtgactttgttggattgctggactgttgtatgggtcgtcatgctcacctggtacgcactgggcacaagatactcactctggcagttcgtgggggcagggacatgtgtggcagggctcgcccttgtgctgctttcagatgcaaaatctcaagatgagcaagatccgaaaaaaataccacttctgggggatgcccttgttattgctgggacagttggttttgcgtttagcaatgttggggaggaatactgtgtcaagaaaaaggatagagctgaggttgttgcaatgcttggtctctttgggttgctgatcagcacagtgcagatacttgtatttgaaaggaagggcctagaagcagttacatggtctccaacaatgataagtctgtttgcaggatttgcagtggcaattttcgtattctacacagttgctcctttcgttcttaagatgagtggagctacattgttcaacctttcactgctaacatctgacatgtgggcagtcgccattcgagttttattctatcagcaagagataaacaggttgtactacctagcattcacagttgtggccattggattaatcatctattcgttgaatgatagatcttcagatgatgaaacagctggaagtacagaagcaccagcccaatatcagcaacttccaattgaagacaattcaacaagaattggttctagttcaggtagccaagaaaggacacataaggaagaagttcatatctgttagtgggataatgtattaatgtacgaagacacttcattgtcaatgcatggatttttactaaaaaaaaaaaaaaaaaagc

SEQ ID NO: 763 - DNA, 1891 bp, Zea mays
  CDS (145)..(1641)
cccacgcgtccgctctctcatctgtaggatgtaaaaaactcagccaggaaagctgctgaaactgttctgttggttattgatgaggaaggagttgaaactttgatacctgagcttctaagaggaatcactgacagtcaggcatcaatgaggcggggctcagcctacctaattggtttcctctttaaaaacactaaactatatttggctgatgaggcttctgatatgatgtcaaccctaataattttgttgagtgatacagacaaggctactgtatcagctgctttagaagcattttcaagagttgttgcatctgttccaaaggaacagctcccaacacacataaaactagtgcgcgatgctgtctctacagccagagataaagagcgtagaaggcgaaagggtgtgcctattcttctgcctggcttatgtctttctaaagcactgcaaccttttcttcctatatttcagcagggtttaattagtgggtcggccgaaacaaaggagcaggcggctgaaggtctaggagagttaattgatgtaacaagcgagaagactcttaaggaagttgtagtgccaattacaggacctcttatccgcatccttggtgatcggtttccatggcaagttaagtcagcaatcctatcaaccctgacaatcatcatcatgaaaggtggaattgcacttaagcccttccttccacaacttcaaactacattcgtgaaatgtctacaggataacaataagtctgtccggacgagggctgcagctgctctcggaaagcttagtgctcttagcacacgggtggatcctttagttagcgatcttctgtccatgttgcagtcaggagatgaatctgtaaaagaaagtgtgctttctgcactcaaaggtgttatcaaacatgctggcaaaagtgtcagtgctccaataaggtcacggggatgtgctcttcttgaagatctgctgcaggctgaagctgatgatatccgcagttgtgctgcaaaagtgattggcacattgtctcagtacatggatgacagagagattccagatttggtgcaaatccttttggaagtgggcacctcatcggactggtgtaccaggcatggtgctttgttagcattatcatccatatcaatgcattctccatcaaaattatgtgatttggcatcctttccatctctggttgatcttctgaaagattctcttaaagacgacaagttccctgttcgtgaagttgctacaagaactctgggaaggatactcgttttcgagctacagtcagaagctgacaccttgcaacttgttcagttgcttgtcttggccttgcgtgatgattctagtgaagttaggagaagatctttgtcgtgtatcaaagctgctgcaaagatgaaccattcagctcttgctacacatcactctatattgggcccggcaattgctgatgctttgaaggactctagcatgcctgtacgtctagcagcggaacggtgtgcccttcatgttttccagttgactaaagggccagataatgttacaacagcgcagaagtacctaggcatgactggcttggaagtgaagaaaatcgcaaagcttaacgaggagagtgatggcagtgagagcagtgatgatgacaggaggacatgacctctactcacagcaagcttgtatcggttcagttattatgatctttatatatagttaggcaagttagctacattgacagtggaaggtggggtcattttttgttctgtctgacccattttgtgaacatcctttttgacaacaaatactggcagaggaagacacgtcggcatttgtcatattttgttgcggcaaaccgacaatgtttatggaaaccaacaatttttgttaaagttattcaatcaaaaaa

SEQ ID NO: 764 - DNA, 1519 bp, Glycine max
  CDS (52)..(1170)
ggctcgagcaaagactgaaggcaaaaaaaacagagaaaggtctggctctgaatgatggatagaaggcactgttacaaggatttgctgccattggtggtgcttgttgccaatgaatgcaacaacacaggcttgttcactctcttcaaagcagccacactgcaagggatgagtaactatgtctttgtcacctatgcctattctgttgcctttcttgtactacttcctgtcacttttttctacagaagatcaagagtggttcctccactcactttttccatcctatccaaaattgcccttcttggagtgatagggtgttcatctcagatcttggggtatgctggcatcaggtatagttctcccacactttcctctgcaatcagcaacctcactcctgctttcaccttcgtgcttgcagtcatttgcaggatggaaaagatagctgtaaaacgtagaacaacccaagctaagatattgggcagcataatatcagtattaggtgcatttgttgtgactttctacaaaggccaatcggtcatcatagctgataattccccttccattcaacttccacaatcaaatggcattcttacttcagtggatagaaattgggtcattggtggccttctgctcacagcttgcaatatactacttactgtatggttcgtttaccaggttgaaatcttgaaggagttcccggatgaactatctatggtcttcttttacaacttgtgtgcagccattgtagcatcaattgtaggcttattaggggagaaaaattcaagtgcatggaaaataagaccagatatatcactgatctctattgtttgcactggaatatttaacaagttcctgagtagtgcaatatatgcttggggaatacacttaaaagggcctgtgtatgtagcaatgttcaagcctctctcaattgttattgcggttgccatgggtgttatgttccttggtgattctctatatgttggaagtataattggagccacaataatatcaattgggttttatactgttatgtggggcaaagcaactgaacagaaggaagaggagggggaggaggaaaatgttggtagccaggaatcatcaattactgagaacgttcctcttttgcaaagctatataactgtaaattctacgaagaaaatagatggaagtgtatagacagctgaaatgagaagtttcctcttctgcaaaaccaaaaaatttgtaaattctgaatagaagacaggtggaagtgtatagaagacaaatataaactgtttgcacctctttagtcttgacattgtagaaaatcatagagaccattttttgtcacagaacagcacattgtaactttcagtaatttatgaaaatacaattctcccatacttactataggttctagttgcagaagcagcctagacaatgggagcatcatgtacctttatacttcagatacaatagtcaatatttctaaggaatgaagccccaaagaagtatcataagttcaaaaaaaaaaaaaaaaagg

SEQ ID NO: 765 - DNA, 1405 bp, Glycine max
  CDS (151)..(1203)
gaattcccgggtcgacccacgcgtccgcccacgcgtccgcccacgcgtccgcccacgcgtccgcccacgcgtccggcgagaagacgacagaaggggaaaaaggatgaggtagagagaaggtgggagtggcagagagaagattacaaagaaatggggagatgggtgaattgtaggggcaatatattcccattcctggggatggtgatggctatgctagctcaaagtggaagcatggtggtaatcaaagttgccatgactgatggaataaacaaatatgtcatggttgtgtactctttggcactctccaccatcttgcttcttccctttgccttgtttcttcacaggtcagagcgtcctcctcttacattctctgcactttgcagtttcttcttgcttgcattctttgggagttcaggacagataatggcttatgttggcatagatctaagctctcctactcttgcatcagccatgcttaatctcattccagctttcacttttatacttgctctcatttttaggatggaagaagtacattggaaacattccagcagccaagccaagttcttaggaacaatagtatcaattgctggagcatttgttgtgatactgtacaagggcccacccatctttaagacacatttgtcaaactcttcgaacaaatttctattttcgcagcaactaaactggatcttgggagggatgttctgtgctggcgattctatagtttgttccctgtggtacatatatcaggcttcggttgcatacaaataccctgctgtaacaaccatagtattcttccaactcttattttcaaccattcagtgtggagtatttgccttaattgtagttcaagatcaaacggaatgggagctgaagttagatattgggttgattggcattgtatatcaggcaattgctgcaacattgatacgttacatcttatgcacgtggtgcgtccttaaagctggacctctgttctgttctatgttcaagcctgtggcaatcatcttctccgttttcatgggtgcaatttttctcggggatgacttaagccttggaagtttgattggtgcggttataatcgtgataggattttatgccgtactgtggggaaaatccatagaagataacaagattgagaaaggggttgagaacttggagtcatcgtgccataatgttcctttattacaaaataggacgtaacaggtaggttgaatatttgacatggagaacaatgtgatattgcaaaacacttaaaaagttagttagaagttgtaatgtttatgtattggtttttcatgtatctatttttaataataataatatttttgagaaaaatgttttccaaaaatattttttagccaaaaaaaaaaaaaaaaaaaaaaaaaaaaaaagcggccgc

SEQ ID NO: 766 - DNA, 1589 bp, Glycine max
  CDS (36)..(1073)
gaattcggctcgagccgaaattctgatctgtgagaatgggaaaaggtggatctctgagcgacggcgtggtgaagaagatcgttctctcctacagctacgtggcaatatggatcttcctgagcttcaccgtcatcgtctacaacaagtacatcctggacaagaagatgtacaactggcccttccccatctccctcaccatgatccacatgtccttctgcgccaccctggccctcctcctcgtccgcgtcttccgcctcgtcgagcccgtctccatgtcccgcgacgtctacctctcctccgtcgtccccatcggcgccctctactccctctccctctggctctccaactccgcctacatctacctctccgtctccttcatccagatgctcaaggccctcatgcctgtcgctgtttactccatcggcgtcatgctccgaaaagaatcctacaaaaacgacaccatgcttaatatgctctccatctccctcggcgtcggcgtcgccgcctacggcgaggcccgcttcgacgcctggggcgtcctcctccagctcggcgccgtcgccttcgaggccacccgcctcgtcatgatccaaatcctcctcacctccaaggggatctcgcttaacccaatcacttctctctactacgtcgcgccgtgctgcctcgtgtttctctctattccgtggatctttgttgagtatcctgttttgagagacacttccagcttccacttcgatttcgtcatcttcgggaccaactccttctgtgcattcgcgctgaatctggccgtgtttcttcttgttgggaagacgtctgcgttgaccatgaatgtggccggtgttgtgaaggattggttgctgattgcgttttcgtggtcggttattaaggacaccgtgacgccgataaatttgttcggctacgggcttgcgttcctcggcgtggcgtattacaatcactcgaagctgcaggcgctcaaggccaaggaggcgcagaagaagaccgcgcaggcagatgaggaggaagggaggttgctcgaggacagagatgacaacaagaggaacgaacagcagacttaacttttatttatttttaatcgttccctgttttattttacacagattcaagaaaggaaaaaaacaaacaagaggtttggtttggttttcgaggcaaatatggaaatgtcatcgtcctctctgggcatattgccggttcggtattgtttttttagttgctagatcttcttcacgttgccaatgcggtgggtagttaattagtagatatgggtttgagatttgagaacaattatgtgttactagagctagagtctccaatccttttattattattattattattattttcttttatctcattcccgttttcggtggttttgttttatgttatgttattgtaggaactcgatttatggagtttacatgcttcttattaattcatagtacatttcaattctgtgtaatgtgaatttgggatttatcttatagccaagctgtctgacaaatttcacttggcactgtgttccgaattactctgtttcggttgtaaaaaaaaaaaaaaaagggcggccgccg

SEQ ID NO: 767 - DNA, 1535 bp, Glycine max
  CDS (69)..(1118)
ggctcgagattatattatccgattcagaattgtgtggactggaaactcctctgtccccaaacaggacgatgaaggaactgggcttggtttcaatgatgctgatggcagagttgttggacgtgatcgtcaacactctaagcaaagcagccatgaagaagggcatgaatgactttgtattcatcatgtactccaatgccttcgctgcatgcctcctccttctcttagccttattcttttataggaaaagaacacttccgccactctcctgtaacacccttggcctattccttgttgttggcatgctcagttgcattaatcagtcgatcaagtttttcggcataggttacagctctccaactttggcctcagcactgtccgatttggtgcccgcctttaccttcatacttgccgtcatcttcaggatggaaaaattagattggaaagctaatagcactctggccaagtccattggcacagtggtatcgatcgctggggcattgttattgtctttgtacaaaggccaagtcatcataaataataatccaccttttaaattgttccctcaaaaacttgtctcatccatgcaatttgactgggtatttggggcactgttgcttgcagctcatagctgttttctctcaataaactacattcttctgacacggatagtgagagaataccctgcagaactggtggtggtactcagtcgcattgcattaacatctatactatctgttcctgctgcactgatttcagtaaaggatctaaaagctttgagactggggtttaatatggagcttatagctattggatgttcagcaatttttgtcttatcctttcgaggtgttatccatatatggatcatggggaagaggggccctgtctatgttgcaatgtttaagccactcgaaattgtcttcgcagtcatcttgggggttacttttcttggggactctctttatattggaagtgtgatcggagctgccataatagttgttggtttttatgctgttatttgggggaaaagtcaagagaaggtggaggaagattgtacagtctgcagctctgagtcatatgataatgaggtccctcttttacagaacaagagaacgggggaataaaatcttcaggaaatgatttatatactttctgcttgtaagcaaagaacgatggcagaaaaatttcaatattcttgtttcctctaaatctgtttccctgggcctgcaagaaatagatattggtcaccgaggacatgaatagaaagattgcataatttgcacaagatattgattttttgggtgccacttattccctacatccaccgagaagggtcagagcggattacaattttctgccattgctgagttgaatgcacacaaatatcaatcagtttgacctttccttctttatttggttcttgtggactttcggatttcacctccagttgttgtatagatcgtctaccaatattatggaatgtgctgtgaaataattaattttagttcttaacaaaaaaaaaaaaaaaaaaaaaaagg

SEQ ID NO: 768 - DNA, 1514 bp, Glycine max
  CDS (55)..(1140)
ggctcgagacctttgcaaaccctttccaacaattagcaaaacatttgttaaacgatggaagtaatgtgtggtgccaaagttggcaatatggtccataaggccaagccttatgtgttaactgtggggttgcaatttgggatggctgggacatacctcttcaccatggccagtttgaaccatggaatgagccgtttggtgttcattgtgtatcgcaatgccattgctgcattggcccttgctccctttgccttgatctttgaaaggaaagttagaccaaagatgacatggactgtcttcatacagatattagtacttggatttcttgagccagtggttgaccaaggattcactttcttggggatgcaatacacttcagcttcctttgcatccgctgttatgaatgccgtgccctctgtaacctttgtgcttgcagtaattttcaggttagagcatataaaaataagggaattacgcagtcaagcgaaagtaattggaaccttagtaacctttgctggggctttgttaatgacactatacaaaggccctcaattcgacctatttcatcattcaaacacaacccaccaacaaggtggaagccacactcagaatcactcacactgggtcgcaggaactctcttcatttgcctgggttgcctggcttggtcttccttctacatattgcagtccataacggtgaaaaggtaccctgcggaactatcactctcatcgttgatatgcttggcgggtgctttgcaaagtgccgtggttgctctgattgcagatcataaccctcgagcatgggctatcggttttgactacagcctctacggtcctctatacactggaataatgagttcaggaatagcatattatatacaagggttggtaatgcaaagcagaggtccagtgtttgtaacatctttcaatcctctttgcatgatcattgttacagctttgggctccttccttctaggagaacacctctacttgggaagcatcattggaggcatcataatcgcagtgggtctatactctgtggtgtggggaaaaggcaaagactataaagatgacacgtcatcaccagcaacaacaaaagaaacagaaacaatgcagcttccaattaccttaccaaataataaataacagacactttgtgttaacttatagaaaagaaaaattacatagtaattcgatcgacttatgttggcggaagtgaccgatgatagcgtaatttgcaaatcatatagtgatttgttgtgctggtgtgggcactatatttagccatgttaagttgaaacacgactttgtttaagttaatactaatttgttagaaagtgttttgctatcgttaattattccaagagtttaaattgttaatcaatgtgtaattttattttcttcctgcttttgtattttttttatcatgatatatgatatattagtgcggaatatttatcacgatgaaatcagatagctggtttaataaaaccaaaaaaaaaaaaaaaaaaaaaagg

SEQ ID NO: 769 - DNA, 1596 bp, Glycine max
  CDS (36)..(1271)
ggctcgagacactacccactcaactcactccaaccatggcgtcgtggtggtgctcctctccctccgccaccctcaccgtctccaccaccaccacccgccacttctctctcctttctcacacttcccaatttcgcatccaaaccctcacattcccaccttcctcctttactcgcttcaccaccgctccaccttcgctccgatttagggttccatgctccaacaaaaccgccttcgaaaccgagcttccggaggacggcgtggattgcgtgggaacaggccaagacgtggaatgcctcgttaacacggaagagaaacaatcggaaccatcatcatcgtcatcatcatcatcatcatcgtcatcgatgctgtgtctcgcggaagcgctgtgggaaggggcggtgttggtgtcgccgttcttcttctggggcacggccatggtggcgatgaaggaagtgcttcccaaatgcggtcctttcttcgtttccgcttttcgcctcattccggcggggtttcttctcgtcgcattcgccgcttccagaggaagaactctcccctctggcttcaacgcttggctttccatcaccctcttcgctctcgtcgatgccgcgtgctttcagggttttcttgcagaagggttgcaaaggacttcagctggtttgggcagcgttataattgattcgcagcctttgactgtggctgtacttgcggctttgttatttggtgagtcaatcggagttgttggagctgctgggcttgtacttggtgtcataggacttgtactgctcgagttacctgccctatcatttgatgaaagcaacttctcactatggggaagtggtgagtggtggatgctacttgcagctcagagtatggcaattggcacggtcatggtccggtgggtctccaagtactctgaccctgtcatggctactggatggcatatggttattggtggtctcccacttgtgctattcgcagttcttaacaatgaccccgcagtgagtttgagtctcaaagagtacagttcgactgatatattggcactcctctacacatccatttttggaagcgcagtcagctatggtgtgttcttttatagtgcaactaaaggtagcttgaccaagctcagttcacttacgtttttgaccccaatgtttgcttcaatttttgggtttctctatcttggtgagaccttctctcctgtacaactagttggggccttagtcactgtggctggaatatacatggttaacttcagaagcacatctgaatgaattgtcatttttgcctggttctttcaacctaatccaatggaaaacaactctgggaattagatgttttccatgaactcaaattgggaacgataaaagcaagtttggacatggagaggagaaattgcagtgatatacaacttggagcccttgtgctcatgctagtgtaaatacaattttgttttgttagttaatttaggcctcgagcctcttcctatgcaatatataccaaaaacttgaagttacctgggcagaacacaagccttatatcggaataaattgtttccgtaaaggtttttttgttgtaaaaaaaaaaaaaaaaagg

SEQ ID NO: 770 - DNA, 1623 bp, Glycine max
  CDS (228)..(1226)
cgcaaacgcaactcagctttccttcgatccctgaatctggacgttactaaagcagcccagccatccacgcaccattttaaaagccaacacagaaagcacagaaccaccacatcgttgccttcctctaaacgataaatttttgggattctgaaactagtgatacattttcttgcatgaaggcagcgtattgaggaattcagttagtgtattggaagatctagttcaacatgtcttctgtaagcaagggtgataggaaggcttccattgatgcagcatcatggctgttcaatgtggtcacgtctgtgggaattattcttgtcaataaggccttgatggctacatatggttttagttttgctacaactttaactggtctccattttgccacgacaaccttgttgacactcattcttaaatcgttgggatatatccagacctctcatcttccattatctgatataatcaaatttgtcttgtttgcaaatttctccattgttgggatgaatgtgagtttaatgtggaactctgttggtttctatcagattgctaagctgagcatgattccagtatcttgcttcctggaggttgtcttggacaatgtacgatattcaagggacacaaagcttagtattgttttggttttgctcggcgttgctgtctgtacagtcactgatgtcagtgtcaatgcaaagggtttcatagctgctgtaatagcagtttggagcacagccctgcaacagtattacgtgcattttcttcagaggaagtattctattgggtcatttaacttgttgggccatactgcaccagcacaggcagcaagtttacttctagtaggcccctttatggactactggttgactggcaaacgagttgatgcctacggctatggtttgacatccacgttgttcatcattctgtcttgcactatcgcagtagggacaaacctcagccagttcatctgcattggtaggttcacggctgtaacgttccaagtccttggtcacatgaagactatcctggtcctgatcttaggattcattttctttggaaaagagggtctcaatctacatgttgttctaggcatgatcatcgcaatagcaggaatggtttggtatggcagtgcttcttccaagccaggggggaaagagcgtcgtagcttttccctccccaaaacacaagattatagttcactacctgtgtcctctgaaccagatacgaaggaatagaaaataatagaaactaattagagaaaaagtgatgaaacttctggtgaactgcatgaaaaaaatcaggtgcccattaggcgagctggttcattttctttataccaggagtgaattcccaattatttatagatcatggttatatcttttcttatgtgttaatgaattgtttgggaaagaaatgagaggaaacagcgttaagggatggaaaaatctacgttatgttcctttttttttatgacagaaaatgttactgttacttttatagtaaaagtttaattccatttttcccattagggttggttccgttgttaccttctactcatgacaactattagcatgtttggattacctagttatgaaatgttttactctataaaatacttttgaaagtttt

SEQ ID NO: 771 - DNA, 1452 bp, Glycine max
  CDS (140)..(1126)
gaattcggctcgagactccgcaatgctgatttccattctctcttagtgtcagtcttattcctcccgaacccgaaattcagtccttaaatgataaataatatcccagttgtttctgctaaacttgggggagtaggaaaacatggccactttcgagcaattttggagcagaaaaacgttactaggtcttgctttgggacagtttctttctctcctcatcacttccactggtttcacctcttctctattggctaaaaaaggaattaatgcaccaacttctcagtcgtttctaaactatgtgttcttggcaattgtctatgggattattgttctatacagaagggaagcactcaaggcaaaatggtattattacatacttcttggattggttgatgttgaagcaaattttcttgttgtgaaggcatatcaatatacatcactaacaagtgtgatgctgcttgactgctggtccatcccatgtgtcatgctttttacatggattttcttaaaaacaaaatatggattcaaaaaggtcactggtgtagttgtttgcattgctggccttgtcctggttgtattttcagatgtccatgcaggcgaccgggcagggggaagcaaccctagtataggggacattcttgttattgctggtgctacattgtatgctgtcagtaacgtcagcgaggagtttctagtgaaaaatgctgatagagttgagttgatggcaatgttgggactctttggtggcattattagtgccattcaaataagcatacttgagcgcaatgagctcaaatctattcactggtcagctggggcagttcttccttttgttggatttgcggtggctatgtttatgttttactctttagtccctgtcctacttaagatcaatggttccactatgttaaatctgtctctattgacctctgacatgtgggctgtcttaattcgcatttttgcttaccatgagaaggttgattggatgtactatgtggcctttggtgctgttgttgttggtctcattatctactctggtggtgacggagatgagaatcaagaccctcatcatgttgctgaagatgctagccaaagacaacatgatgaagaagctacttcaggtaaatcataatataacagcagccaggctggaagctcaaaacactaagcacgcctgaagaggtgcttgaaaggtaaaaccatgacagagtctcctccaaagatgaagattttacttccattcaatttgtgtagatggaattttgagtgttttggacggttttttgaaagttggtactagatttttagtgaacatagtttgctaaatatgatatttaattatttttgaagaaaatctataagaaagattttcggagataataagtaacagccgtttattttttcgtatgaaatttgggatgttcgattaaaaaaaaaaaaaaagggcggccgccg

SEQ ID NO: 772 - DNA, 1573 bp, Glycine max
  CDS (61)..(1173)
cggctcgagcggaaagatcaggctttgctttgctttgtgtgagatctgaagaagagaggtatggcaaaaagggtcttcttgtacaaggatttggttccttttggggccatggtgaccatggaatgcctcaacgtagccttgaatactctgttcaaagcagctaccttgagagggatgagttaccatgtctttgttgtttatgcttatgctgttgctgctattgttctcattcctggaccctttatctcccaaaggtgcagatcaagagtgcttcctccgctcagtttccccctactacgcaaaattggtcttctcgggctaatagggtgtgcttctcagatcgtgggatacacaggcatcagtttcagttcccccactctctcctcggcgataagcaacttggtgcccgcttttacttttttgcttgccatcattttcaggatggaaaaggtgattgtaagaaatacaacttgtcaagccaaggtattgggtaccatagtatcaataactggagcattcgtagtgaccttctacaaaggaccaccaatcatcattgttcatacaccttccttgtcacttcatcaaccaattaacactctgaattcggtagatcgaagttgggcaattggtggccttctactgacagcagagtatattctggttccattatggtacattgtacaggtgcaaatcatgaaggtgtaccccaatgaactaactgtgatcttcttttacaatttatgtgtaagcatcatggctgcaattgtagctatatttacagagacaaatgcaggagcttggaaaataggactagatacagcattggcttcaatagtttgctctggaatttttggttcatttgtgaacaacgcagttcacacatgggtactacgtataaagggtcctgtctatgtggcaatgttcaagccactctcaattgccatagctgttgccttgggagtcatgttcctgggtgatacactccaccttggaagtctagtgggagccacagtaatatcgatcggattttatacagtaatgtggggaaaagcaaccgaagagaatgtggacgaagatgtccctggccagcaatcaccaccaaccacagagaatgttcctctcttgcaaagctataaaactgatacagctgaaaagaaaatgcatggaagtgtataaatgacaaacaaaactgttgataaatcttaacattattgaaattacacgaatagcaaagcaaatacatggttttgttttcgcccaagctaaccctgtaacgccaatagcaattagcaaagtaggtacccacgcctttagagtgtagaggacatcatatgtaagaaatagttcaagggttcaactgatctcctttcgccaaggaacataaacgaatctttatacaaattagggagcaacctatctacaagtttgtgtacgaacactcacagatgaaaacggagcaacttcgttatctgtcttcccttttcctgtctcttgtaacaagtcatccatattatgatttatagaagctgcgtgattctttaacattaaaaaaaaaaaaaaagggcggccgccg

SEQ ID NO: 773 - DNA, 1677 bp, Glycine max
  CDS (99)..(1265)
ggctcgagactacacaagaactagctataggcctcaattagttattatattaatttggtctaagtagttgttattacttgtgtagtagttcttctccaatggctgatttaggttcagcctcttccaagagaatgtggtgttccgttccagaaagaatgcagcttcacttggccatgttggccttgcagtttggctatgctggattccatgttgtctcaagagctgcacttaacatgggcgttagcaagcttgttttcccagtctatcggaacatcattgccttgcttctgctccttccctttgcctacttcttggaaaagaaggataggccagccatgactttaaacttcgtctgccagttctttcttctggcacttgtcgggattacagcaaaccaaggtttctacttgctagggttggagaacacatcccctaccttcgcatcagcaatacagaactcagtcccagccattacatttctcatggcagccatattaagaatagagcaagtgagattgaaccgaaaagatgggttgggtaaggtggcgggaacagtgctatgtgtggttggagccaccgtgatcacactatacaaaggtccaacaatatatagcccaacaactggtgtgaacataaacaacacaagagtgacacaagtgtttgaattggggtcagtgtcactgggagatgcaaaggggaagaactggaccctagggtgcttatacctcattggacactgcttgtcgtggtctggttggcttgtgttgcaagcaccggttctcaagaagtacccggctcgcctctctgtcacttcctacacctgtttctttggactcttgcagtttctcgtcattgctttgctccttgaaagagacgcgcaggcatggcttttccactctggtggagaagctttcactattttatacgcgggagtggtggcatctggaattgccttcgctgtacaaatatggtgcattgacagaggtggtcctgtgtttgttgccgtctatcaacctgttcagacttttgttgtcgccatcatggcttccattgctttaggagaagagttttacttgggcgggatcattggtgccgtgttgattgtagcgggactgtaccttgtcttgtggggtaagagtgaagagaggaagtttgcaagggagcagcttgcgattgcatccactgagcatagcatcataaggcccgcaagccacgccaaagcatcacttgctcagccactcctttcttcatcaacagagaatgtttgaacaagatcaaaattccaacttcaaaccacacaccattttcttggtgagaagaagtaaaagaaaaaaggggaaaaaagataccagctataccttactagttactactgctactactacattatgtcagcaagtttgtgtgtgttggaaccggttttcatcttttcctttctttttttttttatttaattcaaatgcttttttagtaggtcatttagaatatgagagaattgtgggaatggttgtaatggtggatgccactttaagtggggctagagcctgaaatccccccatatgcttttgtatgtcaattaatttatggtttgatttaagaaatgaatttttgttttttgggtcaaaaaaaaaaaaaaaaaaaaaaaaaaaaaaaaaaaaaaaaaaaaaaaaaaaaagg

SEQ ID NO: 774 - DNA, 1441 bp, Glycine max
  CDS (167)..(1084)
ggctcgagtacaagttaacgagttatgggagctccccggacctcagttttaaaggggctttagggcgttaaaaagaaagcgcagagaaaggtgttgttctcagatccatccatcagtggtgggcgatgttgttgttctcagatccagactgagggggtgaaggaaaatgaagtcgtcgaggcgtctgttgaggatcgggcttgtgtcggcgtggtactcgtcgaacattggggtgctgctcctgaacaagtacctccttagcaactatggcttcaagtaccctatcttcctcaccatgtgtcacatgaccgcttgctccctcttcagctacgtcgccatcgcctggctcaagatggtccccatgcagaccatccgctcccgcctccagttcctcaagatcgccgccctcagcctcatcttctgcttctccgtcgtcttcggcaacgtctctctccgctacctccccgtctcttttaaccaggccgtcggcgccaccactcccttcttcaccgccgttttcgcttacgtcatgaccttcaagcgcgaggcctggctcacctatctcaccctcgtccccgtcgtcaccggcgtcgtcattgccagcgggggtgagccgagcttccatttatttgggttcatagtatgcattgcagctactgccgcacgtgccttaaaatccgtgttacaaggaattttgctttcttctgaaggagagaagttgaattctatgaaccttcttctttacatggctccaattgctgttgttttccttcttcctgctacacttataatggaagaaaacgtggttggcattacattggctcttgccagagatgatgtgaagatcatttggtatctgctatttaattcagcacttgcttattttgtcaacctgaccaattttttggtcaccaaacataccagtgctcttacccttcaggtgcttgggaatgctaaaggggccgtagcagtagtagtttcaattctgatatttagaaacccagtgtcagtcactggaatgatgggttattcactcacagtcctcggagttgtactttatagtcaagccaaaaagcgaagcaagtgatactgatgctgtctgtcattcatgattctgtggaaatcagcagtgaattccctatatttgttttcattcctgtgcggacaaactcaagattccatgaggcaaatttgttagcatgattgtgatcagaatgtttcagactctacaattttttggccctacatggaaaaacgggtttcccattgtattagtacctgtgcagaaatagcccacagtacaaagtttcaataagtgactgatctctctactatacccatgttggcatataatcgaggaatgtctttttgtcatttattctttgaagaaagagttgtagaaggacctctactcatttgttgttaaaaaaaaaaaaaaagg

SEQ ID NO: 775 - DNA, 1535 bp, Glycine max
  CDS (158)..(1258)
ccacgcgtccgctttaatttgtctcttacttcacgcaagttgttcacggctcctctttatatgtacacgtactatctctcatgcatttcattcatcacatacaacactctctccaaagttcaaattaagactgagaggtgagaaagagagaattcatatgggtgccggtctagttgcgttcctcttaatggttcttgtgcaattggtctatgcagtgatgaacattacttcaaagcttgcaatagaatctggaatgagccctcttgtccttgttgcttatcgacaactctttgctactgtgtccattgctccctttgcttattggctcgagtggaatacgcttcccaggattacacagcgtcttatgattcagatattattttcgtccctgaccggagttacaggaaatcagatgctttattttgtggggctgaaatattcatccgctacaattgcatgtgcactgacaaatttgctcccagctttcactttcatccttgcagttctcttcagacaagagaatttgggaatcaagaagagggctggtctagcaaaggtattcgggacaatattgtgtgtgagtggagccttgcttttgtcattttaccatggaaaaaccattggtttaggccaatcaagtattcactggagatatgctgagaaaatggaaggaactagctcttctggcaaaggaaacatgttcctaggccctttggtcgtaattcttagcacccttgtttgggcagcatggttcataattcaaaaagacataagcaagacatttccagctccttacacgagcactggcttaatgtgtttcatggcaagctttcaatgcgtgatcattgccgtgtgtgtcgaccacagggcctcagcttggtcactccacaatgctatgagactttcctctgccctttatgcgggaatattttgcactggattagcctattgcctcatgtcgtggaccattgagagaaaaggtcctctttatgtctctgtatttacccctttgcagcttgtcctcactgccattttgagctgggctttgcttcgggagaaattatatgttggaactgccgtagggtctctcttgatagttttgggactctattctgttctctggggaaagagtgaagaggtgaataagggagacggtattgaagaagatgcagttaaagaagcagtcaaggattcgaagaatgacatggaattgcaatcatatgtgccatccaatggtaataatggtcgggttattgcatgaagaagggacgaggcagagtgagattcctcgcaagatgctagtagctaaggattgagaaagtttcggttatttgtctttattttatttttgctctctaccagtaaatttgaattttgatatgtgtaatcttgtgtcacatttgaaaggggttcacaactctttgcagttgcattgaagacatgtattaatattattattattattatttatatattaatcaacccggaatcagttattccattaaaaaaaaaaaaaaaaaaaaaaaaaaaaaaag

SEQ ID NO: 776 - DNA, 1583 bp, Glycine max
  CDS (250)..(1284)
ccacgcgtccgacgacagaagggggattcaattgaaattcgagtttcctttttaatcacctggtttttttttttaaatttgaaggagatccaatccaaatgcatcgaatgccaatcacctgaaattccgccagatctctccctcttacacgctcttgataaaccgaaacgaagcaatagctatagcatcacacacacacaccaccgctagggttagggttagggttgggggtgttccgaagtaacaacaatggcggtctccgacggcgtcgtgaagaaaatcgtcctctcctacacctacgtcgcgatatggatcttcctcagcttcacggtcatcgtgtacaacaagtacattctggatcgcaagatgtacaactggccctacccgatctcgctcaccatgatccacatggcgttctgctcctccctcgcgtacattctcgttcgcgtcttgaagctcgttgaaccggtttcgatgtcgcgtgatctctacctcaaatccgttgttccaatcggtgcactctatccactttccctctggttttccaattccgcgtatatatacctctctgtttcgttcattcagatgctcaaggcgcttatgcctgtcgcggtttattcaattggtgttattttcaaaaaagaggcctttaagaacgagaccatggcgaacatggtttccatctcgctcggtgtagcggttgcggcttacggcgaagccaaattcgatgcatggggtgttaccctgcagcttatggcggttgcgtttgaggcaacacggttggttctgattcaaattttgctcaattcgaaggggatttcgctgaaccctatcacctcgctttactacattgctccctgttgcttggtgttcttgtccgtgccttggattatcatggagtacccttcgttgagggacaactctagcttccatttggatttcgcgattttcggcacgaattcggcttgtgctttcgcgttgaacctcgcagttttcttgctggtgggaaagacttcggctttgacaatgaatgttgctggggtggtcaaggattggcttttgattgcgttctcttggtctgtgataaaggacactgtgaccccgattaacttgattggttacgggttggcgtttttgggggttgcgtattataatcattgcaagttgcaggctttgaaggcttcggaggcgcagaagaaggctctgcaggctgatgaagaggctgggaggttgttggagcagaaggatggagaagggactggaaggaagaacgacaaccagaactgattcaagtgctgatctcattatttggtcactctcttcgattaatgttggatgacgcaggttttgtttttggttttgttctgtaatgtactctgctattaggtaattattattatcgtcgtcgttattgttattatcgttataattatattattattatgatgttacatgttacttctcacagtttaattttcatacccatatttagttatgtattggaggctgagattgacttttgttccttatattactgattcgtgtttatgggtaaaaaaaaaagaaaaaaaaaaaaaaaaaaa

SEQ ID NO: 777 - DNA, 1653 bp, Glycine max
  CDS (96)..(1157)
ccacgcgtccgcaactacacttcagatctggcaccatcaccccaaacctaaaaaacaaaacatcatcgtactatttcccatttggcggcgcggcgatggtggaggcgcagacatggacgacgcggcgaatgagcaaccctcggctggacaccagcacgacggaccaagtactggacattccccccacacccccgggggagctccgcaacagcttcggatcgaaccctaacaacctctccccgaccctgttaactgctctcatcatttcatcttggtacctctcgaacatcggagttcttctcttaaacaagtacctcctcagcttctacggctaccgcttccctatcttcctcacaatgctccacatgctatcatgcgccgcttattcctacgcctccatcaacttccttgaactcgttcctctccagcacatccactccaagaagcagttcctcaagatcttcgctctcagcgccatcttctgcttctccgtcgtctgcggcaacacctccctccgctacctccccgtctccttcaaccaggccatcggcgcaacgaccccgttcttcaccgcgatttttgcgtttttgatcacatgcaagaaggagactggggaggtttacctcgccctgttgccggtggtgttcggtatcgtcgtggcgagcaacagtgaacccctttttcatttgtttgggtttctggtctgtgtcggttccaccgctggtcgcgctttgaagtctgtggttcaggggattttgttgacttctgaagcggagaagcttcactccatgaacttgcttctctacatggcacccttggcggcgatgattttgttgccgttcacgctctacattgaaggaaatgtgctggctttgactattgagaaggcgaaaggtgacccctttattgtgttcttgctgcttgggaatgccaccgtggcttatttggtgaacttgacgaatttcttggtgacgaagcacacgagtgctttgacgctgcaggtgttggggaatgccaaggcggcggtggcggcggtggtttcggttttgatcttcaggaatccggtgacggttatgggaatggccgggttcggaatcaccataatgggggtggtgctttacagtgaggccaagaagaggtccaaagttacgactcattgattcattcgcacgcacgccgttttggtttcttttttggcttttatcataacaccttattcttcgggtatttttctttctttctttgtttttattgatattgcacaatttagtttgatttaattttatcattatatttccgtggaattgggtcgaattaattacagcaattggactgtataggaaggaaggaaggagaagcagaaaatggggtgggagtgggagggattattattacttggtgttgttgttgggtttctgttggccgttgtgtaagcttatatatgaaacgctctatgccctttggcaacatacataaaaacgttcaaagaacgaaaaaccttatgtgtatttggctagggaggaaaattctccctccctgcattttgttgatcacatcatcatccatttttttttggcttttttgtcatttggtgttttgttagctttaattttgattcgtttgtgaggttcgagctaaaaaaaaaaaaaaaag

SEQ ID NO: 778 - DNA, 3009 bp, Oryza sativa
  CDS (76)..(2808)
  unsure (1)..(3009): unsure at all n locations
cgacgagtatcccgaccaccactctctctctctctctactctccctcctcgccgcgccgcgccgccgccgccgccatgagcgcgggctggaggacgctgctgctgcggatcggcgacaggtgcccggagtacgggggctccgtcgaccacaaggagcacatcgaaacttgttatggtgtgctttgtcgagaatacgaacactccaaagatgcaatgtttgagtttctcctccaatgtgcagatcaattgcctcacaagattcctttctttggagtattgataggtttgataaacttggaaaatgaagatttttccaagggtattgtcgatacaacacatgccaatttacaggatgccttgcataatgaaaatcgtgacagaatcaggatattgctgcgntttctctgtggcctgatgtgcagcaaagttgtcctgccaaattctattattgaaacatttgaggcactattatcatctgctgcaacaatattagatgaggaaaccggaaatccttcgtggcaaccacgtgctgatttctatgtttattgtatcttggcttcccttccatggggtggctcagaattgtttgagcaagttccagatgaatttgagagagttctggttggtatacagtcttatataagcattagaaggcattttgatgatattgctttctcagtctttgaaacagatgaaggcaactctcccaacaaaaaggatttcatcgaagatttatgggagcgtattcaagttctttctcgcaatgggtggaaggttaagagtgttccaaaacctcacctgtcgtttgaagctcagctggtagctggagtttctcaccgtttctccccaattagttgcccccacctactatctcgcaatgcatcctctgaaatagtaaaaggtcaagaaaagcatgaagctgatctgaagtatcctcaaaggcttcgtaggcttcacatatttccaacaaataaagctgagaacatgcaacctgtagatcgttttgttgttgaagaatgcatattggatgtgctacttttcttcaatggatgtcgcaaagaatgtgcattttatctggtcagcttacctgtgcctttccgttatgaatacctgatggctgagaccatattttcacagctactgttattgccgaatccccctttcaggccaatttactataccttggttattatcgacctttgcaaggcattgccaggtgcatttccttcagttgtggtaggagcagtacatgctctttttgacagaattagcaacatggatatggagtgccgcacccgacttatcctatggttttcacatcacttgtcaaattttcagttcatttggccttggcaggagtgggcttacgtcaaggaccttccaaaatgggctccacagcgtgtttttgtccaagaagtattagaaagggaaattcgcttgtcctactttgacaaaattaagcagagcatagaggatgctgttgaattggaagaactgttacccccaaaagctgggcctaacttcagatatcatagtgatgaaggcaaagaaagcactgatggccacagactctccaaggaacttgttgccatggttagaggaaggaagacacaaggtgatattatttcatgggtagacgaaaaaataattcctgtaaatggtgccaaatttgcacttgatgtagttagccagacacttctggacattggctcaaaaagtttcacccatcttatcactgttttggagagatatggtcaaataatatcaaagctgtgcccgaatgaagaaatgcagttattgttgatggatgaagtcagtgcttattggaagaacagtacccagatgattgccatagctattgataggatgatgggttatcgcctactttccaatctggctatagtcaaatgggttttttctcctgctaatgttgatcaatttcatgtttcagatcgtccatgggagattcttagaaatgctgttagtaaaacatacaatcggatttttgacctccggaaagaaattcagacactcaggaaaggtcttcaagctgctaaagaggccagtgaaaaggccgccagagagttggaggaggctaaatctattattgagattgtagatggccaacctgtgccatctgaaaatccaggaaggctaagacgacttcaagcgcgtgctgacaaagcgaaagaaggagaagtaaccactgaagaatctttagaagcaaaggaggccctccttgctcgagggcttgaagaaagcaaggaattgcttaggttactattcaagagctttgttgaagtgctaactgaacgtttgccacctatttctgctgatggagatgttcctaatttacgtgctggagacccgaatgtaaattcttcagcccgtgaccctgaagcaacaaccatggaaatagacaatgaaaatggaggagataacgatagtcagctgaatggtcaaaacaagaaaatcagtcacaatgttggagagcttgagcaatggtgtctctgcacattgggctatctcaagtcgttttctcgtcaatatgctactgagatctggtcccatattgccatgttggatcaggagattttcgttgggaatattcaccctcttatccggaaagctgcttctccggtttgtgcagacctaccagtgaagggtctcacctttgattttgacccttccagtgagttggagtttacctgtattatacgcgacaaatttttcatcatgctatcactaactggacatgcccaaaagtactctgatgtgtactcaggaactccatcgattctcctgtaatcctggccccgaggaacacccttggtggaaagcactgtaacgactttaggtgattaaattatcagttaggtttatttgaattgtagtggactaattttcttgggtgagtaattgctatggtctagctttcttaattccctctgcctgtgttagacaacgccgtgtttattgataagctgatctgaagctgtgattatcttt

SEQ ID NO: 779 - DNA, 4223 bp, Saccharomyces cerevisiae
  CDS (908)..(3484)
atcgataaaaagggaaactgaattagaagaaagaatacggctgtatgaaaccaataattcagcaccatcttttgacgattcttcgagtgtgtctttttctgactttgaaaaggaactgagaaaaaaatccagtaaaattgtgcaattgatccagcaattaaatgacgagagattaaagagattcattgcggaggagcagttattactccaagaaaatggcaccaaaccaagttctatggaactagtaggaagaattgaaaacttgaataaacttattgatgagagagattcagaaattgaaatgcttaaaggacgtttacagtagatgaatgatgtattttattgtatatatcgcttagtgcaccaaaatcatactacgtaagtataaaatcactttacacgtagaagatgctttttcagattgttcttgaaaaagttgaaaaaaatataattcacactcagcaacaggtgaaagtgtataatgggtaaaaaaggaaggacagaaggtatattgctaatcaaaacgactttggtatacgcgtttggggctacaattgcattttaaatatatttaagatgtttaatagaaaaagaagaggaggtatgttttaaaaccaatgttttccagaagtttcgttctagagtgtgtatatcaagaccaattaggatggtatttccattttttgtcagttagtacggtgtgacagaaaagtgtacttttgtggcacagagaagtggagaaacggtacacgtagaatacataacggcaagtaacctctcttattttactctccatctttactttgttttacattcctaggattattaggttagcttggttttacaaaaactcaattattcagtttcattcaaattactaacatacccaactttgactaccttgcatatgattttaccgttagacttcgatgaagatgaaaattaccgtgattttaggcctcgcatgcctaaaagacagagaatcccacctgttgtacaactgtgtaaagaaatgatgcccgatattcgcactattggtgaatctgttaaagcttttgaagatgatatcaaattcttgagtgaagctataatgaatgagtatggccatgaggactactttaataatgctttactgagcactttaaacgctgttgttgtggagcaaccacagaagcaagctgctatcgctctcttaaccatggttgttaattcgaaaaataatgttgccggaaagagtattatcaattacttcttcgaagaattacaaaaatggtgcaagcaaacatataatgatgaattcaagagtacgtcaaatgaaactgggccatggaacaagatcaagttaatcctgagatttttatccattctatcgcccatgtttttagttgatgaactaatcaatatctacaagagcttatttgaattgagtatcgaattaaacaatctggatccaggtaacagagttcctttatctgaagcaatttacaccaatacattattaaatatcccgtatttgttcttttttaataggaataatgacggtttgaggacaaaagtggaggagttacttgcatacgttgaacaaaactatctagttaaaacaacggatataaacctattaagagaatacaatggtgaacctccatatgaaatggtagaacttgtccgagtcgtattaccaaacgtcaagaaggcgctaatcaataacttggaacagctgaatgaattatttcctgattggaatcatttattaactccccaaaccggtgatgaagggttcaatgacgctttaacccttccatcagtagatgatctaaagtctttcgtgcgcttgaataaaaactttggttcagttgatagcatgtggaagacaccaaggtatgcttttcatgtttacttgccaaactccgctggtaatttcgaaacagttgtaccaatcagcacttatgctggtcaattattcaacgatatcattattgatctggtggaaagtttagaattcaatagaaaggaagtagctagacaagtgataactttggatctttttttcaaagcaggtatatttacagaacctggtgaatctattgcccaattaattgccacttatgaagagaacccattggctcctacatttaagatagaagatttggctattgaaaccattttgggacttatttttaaattacctagtgtttcccagccttttgcatacttttacactttattggtggatatttgtcaaaattctccaaaagcaattgctcctgtctttggtagagcctttaggtttttttatagtcatttggattcattagattttgaactaaaattaagatatttggactggttttcaattcaaatgagcaactttaatttttcttggaagtggaatgaatgggaagacgattcgatcaaatttggcaagtatttttataatccaaaggtaaattttgctaaaaatttgattcaaaaagaactacgattgacctctaacttttcagaagtagaggacagcctaccacaagaattcacgaaatatttggatacttcttacattccaagagatcaactgattaactactatcaatcattattcaccggttatacggtagaagaagattccgttagaaaaaatgatctatattttagacaagaaggtgtacctatggaaaacacagtccgtaaaattttagattatacccacaaagcaaacaattctagggaagttactgaattagaaagtattctaggtgagttaaagaatgagtatggttccataatttccgactttaacagatttgttatcatattgttagtccaggccgttacagactctggtagtagatctttatcacatgctaataaatatattaatgatttaaaagaagatctcaaaaccatatttgcgaagattgaattggatatcgagacaaaagagtatatcataattgaagccgtcctaacattttggaacgccaaccctcagacaggtttcttagtagcagatgcattcaaatatgcaggtttacttacttccagaaccatttttacatttatatttaacgaaactggtttgaagaataatggtttgattgaagctacagcaattgaagcggtctttagaaatttatctcaacaaatctcggaagagaacgaaagtggaaataattttgagttcgttttcgaaagattatgtaccatcgccaacagtactatagacttactagatgtcaatgctgatgaagatattgagatacctaaagtcaacggggaaatggacatcgacgatattgaagatgataaactggatttgaaatggaaatattttacagtgattgggtttattaaaagtatattaagaaggtattcccacgaatatcgtgagttagcagacaaattcattgccaacattgataacgctattccacacgaatccactaggagaacaatttcgaattggattcaagaaacaaaggaagtttaaaaagattcggaggatggactacattcgttatcactccgctttttaatttttaatcaatgttacatacctagcgtaattttcctatatataaaatatcagctttatataaatatattattgaaactgtacctataataataaatttaaaattaagtaaatacaaatgcttcaaaatttgttagtattgttttcttcaatcatctttacttaattgtcatcgcaataattaaattaatattttattgttgttgcgtatataatacaacctgaatggtatgctacactatgttacactatgctattgatcagagtttctaatgacgaattacacttctataactatccgctttggaaagtttgagacgaagggcgttacaatcagaatccgtatccaaaggatgttcttcagaattagtcagatctacacctgatgaaacatgccttgcgacagtacttatgctactttctctaaccaaatgtgtaggcggttcgggaaagtaatgcatatcatcctgcgcgtattcgttttcatcaaatgggtttattgaatattttgattcagttcttccaatgttatttgaactgccatttaatctaaaattatgtaaatttgcaaatgaagtgtctcttgttaatgacacttcaccgaaatagagacaaaacttaacaaactttatgaactggtctctagtaacgtccttccctgaaaatctaattgtttcatataaatcggggatcc

SEQ ID NO: 780 - DNA, 927 bp, Zea mays
  CDS (8)..(736)
gcccacaatggcgtcccttttcaaggacccgagcaagctctcagcgtacagggaccgccgattcaagggcacacaggaggagtatgaggcaacgctgcatgcgtcgacaacgctgtacattgggaatatgtccttctacaccacggaggagcaggcctacgagctcttctcccgcgctggcgagatcaagaagatcatcatggggctcgacaagaactctaagaccccatgcggtttctgcttcgtactgtactactccagggaggatgctgaagatgctgtcaaatacatcagtggaacgatgcttgacgatcgtccaatccgtgttgatttcgattggggctttgaagaaggcaggcaatggggccgtggacgaagtggtggacaagtgagagatgagtaccgtacagattatgatcctggtagaggtggttacggtaagatggttcagagggaactagaagcacaaagagaactagttgactatggtggatctttccaaccaaatgcaccacctccctatgagagaggtgagcggaagagaggatacggggactctcataggaatgccagaggagattaccagcggaaacgctaccggagcagcgatgaccggtcagcaccagaggagtccaagagagcgcctgactctgatccagcggataagaatcctagatttcgcgagaaaggtgactctgatgaagaagatgatgactacgacaagagacgtcgtcgctaaagctgtgtggaacagtcgttgctacatgcagctgttctggtgtccagtcgctgcagaagagtccacagcgagcagcagtatccggatttcgccctgctgtgcctgtactgttcctccttttcgggctagtttggagccacaaaagtagagcagattggagggcccaaaatacacttattcaaaatttg

SEQ ID NO: 781 - DNA, 3235 bp, Saccharomyces cerevisiae
  CDS (2352)..(2978)
ctgttgctaagattggttttgcctggaaagcacattggtttttaggcctcttatccttcatttggaaactttttgtcctatgatttgtttttttcattttatttttcattttatttttcattttattttcatttagttaacattattatgcagttatttttttttttcccaccttcatggcctcgtttatgtcttttatcaatatattttttacgtttataagtcatttactcgactttttttacctttgatatgcaatcatattattcttccctccattatggctaaataaatgataattataatctatagttttcaagcgttcatattttgacagataagattatgcaacaacttggaagggcggaaggaagcaaaaagaaaactccgatacggggagtcgaaccccggtctccacggtgaaagcgtgatgtgatagccgttacactatatcggacaataattggacagaaaattttgttaaagtgtcagcctaatcggcgtaatacgtatatatgtatattatctgcatattattacgataatatacaacaaaacggattaaaacaatcggtatatttcaatttgatatttgggataaggtaaaataaaaaccgaagatcagtaagctcttgttacttttttgttggaatagaggatcaagaagcatttattgctagtatccaaattattagtatatcatcatgttttcaaaaaaaaatgatgtaaaaattgagaaacagtcaccagtcatcatgaaaagtgcactgcaaggattaataacgtaataaaacaagaacgacagtacataaacgaaagaagagataactatattattgtatagaattatcgattctcttttagaattcttttattctccaggaaaactacttgtacattctgtttagctaatattgtagcctttaaccacaataaaatgcactccaagtataacccaaaattcattgttttcaaatttatattaatgagatattggtaacctaaacatcaaaaatatttttactcaaattctcttttctgaaaacgctgaaggaaatgtgcaggaaaaatgtttggccatcaacttttattcctagtaccacaactaacgtcacattctatcgaggcaaatgctaattggcaactaacactatcttaacggtttgataatgtcaacacaaaattcacctattattacaaacgaatctaccggaagttgaaatgcctgacaataatcatacaattgcatgaataattgcgaacagatggcagcaaaggatgaactaatcataattatacattgccgctgtaggtttcctcccataaaaatccaaatttccaagaaaaagttcttgtgtcttcatacacttaatattgttatccttcttcaagaccggactatataaagaaaaaattttgtaatgctattatatttcaacttcaaattattttctactagtagacataatggaacttcgctctcagataatctatggcgatagatggacaattgacaatcttctgaaagaatttatataataagatgtgaccatgacctaaacctgctcacgctcatgaaaggatacaggtaatttggcgaaacattcccaagcttcgctgatagacctatcccagaaagtgtctgtttaaaactacaagtatttgcagttttcgttatccagtttcgttcaagagcattaatgcacaagccacttatattatataaatttaaactttgggaaaatatcatacacctattgtaccagtaaatgttggaataaaaatcaactatcatctactaactagtatttacgttactagtatattatcatatacggtgttagaagatgacacaaatgatgagaaatagtcatctaaattagtggaagctgaaacgcaaggattgataatgtaataggatcaatgaatattaacatataaaatgatgataataatatttatagaattgtgtagaattgcagattccctttcatggattcctaaatccttgaggagaacttctagtatatctatatacctaatattatagccttaatcacaatggaatcccaacaattacatcaaaatccacattgtctacagtaaaagtataccactaatagatttgtaattggtgtatgaagtagtgtatggtataaacgttaataagtgcttatcaaagtattacccgctttaacagtttttgtgtttttttcaagaaaaatattatatgtatgaatatagaacatgagtttatatggagaaagtgtctcgacagcttttaaagtcccgaaaggactaatatcgaataaaagttgcatccattaatataccaataaataaagggaaagatgtccctggaagaatttgacgaagttaaatatgatcattcaactaaacgcctagatacaccatcaaggtacctgctgcgcaaggctagaagaaaccctaacgggctacaagaactgcgtgagtcgatgaagtcatccacaatttatgtaggaaatctttccttttatacatcagaagaacaaatttacgaattattcagtaaatgtggcacaataaaaagaataattatgggtttggaccgttttaagttcacgccatgtggcttctgttttattatatatagttgtccagatgaagcattgaatgccttaaaatatttgtccgatacaaagttagacgaaaagacaattaccattgatctagatcctggttttgaagatggaagacagtttggtcgtggtaagagcggtggtcaagtcagcgatgaattgaggttcgattttgatgcatccagaggtggcttcgccattccatttgcagagcgtgtcggcgtaccacattccagatttgataacagtagctcacaatctaatacgaataattatatccctcctcctgatgcaatgggtactttcagaccaggtttcgatgaagaaagagaagatgataactacgtacctcagtagaatcaatcaatttatatctgagaaagattctacacacagatatatatatatatatatatattattgtatatatacatacctacattatttttaaaggcttgcatgatgctgttatgtaaaaaaaaaaaaaaaaaatcagtgtaacataatagacgtaacacgttcaatgacatgataatactatatatagtaacgataaaatgtaaatggtaatagatataattatatgaatatttaagtaatgcattgataagtga

SEQ ID NO: 782 - DNA, 2016 bp, Emericella nidulans
  CDS (1)..(2013)
atgaacgatctttggggccttatttcctgccattcgtatggacccagaggaatgcgagtgtcatttcccattcggaagatgtgtcgtctgatcggtgacaccgtttctcgaaatatcgaacgcttatcttacgcttctcgcctgcaggctcgcaagcttatcaacacagtaccaaccgacgcaaacccctccggatacattgttgcctcatctgacgatttgcttcgtctggtggatgccgactacggtgcgctgtgcatccgcggcgaggtaaaaattctggcaaagtcaccccagtctcaggagatgttggccttgctagagtacctaaaggtccgaaaatacaattcggtactgacgtccaaccatatcgtcaaagacttccaggacctcaattatcctcccgggttcaaggacatttcaggtttgctttatgtgcctctgtcgaccgacggtttggacttcattgttttcttccgtcgcggtcaattgaccgaagtcaaatggggcggcaatcctaacgaggccaagttcaccgagggccaccttgagccccgaaagagctttcagacatggcgggaaaccgtcctggaccggtgccgcgattggactgaatctgaggtcgacacagctgccgtgctctgcctggtgtatggcaagttcatcaaagtctggcggcagcaggaagccgctttggagagctccagccttaccaaattgctcctggcaaactctgcgcacgaagtacgcacacctctgaatgccattgtcaactatctagaaatcgcgcttgaaggtgcgctggacggcgagacaagggatcacttgagcaagtcctactccgcatccaagtccctgatctatgttatcaacgaccttctcgaccttaccaacgtcgagaagggacagagcctcatcaaagatgagccctttgatttgcccaccactttcagcgaagcaacggccatgtttgaaagtgaagccaaacgcaagggcttgaactacaaggtattgtcacaaccggggattcccgagaccgtgattggagatcagcggcgtgtccggcagtcgatcagcaacctcacctccaacgcggttcaaaacacctcgtccggtggagtgactgtcgaggtgtggcacgctcctggggagggcgataccgacaaggcgacggtcaagatcgcggtccttgatacaggccgcggtatctcatcaagcacgcttgagctattgttccgtgagctggagcaggtctcaggagaagacgactcgcattattatggcgggagcgaagaaggggaggaatccgctccagaggctaaggctagcaaggataaggctgttttgggcctgggcctggcgttggtggctcgaatcgtgcgcaatatgcacgggcaactcactgtgcggtctgaagaagggaagggtagtcggttccagatttcgctacagttccctatccccgaaggctcggataccaagagtccaaccgcggaacaccgtcctgttgccactggggactctgcggccccgttctcgaccggggatgatgtgatcctcgttgatagcactactggttccaaaagaaatagccaagacagcctaacccgcccagacgtgcctcgaaaatctgaaccggaggatacagcccttgctgatggcgctggtgaacaagcgtcaggtgaaagcgaagctcagactcgacccaaaaagaccggagaatcgacagcatctacttctcatgagcaatccgaaacggcacgttcacggccgtcaggccccagctctgggcctagtgcgcccgaacggcggcccctccgggttctcgtagctgaggacgacccgatcaacgcgaagattatcgagaaacgactcgaaaaactcggccacactgttcaacgcacggtgaatggggaggagtgtgcgaatgcatactcggcagagtcgacgcagtgggatgttgtgttgatggatattcaggtaggtggtcaatgcctttggtgtcttttaatgtaa

SEQ ID NO: 783 - DNA, 832 bp, Arabidopsis thaliana
  CDS (103)..(525)
gagcgtttcgtagaaaaattcgatttctctaaagccctaaaactaaaacgactatccccaattccaagttctagggtttccatcttccccaatctagtataaatggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtaaaagaagttgcaagtagtgattaagaacaatcgccaaatgatcaagggaaattagagatcagtgagttgtttatagttgagctgatcgacaactatttcgggtttactctcaatttcggttatgttagtttgaacgtttggtttattgtttccggtttagttggttgtatttaaagatttctctgttagatgttgagaacacttgaatgaaggaaaaatttgtccacatcctgttgttattttcgattcactttcggaatttcatagctaatttattctcatttaataccaaatccttaaattaa

SEQ ID NO: 784 - DNA, 1087 bp, Zea mays
  CDS (149)..(817)
gtaccggtccggaattcccgggtcgacccacgcgtccgctagccttctcgtcgctcctgttcttctcgcatccccagcccaggtggtgtcccctgtcgcgttgatgcatgctccctcggcggtggccttgagctgaggcggcggagcgatgccggactccgacaacgactccggcgggccgagcaacgccgggggcgagctgtcgtcgccgcgggagcaggaccggttcctgcccatcgccaacgtgagccggatcatgaagaaggcgctcccggccaacgccaagatcagcaaggacgccaaggagacggtgcaggagtgcgtgtccgagttcatctccttcatcaccggcgaggcctccgacaagtgccagcgcgagaagcgcaagaccatcaacggcgacgacctgctgtgggccatgaccacgctcggcttcgaggactacgtcgagccgctcaagcactacctgcacaagttccgcgagatcgagggcgagagggccgccgcgtccgccggcgcctcgggctcgcagcagcagcagcagcagggcgagctgcccagaggcgccgccaatgccgccgggtacgccgggtacggcgcgcctggctccggcggcatgatgatgatgatgatggggcagcccatgtacggcggctcgcagccgcagcaacagccgccgcagcctcagccgccacagcagcagcagcagcaacatcaacagcatcacatggcaatgggaggcagaggaggattcggccaacaaggcggcggcggtggctcctcgtcgtcgtcagggcttggccggcaagacagggcgtgagttgcgacgatacgttcagaatcagaatcgctgatactcctacgtagaattatacctacctaattgatgacaccgcaccgcacctcgttgtgctgcctgtccttgtacgtttactaattattgctgcctgtatgtaaatcaaaatctgaggctcccatttcgaaacggccggtgaactactcttcccgtttcgtttcatacgagaatcgaactcgttttcaattaaaaaaaaaaaaaaaaaaaagggcggccgctctagaggatcca

SEQ ID NO: 785 - DNA, 1205 bp, Zea mays
  CDS (196)..(750)
cggtccggaattcccgggtcgacccacgcgtccgcgcaccctcccgggccgccttctcttctccagcgtccgatctcccactcccctccctcaccgcagctctcccacctccgccctccccccgcacgcgctcgccacctcgccctcccctccacgttgctcgcacccgcgcttatataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagaccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctgcagaagtacagagagatggagggtgatagcaagttaactgcaaaatctagcgatggctcaattaaaaaggatgcccttggtcatgtgggagcaagtagctcagctgcacaagggatgggccaacagggagcatacaaccaaggaatgggttatatgcaaccccagtaccataacggggatatctcaaactaatggaggtatggaccttttctgcgacagctgctcttacctgaggcgattttttttgtcttagttatttactaagacaccttgcggtgaccattaaagagtaaccaatcgccctcaataggtccgtttttatctgccagaactgatgaggtcgctcactaggagtaagtcgcttccctgggaacggttgtcggctagcaccgctcttgtatgtatattaagagtaacttaatgattggtcttttggctgcgatttgattacatgtatttgtatcgggaggcataaatattgtgtaatttgtgttaaagactggtgtaattgaactatgggaagagctgctttggttgtaaccatattttgatgcccgtatattaggcaaaaatagaaggctgtgggcgtgcacaacaaaaaaaaaaaaaaaaaaaaaaaaagggcggccgctctagaggatcca

SEQ ID NO: 786 - DNA, 1158 bp, Zea mays
  CDS (91)..(588)
ggtaccggtccggaattcccgggtcgacccacgcgtccgcggacgcgtgggttttataagggtttcggcggaggcgcccggtcgctggcgatggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacaggtaatctatcgtactgtcatttgttagtaaaacaatactgcagctattttccgtctcactaaacatggcagaaaatttcgatcattacattattccactaataattttctctctgtacgcactcagtaccacaatggggaaacctaataaagggctaatacagcagcaatttatggtaatattattgctccctgaattttgttaactaaagattctgtatcatgctatatgtatgtttccttttttcttcttctttgttttgacaattgcttctttctctacggtgtttatccatcagctagggaagtctctgcattgcttaccatgtgtattggcagaaaacaggaggcacttacaaagggtgttaatctctgcgatggctgcctctcaggtgtaaattggcttcggtttagcgctgcttttgtccgtatatttaggatgatttgactgttgctacttttggcaaccttttacatttacagatatgtattattcagcataaatataatatagtagtcctaggcctaaataatggtgattaacataccaaaaaaaaaaaaaaaaaaaaaaagggcggccgctctagaggatcca

SEQ ID NO: 787 - DNA, 2240 bp, Arabidopsis thaliana
  CDS (238)..(2061)
tgagatttctccatttccgtagcttctggtctcttttctttgtttcattgatcaaaagcaaatcacttcttcttcttcttcttctcgatttcttactgttttcttatccaacgaaatctggaattaaaaatggaatctttatcgaatccaagctgattttgtttctttcattgaatcatctctctaaagtggaattttgtaaagagaagatctgaagttgtgtagaggagcttagtgatggagacaaattcgtctggagaagatctggttattaagactcggaagccatatacgataacaaagcaacgtgaaaggtggactgaggaagaacataatagattcattgaagctttgaggctttatggtagagcatggcagaagattgaagaacatgtagcaacaaaaactgctgtccagataagaagtcacgctcagaaatttttctccaaggtagagaaagaggctgaagctaaaggtgtagctatgggtcaagcgctagacatagctattcctcctccacggcctaagcgtaaaccaaacaatccttatcctcgaaagacgggaagtggaacgatccttatgtcaaaaacgggtgtgaatgatggaaaagagtcccttggatcagaaaaagtgtcgcatcctgagatggccaatgaagatcgacaacaatcaaagcctgaagagaaaactctgcaggaagacaactgttcagattgtttcactcatcagtatctctctgctgcatcctccatgaataaaagttgtatagagacatcaaacgcaagcactttccgcgagttcttgccttcacgggaagagggaagtcagaataacagggtaagaaaggagtcaaactcagatttgaatgcaaaatctctggaaaacggtaatgagcaaggacctcagacttatccgatgcatatccctgtgctagtgccattggggagctcaataacaagttctctatcacatcctccttcagagccagatagtcatccccacacagttgcaggagattatcagtcgtttcctaatcatataatgtcaacccttttacaaacaccggctctttatactgccgcaactttcgcctcatcattttggcctcccgattctagtggtggctcacctgttccagggaactcacctccgaatctggctgccatggccgcagccactgttgcagctgctagtgcttggtgggctgccaatggattattacctttatgtgctcctcttagttcaggtggtttcactagtcatcctccatctacttttggaccatcatgtgatgtagagtacacaaaagcaagcactttacaacatggttctgtgcagagccgagagcaagaacactccgaggcatcaaaggctcgatcttcactggactcagaggatgttgaaaataagagtaaaccagtttgtcatgagcagccttctgcaacacctgagagtgatgcaaagggttcagatggagcaggagacagaaaacaagttgaccggtcctcgtgtggctcaaacactccgtcgagtagtgatgatgttgaggcggatgcatcagaaaggcaagaggatggcaccaatggtgaggtgaaagaaacgaatgaagacactaataaacctcaaacttcagagtccaatgcacgccgcagtagaatcagctccaatataaccgatccatggaagtctgtgtctgacgagggtcgaattgccttccaagctctcttctccagagaggtattgccgcaaagttttacatatcgagaagaacacagagaggaagaacaacaacaacaagaacaaagatatccaatggcacttgatcttaacttcacagctcagttaacaccagttgatgatcaagaggagaagagaaacacaggatttcttggaatcggattagatgcttcaaagctaatgagtagaggaagaacaggttttaaaccatacaaaagatgttccatggaagccaaagaaagtagaatcctcaacaacaatcctatcattcatgtggaacagaaagatcccaaacggatgcggttggaaactcaagcttccacatgagactctattttcatctgatctgttgtttgtactctgtttttaagttttcaagaccactgctacattttctttttcttttgaggcctttgtatttgtttccttgtccatagtcttcctgtaacatttgactctgtattattcaacaaatcataaactgtttaatctttttttttcca

SEQ ID NO: 788 - DNA, 2163 bp, Zea mays
  CDS (1)..(2160)
atggagatgaattcctctggcgaggaaactgtggtaaaggtaagaaagccgtacacaataacgaagcagcgggagcggtggacagaggctgaacacaaacggttccttgaagccttgaaactttatggcagagcatggcagcgcatagaagagcatgttgggacaaagacagccgtgcagatcagaagtcacgctcaaaagttcttcactaagttggaaaaggaagctatgaacaatggtacttctccggggcaagcccatgacattgacatacctccaccacggcctaaaagaaagccaaacagtccatatcctcgaaaaagttgtctcagctccgagacacaaaccaaagaacttccaaatgacaagtcaacaaaaccaaatatgcccttgagcaatgggcatgtaaaaatggtaggcgatgcatctcttcagaattttcaaaggaaggagttgtctgaaaaaggaagtcgctcggaagttcttaatctcttccgtgatgccccatctgcatcattttcttcagttaacaaaagctcttcaaatcatggggcacccaggaggaccgaggcaagtaaaacagaaagccgagatatgtccatcatggaaaataattcttttaaccccaacacccaagaggatgtaaaggtgatcagtgatcaggaaatggaaaggcttaatggtatccagatcagatctaaatgtgaacattctcatgaggggtatttggacatctcaacgcaacaaatgaagctaatgccaaagtctgtggagacaacatatgtggatgaacaaactgcaagagcttcacacaccctagcagagagcaacgggacagctagcgttccagtgactgtacctgaaggaactcatcctgatcaaacaagtgatcaagtgggaatcaatggaagcatgaacccatgcatccatccaatggtttctgcagacccaaaatttggtagtagtgccacaccacagacttttcctcataattatgctgcctttgctccaatgatgcagtgcaactgcaaccaagatacgtacaggtcattcaccaacatgtcatccacgttctccagcatgcttgtttccacgttgttgtcaaaccctgccatccatgcagctgccaggctcgcagcatcatactggccagcagctgaaggtaacactcctattgatccgaatcaagaaaaccctgcagatggcgtccaaggaaggaacataggctctcctccaagcatggcttctattgtagcagctacagttgctgcagcatctgcatggtgggcaacacaaggtcttctccctttcttcgctccacccgtggcttttccatttgtaccagctcctagtgctgcctttcccacagttgatgttccacgaccttcagagaaagacagagattgcccagttgaaaatgcacagaatgaatgccaagaagctcgaaaacaggtacagttcgaaggtttaagagttgctgcttcttcagagtctgatgggagtggaaaaggcgaggtgtctctccatacggagttaaagctatctcctgcccagaatgctgatgccacacctaccacaggagctggcacaaatgatgcattcaggaataagaaaaagcaggatcgctcttcatgcggttctaacacaccttcaagtagtgatgtagatgcgggcaatgttcctgaggaggacaatgctaatgagaaggcgaagcaagcctcctgcagcaactcttcagctggtgacactaaccaccgcagatttagaagcaatggaagcacaagtgattcatggaaggaagtttccgaagagggtcgtctggctttcgatgcgctgttcagtagggaaaagcttccgcaaagcttttctcccccacaagcagtagactcgaaggaggttgccaaggaggaggaagatgaagtgaccacagtggcggttgacctcaacaagaatgccacaagcattgatcatgatgacctcgacacaatggatgagcccagggcttcctttcccaatgaattgtcgcacctgaagctgaaatcgcgccgtacaggcttcaaaccatacaagagatgttctgtggaagcgaaggaaaaccgggtgccgactagcgacatggttggtaccaagaggattcgtcttgatagcgaagcatccacataa

SEQ ID NO: 789 - DNA, 2316 bp, Zea mays
  CDS (79)..(1986)
attcggctcgagtgggcgcctccaccacctgatccacctctgtttcttcttcctttcatccgttcatacgggggttagatgatggagtcctgtgattgtatagatacgcagtatccgccggatgaacttcttgtgaagtatcagtatatctcggatgtgctaattgctcttgcgtatttttcgattccggtggagctcatctattttgttcagaagtctgctttctttccgtatagatgggtgcttatgcagtttggtgcctttattgttctctgtggagcaactcatttcataaacctgtggacattctctccgcactctaagtctgttgctgttgtcatgacgattgccaaagtttcgtgtgctattgtgtcatgtgcgacggcactgatgcttgtacacattattcccgatctgttgagtgtcaagaggcgcgaatcgatcctcaagaacaaggctgaagagcttgacagagagatgggacttattcttactcaggaagagacgggaagacatgttagaatgttgactcatgaaattaggagcacacttgacaggcatacaattttaaagactactcttgtggagctggggaggactttgggcttggaggagtgtgcattatggatgccttcgagaagtggtctgaatctgcaactttcccatactttaacctatcatgtgcaagttgggtctacggtgcaaacaaacaatcctattgtcaatgaagttttcaacagccctcaagctatgcggataccacccacctgtccattggccaggatcagacctcttgtgggaagatatgtgccccctgaagttgttgctgttcgggtgccgcttttgaatctgtcaaattttcaaattaacgattggcctgatatttcagcaaagagctatgcaatcatggttctcatcctccctactgacagtgttagaaaatggcgagaccatgagttggaacttgttgatgttgttgcagatcaggtagcagttgccctttcacatgctgctattttggaggagtctatgcgtgcccgtgatcaactcatggagcagaatgttgctttagatttagcccggcgagaggcagagatggcaattcatgctcgcaatgattttcttgctgtcatgaatcatgaaatgaggacaccaatgcatgcaattatagcattgtcatcacttctcttggagactgaactgacgccagagcaaagggttatgatagagacagtgttgaagagtagtaatgttttggcaacactcattaatgatgttctagatctttctcgacttgaagatggtagcctcgaattagaaatgggaaaattcaacctccatggagttttgggagagattgttgaactgataaaaccaatagcatccgtgaaaaagttacctatcaccttaattctgtctcctgatctgcctactcatgccattggtgatgaaaagcggcttacacaaactcttttgaatgtcgtgggtaatgctgtcaaattcactaaggagggctatgtttctgtaagagtatcagttgcaaaaccagaatcttcacaggattggcgacctccagagttttatccagcatctagtgatggccatttctacattcgagtccaggttaaggactctggatgtgggattctcccacaagatattccgcatctctttaccaagtttgcccagtctcggagtggaccagctcgacctagcagtggtgcaggtcttgggcttgccatttgtaaaagatttgtaaacctcatgggaggccacatatggattgagagtgagggccttgacaaaggaagcacagctacatttatagtcaaacttgggatttgtggcaatccagatccatccgatcatcaagctgcaaacagaagccaagcatatagtggaagtggtggcctcgctagatttaaacccttcatcacagatgaaaacgacactggtttttctactagacgcaatcaaagaagtttctaatatccaagacaccaaaattgcatacctctcaatcacagtcgacaagatggagtaaacctcctactttcattttgcatgtgctaaattgtataatttgcagtttgcggctgtagaataggattactatgtcaggcatatttctaacaaacaggttttatgcgaactcctgttgtattaactagaatacaatacaacaaaacaaagttgagagacgatctgttacttaatttgacttgtagtatatattgtcagtggcttttgccgtttagcgttcataaaaatgacagtattggcatgaaaaaaaaaaaaaaaaaaaaaaaaaaaaag

SEQ ID NO: 790 - DNA, 1350 bp, Saccharomyces cerevisiae
  CDS (1)..(1347)
atgggtctctgcgcatcttcagaaaagaacggcagcactcctgacacgcagaccgccagcgctggtagtgacaacgttggcaaagcgaaggtaccaccaaagcaggagccacagaagactgtgagaacagtcaacacagcaaatcaacaagaaaagcaacaacagaggcagcagcagccgtctccgcataatgttaaggaccgcaaggagcaaaacgggagcattaataacgcgatatctcccacggctacggcaaatacaagcggatcgcaacagatcaatatcgactctgccctgagagacaggtcgagtaacgttgcagcacaaccatcattgtcggacgcttcaagtggcagcaacgacaaagaactgaaagtgctactgctgggtgccggtgaaagtggtaagtccacggtattgcagcagttgaagattttacaccagaacgggtttagcgagcaggaaattaaagagtacatccccttgatctatcagaatctattggaaattggcaggaacctcatccaggcgagaacaaggtttaacgtcaacttggaaccggagtgtgaactgacgcaacaagacctgtcgagaaccatgtcctatgaaatgcccaataactacacgggccaattcccggaagatatcgcgggcgtaatatctacgttgtgggccttgccctcaacacaagatttagtcaatgggcctaacgcatcgaagttctatctaatggactcgactccttacttcatggaaaatttcaccaggatcacttcgcccaattacagacccacccagcaggacatattaagatcgagacagatgacgtcagggatttttgacaccgtcattgatatggggtcggatatcaagatgcatatttacgacgtgggtggacagcgttccgaaagaaaaaaatggatacactgcttcgacaatgtcactctggtcatattttgcgtttctctatcggagtacgaccagacgctgatggaggacaagaaccagaacaggtttcaggaatcgctggtgcttttcgataatattgtcaacagtagatggttcgcgcgcacgtctgtcgtactctttctgaataaaatcgacctttttgctgaaaaactaagcaaagtgcctatggaaaattacttcccagactacaccggcgggtcagacatcaacaaggctgctaagtacatactctggaggtttgttcagttaaacagggcgaatctaagcatatatcctcacgtgacacaggccacagacacgtcgaatataagattagtatttgccgccatcaaagaaacaattttggaaaatacattgaaagactctggagtgttacaatga

SEQ ID NO: 791 - DNA, 3121 bp, Oryza sativa
  CDS (239)..(2920)
ggcacgaggcaaagcaaagcagcgaatccggcttcactagtcttcttcccccccgccgccgcatcgatcccccttcccctcgtcttccttccctttcccccaatcagattgcttccagaagcctccttccccgcgaagcaaccaaccccttccggatcccgactccatccaaacccccatcccctcccctctcccctacgctcgaaaccctagggagatccatccacatgccgccccgatgaggtcgctccgccgcgtcctcctccagctcgtgctcctcgccggcgtcgccttccgcggggtccgcttcgacgacgccgccgacgccgccgccgccgcccaggggtcgtcagacctcttcgagctcccttcgccgtccccgactctcgcgctccccggcggcggggatgagggggcctcgacggagatcatcgccgcgccgtggccggggcgccacggcctgttcacgccgccgcggagcacgtcccagccggcgagagcggtggtccagccggccgccgacttcggctcccaactccagttttacgacaatggtacaattcaactagtggaccttctatcaaaattgcctcggtggcagttctccaccggaccccctctttcgaagcatatcactacttcgaaacctgatttgaactatgtcatataccttgatgggtcagaaacatcggaccttatagaagttcataatggcagtggtgtgagacttccctggaaactggaggagtttattgctgagactccatatatacgggattcttttgttacgattggatcaaaggtttcaactacttttgtggtcaatgctgatagcggtgagatcatttacaagcatagcttgccagtggccttgaacgaggtaggtggccccctggttgaggaaattccatccaagttagatgctgctagaagtggtacaagtgctaatatcatagtggttgtgagaactgattattctatcagtgcatcggatcttggggaacatttgttcaactggacaagaacttccttcactgcaaattactatgcgaggtatggccaccaagacatgcttgcccaatcgtcctgtctgcgaggaaatattccatgcattaggactgagggtccaccaattaaactttatttacctgattcaagttcagataatgcaattgtcttgagacctgtgaacgaagtttctgctgtggatgctctggaaccacttctacctccaaagaagttaccacaacctgctggcgagtctaatgtggccttggatagtgctcaaaaccagactgctgacattgccctaggtcattttgtgcctgctgacactgaattgaccaacagtgtcactaaattttcttacagatggctattccccacgtttctcatgttgttgatcatggcttgtctagtgaaattggccgatgcaagcaaatattgcaggcaatttgtgattcgatttttgaagccatttatgcgtgatgagaaattgatggacccaagaggcaaatcagagggaacatcaaaaagaaggaaggcgcggaagaaagatggacttatcaatagcactcagatcttttcagcatctgataaagaggggaatggaactggtggatcaactgaggcacaaagtaataaagcacatgattcaacaaatgtggaactccctaatggcctcaatgggcgtcagattggtaagctttgtgtttacagtaaagaaattggtaaagggagcaatggtacagttgtctttgaaggctcctatggtggtcgggaagttgctgtgaaacgtctgctgcgctctcacaatgatatagcctcgaaagagattgagaatctgattgcatctgatcaggatcctaatattgttcgaatgtatggttttgagcaggacaatgattttgtttatatctcccttgagaggtgtcgctgcagcttggctgatctaatccaactgcactcggtaccaccattttcaaatactaagggaacagacattgaactttggaggcaggatggacttccttcggcacaacttctaaagctgatgagagatgttgttgctggtattgtgcatttgcatagtttgggaattatacatcgtgatttgaagcctcagaatgttttgataagcaaggaaggacctctcagagcaaaactttcagatatgggtatcagtaagcgtttgcaggaggatatgacttctgttagtcatcatggcactggatttggaagctctggttggcaagcacctgaacagcttcgtcatggtcgtcagactcgagccatagatttatttagtttgggctgccttatattctattgcattactaaaggcaagcatccgtttggtgagtactatgaacgggacatgaaaatcataaacaatcaatttgatctcttcatagtggatcacataccagaagcagtgcatcttatttctcaactgttagatccagatccagagaagagaccaacggccgtgtatgtgatgcatcatcctttcttttggagccctgagttgtgcctttcatttctacgagataccagtgacagaattgagaaaaccagtgaaactgatctcatagatgctttggaaggcataaatgttgaagcatttggtaaaaattggggagagaaattagatgctgccctgcttgcagacatgggacgttatagaaaatatagttttgagtccactcgtgaccttctaagattgatcagaaacaaatcaggacattacagagaattttcagatgatctcaaggagctacttgggtcgctgccggagggatttgttcagtatttctcaagccgattcccaaagctgctaattaaagtctacgaggtcatgtccgagcattgcaaggacgaagaagctttcagcaaatatttccttggaagctcggcgtagctgtaacctgcaggaggggtgaaggccctgccctgcctagtgtgtacactaacactcttctagcaaaaatgtatgtacatgtgatttgtaccatatatcatagggtaaagaaagttcagcctgtacattgtattccacagaattgtgtattacttatagtaaatcaaattttttacctgactaaaaaaaaaaaaaaaaaaa

SEQ ID NO: 792 - DNA, 3121 bp, Oryza sativa
  CDS (239)..(1483)
ggcacgaggcaaagcaaagcagcgaatccggcttcactagtcttcttcccccccgccgccgcatcgatcccccttcccctcgtcttccttccctttcccccaatcagattgcttccagaagcctccttccccgcgaagcaaccaaccccttccggatcccgactccatccaaacccccatcccctcccctctcccctacgctcgaaaccctagggagatccatccacatgccgccccgatgaggtcgctccgccgcgtcctcctccagctcgtgctcctcgccggcgtcgccttccgcggggtccgcttcgacgacgccgccgacgccgccgccgccgcccaggggtcgtcagacctcttcgagctcccttcgccgtccccgactctcgcgctccccggcggcggggatgagggggcctcgacggagatcatcgccgcgccgtggccggggcgccacggcctgttcacgccgccgcggagcacgtcccagccggcgagagcggtggtccagccggccgccgacttcggctcccaactccagttttacgacaatggtacaattcaactagtggaccttctatcaaaattgcctcggtggcagttctccaccggaccccctctttcgaagcatatcactacttcgaaacctgatttgaactatgtcatataccttgatgggtcagaaacatcggaccttatagaagttcataatggcagtggtgtgagacttccctggaaactggaggagtttattgctgagactccatatatacgggattcttttgttacgattggatcaaaggtttcaactacttttgtggtcaatgctgatagcggtgagatcatttacaagcatagcttgccagtggccttgaacgaggtaggtggccccctggttgaggaaattccatccaagttagatgctgctagaagtggtacaagtgctaatatcatagtggttgtgagaactgattattctatcagtgcatcggatcttggggaacatttgttcaactggacaagaacttccttcactgcaaattactatgcgaggtatggccaccaagacatgcttgcccaatcgtcctgtctgcgaggaaatattccatgcattaggactgagggtccaccaattaaactttatttacctgattcaagttcagataatgcaattgtcttgagacctgtgaacgaagtttctgctgtggatgctctggaaccacttctacctccaaagaagttaccacaacctgctggcgagtctaatgtggccttggatagtgctcaaaaccagactgctgacattgccctaggtcattttgtgcctgctgacactgaattgaccaacagtgtcactaaattttcttacagatggctattccccacgtttctcatgttgttgatcatggcttgtctagtgaaattggccgatgcaagcaaatattgcaggcaatttgtgattcgatttttgaagccatttatgtaggatgagaaattgatggacccaagaggcaaatcagagggaacatcaaaaagaaggaaggcgcggaagaaagatggacttatcaatagcactcagatcttttcagcatctgataaagaggggaatggaactggtggatcaactgaggcacaaagtaataaagcacatgattcaacaaatgtggaactccctaatggcctcaatgggcgtcagattggtaagctttgtgtttacagtaaagaaattggtaaagggagcaatggtacagttgtctttgaaggctcctatggtggtcgggaagttgctgtgaaacgtctgctgcgctctcacaatgatatagcctcgaaagagattgagaatctgattgcatctgatcaggatcctaatattgttcgaatgtatggttttgagcaggacaatgattttgtttatatctcccttgagaggtgtcgctgcagcttggctgatctaatccaactgcactcggtaccaccattttcaaatactaagggaacagacattgaactttggaggcaggatggacttccttcggcacaacttctaaagctgatgagagatgttgttgctggtattgtgcatttgcatagtttgggaattatacatcgtgatttgaagcctcagaatgttttgataagcaaggaaggacctctcagagcaaaactttcagatatgggtatcagtaagcgtttgcaggaggatatgacttctgttagtcatcatggcactggatttggaagctctggttggcaagcacctgaacagcttcgtcatggtcgtcagactcgagccatagatttatttagtttgggctgccttatattctattgcattactaaaggcaagcatccgtttggtgagtactatgaacgggacatgaaaatcataaacaatcaatttgatctcttcatagtggatcacataccagaagcagtgcatcttatttctcaactgttagatccagatccagagaagagaccaacggccgtgtatgtgatgcatcatcctttcttttggagccctgagttgtgcctttcatttctacgagataccagtgacagaattgagaaaaccagtgaaactgatctcatagatgctttggaaggcataaatgttgaagcatttggtaaaaattggggagagaaattagatgctgccctgcttgcagacatgggacgttatagaaaatatagttttgagtccactcgtgaccttctaagattgatcagaaacaaatcaggacattacagagaattttcagatgatctcaaggagctacttgggtcgctgccggagggatttgttcagtatttctcaagccgattcccaaagctgctaattaaagtctacgaggtcatgtccgagcattgcaaggacgaagaagctttcagcaaatatttccttggaagctcggcgtagctgtaacctgcaggaggggtgaaggccctgccctgcctagtgtgtacactaacactcttctagcaaaaatgtatgtacatgtgatttgtaccatatatcatagggtaaagaaagttcagcctgtacattgtattccacagaattgtgtattacttatagtaaatcaaattttttacctgactaaaaaaaaaaaaaaaaaaa

SEQ ID NO: 793 - DNA, 3121 bp, Oryza sativa
  CDS (1481)..(2920)
ggcacgaggcaaagcaaagcagcgaatccggcttcactagtcttcttcccccccgccgccgcatcgatcccccttcccctcgtcttccttccctttcccccaatcagattgcttccagaagcctccttccccgcgaagcaaccaaccccttccggatcccgactccatccaaacccccatcccctcccctctcccctacgctcgaaaccctagggagatccatccacatgccgccccgatgaggtcgctccgccgcgtcctcctccagctcgtgctcctcgccggcgtcgccttccgcggggtccgcttcgacgacgccgccgacgccgccgccgccgcccaggggtcgtcagacctcttcgagctcccttcgccgtccccgactctcgcgctccccggcggcggggatgagggggcctcgacggagatcatcgccgcgccgtggccggggcgccacggcctgttcacgccgccgcggagcacgtcccagccggcgagagcggtggtccagccggccgccgacttcggctcccaactccagttttacgacaatggtacaattcaactagtggaccttctatcaaaattgcctcggtggcagttctccaccggaccccctctttcgaagcatatcactacttcgaaacctgatttgaactatgtcatataccttgatgggtcagaaacatcggaccttatagaagttcataatggcagtggtgtgagacttccctggaaactggaggagtttattgctgagactccatatatacgggattcttttgttacgattggatcaaaggtttcaactacttttgtggtcaatgctgatagcggtgagatcatttacaagcatagcttgccagtggccttgaacgaggtaggtggccccctggttgaggaaattccatccaagttagatgctgctagaagtggtacaagtgctaatatcatagtggttgtgagaactgattattctatcagtgcatcggatcttggggaacatttgttcaactggacaagaacttccttcactgcaaattactatgcgaggtatggccaccaagacatgcttgcccaatcgtcctgtctgcgaggaaatattccatgcattaggactgagggtccaccaattaaactttatttacctgattcaagttcagataatgcaattgtcttgagacctgtgaacgaagtttctgctgtggatgctctggaaccacttctacctccaaagaagttaccacaacctgctggcgagtctaatgtggccttggatagtgctcaaaaccagactgctgacattgccctaggtcattttgtgcctgctgacactgaattgaccaacagtgtcactaaattttcttacagatggctattccccacgtttctcatgttgttgatcatggcttgtctagtgaaattggccgatgcaagcaaatattgcaggcaatttgtgattcgatttttgaagccatttatggccgatgagaaattgatggacccaagaggcaaatcagagggaacatcaaaaagaaggaaggcgcggaagaaagatggacttatcaatagcactcagatcttttcagcatctgataaagaggggaatggaactggtggatcaactgaggcacaaagtaataaagcacatgattcaacaaatgtggaactccctaatggcctcaatgggcgtcagattggtaagctttgtgtttacagtaaagaaattggtaaagggagcaatggtacagttgtctttgaaggctcctatggtggtcgggaagttgctgtgaaacgtctgctgcgctctcacaatgatatagcctcgaaagagattgagaatctgattgcatctgatcaggatcctaatattgttcgaatgtatggttttgagcaggacaatgattttgtttatatctcccttgagaggtgtcgctgcagcttggctgatctaatccaactgcactcggtaccaccattttcaaatactaagggaacagacattgaactttggaggcaggatggacttccttcggcacaacttctaaagctgatgagagatgttgttgctggtattgtgcatttgcatagtttgggaattatacatcgtgatttgaagcctcagaatgttttgataagcaaggaaggacctctcagagcaaaactttcagatatgggtatcagtaagcgtttgcaggaggatatgacttctgttagtcatcatggcactggatttggaagctctggttggcaagcacctgaacagcttcgtcatggtcgtcagactcgagccatagatttatttagtttgggctgccttatattctattgcattactaaaggcaagcatccgtttggtgagtactatgaacgggacatgaaaatcataaacaatcaatttgatctcttcatagtggatcacataccagaagcagtgcatcttatttctcaactgttagatccagatccagagaagagaccaacggccgtgtatgtgatgcatcatcctttcttttggagccctgagttgtgcctttcatttctacgagataccagtgacagaattgagaaaaccagtgaaactgatctcatagatgctttggaaggcataaatgttgaagcatttggtaaaaattggggagagaaattagatgctgccctgcttgcagacatgggacgttatagaaaatatagttttgagtccactcgtgaccttctaagattgatcagaaacaaatcaggacattacagagaattttcagatgatctcaaggagctacttgggtcgctgccggagggatttgttcagtatttctcaagccgattcccaaagctgctaattaaagtctacgaggtcatgtccgagcattgcaaggacgaagaagctttcagcaaatatttccttggaagctcggcgtagctgtaacctgcaggaggggtgaaggccctgccctgcctagtgtgtacactaacactcttctagcaaaaatgtatgtacatgtgatttgtaccatatatcatagggtaaagaaagttcagcctgtacattgtattccacagaattgtgtattacttatagtaaatcaaattttttacctgactaaaaaaaaaaaaaaaaaaa

SEQ ID NO: 794 - DNA, 3501 bp, Saccharomyces cerevisiae
  CDS (80)..(3427)
tcacttttctccatatcacccttcatacacattaaaaaaacagcatatctgaggaattaatattttagcactttgaaaaatgcgtctacttcgaagaaacatgttagtattgacactgctcgtttgtgtgttttcatccatcatttcatgctcaatcccattgtcgtctcgcacctcaaggcggcagatagtggaagatgaagttgcctccactaaaaagctcaatttcaactatggtgtggataaaaatataaactcgcccattcctgctccaagaaccactgaaggtttaccaaatatgaaactcagctcatatccaactcctaacttattgaatactgctgataatcgacgtgctaacaaaaaaggacgtagggctgccaattctataagtgtaccctatttggagaatcgttccttgaacgaactgagtttatcagatatactaatcgcagccgacgttgagggtggacttcatgctgtagatagaagaaatggtcatatcatatggtcaatcgaaccagaaaattttcaacctctgatagaaatacaagaaccttcgaggttagaaacatatgaaacgttgattatagaacctttcggtgatgggaacatttactactttaacgcccatcaagggttacaaaaactgcctttatccatacgacaacttgtatcaacttccccgctgcacttgaaaacaaatattgtggttaatgactctggaaaaattgttgaagatgaaaaggtctacactggatcgatgagaactataatgtatactataaacatgttgaatggtgaaattatatcagcgttcggacctggttcaaaaaacgggtatttcgggagccagagtgtggattgctcacctgaggagaagataaaacttcaggaatgtgaaaatatgattgtaataggcaaaactatttttgagctgggaattcactcttatgatggagcaagctacaatgtcacttactctacatggcagcaaaatgttttagatgttcccctagcgcttcagaatacattttcaaaggacggcatgtgcatagcgcctttccgtgataaatcattgctagcaagcgatttagattttagaattgctagatgggtttctccgacattccccggaattattgttgggcttttcgatgtgtttaatgatctccgcaccaatgaaaatatactggtaccgcatccctttaatcctggtgatcatgaaagtatatcgagtaacaaagtttacttggatcagacttcgaacctctcctggtttgcattatctagtcagaattttccatctttagtcgaatcagctcccatatcaagatacgcttccagtgaccgttggagggtgtcttcaatttttgaagatgagactttattcaagaacgcaatcatgggtgttcatcagatatataataatgaatatgatcacctttatgaaaactatgaaaaaacgaatagtttggacactacgcacaaatatccacctctgatgattgattcgtccgttgatacaaccgatttacatcagaataacgagatgaattcactaaaggaatacatgtcaccagaagaccttgaggcatatagaaaaaagatacacgagcaaatatcgagagaattagatgaaaagaaccaaaattctttgctactgaagtttggaagtctagtatatcgaattatagagactggagtatttctgttgttatttctcattttttgtgcaatactacaaagattcaaaattttgccgccactatatgtattattatccaaaattggatttatgcctgaaaaggaaatccccatagttgagtcgaaatcgctaaattgtccctcttcatcggaaaatgtaaccaagccattcgatatgaaatcagggaagcaagttgtttttgaaggtgctgtgaacgatggaagtctaaaatctgaaaaagataacgatgatgctgatgaagatgatgaaaaatcactagatttaaccacagaaaagaagaagaggaaaagaggttcgagaggaggcaaaaagggccgaaaatcacgcattgcaaatataccaaactttgagcaatctttaaaaaatttggtagtatccgaaaaaattttaggttacggttcatcaggaacagtagtttttcagggaagttttcaaggaagacctgttgcggtaaagagaatgttaattgatttttgtgacatagctttaatggaaataaaacttttgactgaaagcgatgatcaccctaacgtcatacgatactactgttcagaaacaacagacagatttttgtatattgctttagagctctgcaatttgaaccttcaagatttggtggagtctaagaatgtatcagatgaaaacctgaaattacagaaagagtataatccaatttcgttattgagacaaatagcgtccggggtagcacatttacattctttaaagattatccatcgagatttaaagcctcaaaatattctcgtttctacttcgagtaggtttactgccgatcagcaaacaggagcagaaaatcttcgaattttgatatcagactttggtctttgcaaaaaactagactctggtcagtcttcatttagaacaaatttgaataacccttctggcacaagtggttggagggccccagagctgcttgaagaatcaaacaatttgcagtgccaagtcgaaacggaacactcttctagtaggcatacagtagtttcatctgattctttttatgatccgttcaccaagaggaggctaacaagatctattgatattttttctatgggatgtgtattctattatatcctatccaaagggaagcatccatttggagataaatattcacgtgaaagcaatatcataagaggaatattcagtcttgatgaaatgaaatgtctacatgatagatccttaattgcagaagctacagatctgatctcccaaatgattgatcacgatccgttaaaaagacctactgctatgaaagttctaaggcatccgttgttttggccaaagtcgaaaaaattggagttccttttaaaagttagtgataggcttgaaattgaaaacagagaccctccaagtgccctgttaatgaaatttgacgccggttctgactttgtaatacccagtggagattggactgtcaagtttgataaaacattcatggacaaccttgaaaggtacagaaaataccattcatcaaagttaatggatctattaagagcacttaggaataaatatcatcattttatggatttacctgaagatatagcagaactaatggggccggtacccgatggattttacgattacttcaccaagcgttttccaaacctattaataggtgtttatatgattgtcaaggaaaatttaagtgacgatcaaattttacgtgaatttttgtattcataacatgttcatgcccctctgcttcttcttggttgattattgcattaatgttactttgatcattagtagtaaccatc

SEQ ID NO: 795 - DNA, 3501 bp, Saccharomyces cerevisiae
  CDS (80)..(1798)
tcacttttctccatatcacccttcatacacattaaaaaaacagcatatctgaggaattaatattttagcactttgaaaaatgcgtctacttcgaagaaacatgttagtattgacactgctcgtttgtgtgttttcatccatcatttcatgctcaatcccattgtcgtctcgcacctcaaggcggcagatagtggaagatgaagttgcctccactaaaaagctcaatttcaactatggtgtggataaaaatataaactcgcccattcctgctccaagaaccactgaaggtttaccaaatatgaaactcagctcatatccaactcctaacttattgaatactgctgataatcgacgtgctaacaaaaaaggacgtagggctgccaattctataagtgtaccctatttggagaatcgttccttgaacgaactgagtttatcagatatactaatcgcagccgacgttgagggtggacttcatgctgtagatagaagaaatggtcatatcatatggtcaatcgaaccagaaaattttcaacctctgatagaaatacaagaaccttcgaggttagaaacatatgaaacgttgattatagaacctttcggtgatgggaacatttactactttaacgcccatcaagggttacaaaaactgcctttatccatacgacaacttgtatcaacttccccgctgcacttgaaaacaaatattgtggttaatgactctggaaaaattgttgaagatgaaaaggtctacactggatcgatgagaactataatgtatactataaacatgttgaatggtgaaattatatcagcgttcggacctggttcaaaaaacgggtatttcgggagccagagtgtggattgctcacctgaggagaagataaaacttcaggaatgtgaaaatatgattgtaataggcaaaactatttttgagctgggaattcactcttatgatggagcaagctacaatgtcacttactctacatggcagcaaaatgttttagatgttcccctagcgcttcagaatacattttcaaaggacggcatgtgcatagcgcctttccgtgataaatcattgctagcaagcgatttagattttagaattgctagatgggtttctccgacattccccggaattattgttgggcttttcgatgtgtttaatgatctccgcaccaatgaaaatatactggtaccgcatccctttaatcctggtgatcatgaaagtatatcgagtaacaaagtttacttggatcagacttcgaacctctcctggtttgcattatctagtcagaattttccatctttagtcgaatcagctcccatatcaagatacgcttccagtgaccgttggagggtgtcttcaatttttgaagatgagactttattcaagaacgcaatcatgggtgttcatcagatatataataatgaatatgatcacctttatgaaaactatgaaaaaacgaatagtttggacactacgcacaaatatccacctctgatgattgattcgtccgttgatacaaccgatttacatcagaataacgagatgaattcactaaaggaatacatgtcaccagaagaccttgaggcatatagaaaaaagatacacgagcaaatatcgagagaattagatgaaaagaaccaaaattctttgctactgaagtttggaagtctagtatatcgaattatagagactggagtatttctgttgttatttctcattttttgtgcaatactacaaagattcaaaattttgccgccactatatgtattattatccaaaattggattttagcctgaaaaggaaatccccatagttgagtcgaaatcgctaaattgtccctcttcatcggaaaatgtaaccaagccattcgatatgaaatcagggaagcaagttgtttttgaaggtgctgtgaacgatggaagtctaaaatctgaaaaagataacgatgatgctgatgaagatgatgaaaaatcactagatttaaccacagaaaagaagaagaggaaaagaggttcgagaggaggcaaaaagggccgaaaatcacgcattgcaaatataccaaactttgagcaatctttaaaaaatttggtagtatccgaaaaaattttaggttacggttcatcaggaacagtagtttttcagggaagttttcaaggaagacctgttgcggtaaagagaatgttaattgatttttgtgacatagctttaatggaaataaaacttttgactgaaagcgatgatcaccctaacgtcatacgatactactgttcagaaacaacagacagatttttgtatattgctttagagctctgcaatttgaaccttcaagatttggtggagtctaagaatgtatcagatgaaaacctgaaattacagaaagagtataatccaatttcgttattgagacaaatagcgtccggggtagcacatttacattctttaaagattatccatcgagatttaaagcctcaaaatattctcgtttctacttcgagtaggtttactgccgatcagcaaacaggagcagaaaatcttcgaattttgatatcagactttggtctttgcaaaaaactagactctggtcagtcttcatttagaacaaatttgaataacccttctggcacaagtggttggagggccccagagctgcttgaagaatcaaacaatttgcagtgccaagtcgaaacggaacactcttctagtaggcatacagtagtttcatctgattctttttatgatccgttcaccaagaggaggctaacaagatctattgatattttttctatgggatgtgtattctattatatcctatccaaagggaagcatccatttggagataaatattcacgtgaaagcaatatcataagaggaatattcagtcttgatgaaatgaaatgtctacatgatagatccttaattgcagaagctacagatctgatctcccaaatgattgatcacgatccgttaaaaagacctactgctatgaaagttctaaggcatccgttgttttggccaaagtcgaaaaaattggagttccttttaaaagttagtgataggcttgaaattgaaaacagagaccctccaagtgccctgttaatgaaatttgacgccggttctgactttgtaatacccagtggagattggactgtcaagtttgataaaacattcatggacaaccttgaaaggtacagaaaataccattcatcaaagttaatggatctattaagagcacttaggaataaatatcatcattttatggatttacctgaagatatagcagaactaatggggccggtacccgatggattttacgattacttcaccaagcgttttccaaacctattaataggtgtttatatgattgtcaaggaaaatttaagtgacgatcaaattttacgtgaatttttgtattcataacatgttcatgcccctctgcttcttcttggttgattattgcattaatgttactttgatcattagtagtaaccatc

SEQ ID NO: 796 - DNA, 3501 bp, Saccharomyces cerevisiae
  CDS (1799)..(3427)
tcacttttctccatatcacccttcatacacattaaaaaaacagcatatctgaggaattaatattttagcactttgaaaaatgcgtctacttcgaagaaacatgttagtattgacactgctcgtttgtgtgttttcatccatcatttcatgctcaatcccattgtcgtctcgcacctcaaggcggcagatagtggaagatgaagttgcctccactaaaaagctcaatttcaactatggtgtggataaaaatataaactcgcccattcctgctccaagaaccactgaaggtttaccaaatatgaaactcagctcatatccaactcctaacttattgaatactgctgataatcgacgtgctaacaaaaaaggacgtagggctgccaattctataagtgtaccctatttggagaatcgttccttgaacgaactgagtttatcagatatactaatcgcagccgacgttgagggtggacttcatgctgtagatagaagaaatggtcatatcatatggtcaatcgaaccagaaaattttcaacctctgatagaaatacaagaaccttcgaggttagaaacatatgaaacgttgattatagaacctttcggtgatgggaacatttactactttaacgcccatcaagggttacaaaaactgcctttatccatacgacaacttgtatcaacttccccgctgcacttgaaaacaaatattgtggttaatgactctggaaaaattgttgaagatgaaaaggtctacactggatcgatgagaactataatgtatactataaacatgttgaatggtgaaattatatcagcgttcggacctggttcaaaaaacgggtatttcgggagccagagtgtggattgctcacctgaggagaagataaaacttcaggaatgtgaaaatatgattgtaataggcaaaactatttttgagctgggaattcactcttatgatggagcaagctacaatgtcacttactctacatggcagcaaaatgttttagatgttcccctagcgcttcagaatacattttcaaaggacggcatgtgcatagcgcctttccgtgataaatcattgctagcaagcgatttagattttagaattgctagatgggtttctccgacattccccggaattattgttgggcttttcgatgtgtttaatgatctccgcaccaatgaaaatatactggtaccgcatccctttaatcctggtgatcatgaaagtatatcgagtaacaaagtttacttggatcagacttcgaacctctcctggtttgcattatctagtcagaattttccatctttagtcgaatcagctcccatatcaagatacgcttccagtgaccgttggagggtgtcttcaatttttgaagatgagactttattcaagaacgcaatcatgggtgttcatcagatatataataatgaatatgatcacctttatgaaaactatgaaaaaacgaatagtttggacactacgcacaaatatccacctctgatgattgattcgtccgttgatacaaccgatttacatcagaataacgagatgaattcactaaaggaatacatgtcaccagaagaccttgaggcatatagaaaaaagatacacgagcaaatatcgagagaattagatgaaaagaaccaaaattctttgctactgaagtttggaagtctagtatatcgaattatagagactggagtatttctgttgttatttctcattttttgtgcaatactacaaagattcaaaattttgccgccactatatgtattattatccaaaattggatttatggccgaaaaggaaatccccatagttgagtcgaaatcgctaaattgtccctcttcatcggaaaatgtaaccaagccattcgatatgaaatcagggaagcaagttgtttttgaaggtgctgtgaacgatggaagtctaaaatctgaaaaagataacgatgatgctgatgaagatgatgaaaaatcactagatttaaccacagaaaagaagaagaggaaaagaggttcgagaggaggcaaaaagggccgaaaatcacgcattgcaaatataccaaactttgagcaatctttaaaaaatttggtagtatccgaaaaaattttaggttacggttcatcaggaacagtagtttttcagggaagttttcaaggaagacctgttgcggtaaagagaatgttaattgatttttgtgacatagctttaatggaaataaaacttttgactgaaagcgatgatcaccctaacgtcatacgatactactgttcagaaacaacagacagatttttgtatattgctttagagctctgcaatttgaaccttcaagatttggtggagtctaagaatgtatcagatgaaaacctgaaattacagaaagagtataatccaatttcgttattgagacaaatagcgtccggggtagcacatttacattctttaaagattatccatcgagatttaaagcctcaaaatattctcgtttctacttcgagtaggtttactgccgatcagcaaacaggagcagaaaatcttcgaattttgatatcagactttggtctttgcaaaaaactagactctggtcagtcttcatttagaacaaatttgaataacccttctggcacaagtggttggagggccccagagctgcttgaagaatcaaacaatttgcagtgccaagtcgaaacggaacactcttctagtaggcatacagtagtttcatctgattctttttatgatccgttcaccaagaggaggctaacaagatctattgatattttttctatgggatgtgtattctattatatcctatccaaagggaagcatccatttggagataaatattcacgtgaaagcaatatcataagaggaatattcagtcttgatgaaatgaaatgtctacatgatagatccttaattgcagaagctacagatctgatctcccaaatgattgatcacgatccgttaaaaagacctactgctatgaaagttctaaggcatccgttgttttggccaaagtcgaaaaaattggagttccttttaaaagttagtgataggcttgaaattgaaaacagagaccctccaagtgccctgttaatgaaatttgacgccggttctgactttgtaatacccagtggagattggactgtcaagtttgataaaacattcatggacaaccttgaaaggtacagaaaataccattcatcaaagttaatggatctattaagagcacttaggaataaatatcatcattttatggatttacctgaagatatagcagaactaatggggccggtacccgatggattttacgattacttcaccaagcgttttccaaacctattaataggtgtttatatgattgtcaaggaaaatttaagtgacgatcaaattttacgtgaatttttgtattcataacatgttcatgcccctctgcttcttcttggttgattattgcattaatgttactttgatcattagtagtaaccatc

SEQ ID NO: 797 - DNA, 1419 bp, Zea mays
  CDS (80)..(1339)
ccacgcgtccggcacaaagaagaaaaatggaagtaccaacactctgggtggtggtgaacaagaatctggagtggcttcaatgtcaaatgaggaatatttgcacactgatacccatggtttgcagatatcagaaactgttgttgaacctcaagtaggtagatctgagggagacttgttgcctacaagttctacagatgatctacatatatcaggggggagaacaaagcaatctgatgcaggtgaattacgcaaaggaaatagcatagatgatagcactccaacttatctagatatcacgataggacatttacctgaacgcaaaactgcatccaggatcacaacagagggttctggtgagtttattactgggaaaggaatgttagctggcacatcttctgtgaccatcagtgcaatggaagctggtcgcagtgaagatggagctgattcgatatatgatccttcaggtgctataactccttatcatgattctcaaacgcaaacagtaatgccacatgagaatacctcaactggtatccttggaccaccagcgttacctgtgggagtttctacaaggtttgaagaaaagaatatcatgcaagaggccccagaaattattaaaacaggagggaaggatacagaattgaaaaggagaaattttcaaagaaataaacaagtattgaaggatacatttgatgaatgggaggaagcataccagcgggatgctgagcagagaaaagctgatgagttattcatgagagaagctttacttgaggcccagagagctgcagatatttgggaggtacccgttggtgcagtgttagtacagaatggcgaaattattgctcgtggttgtaatcttgtcgaagatcatagggattcaactgcgcatgctgaaattgtttgtataagagaagcttctaacaaactcaagacatggcgcctagcggacacaacgctttatgtgacattggaaccttgtgccatgtgtgctggtgctattcttcaagctagaatcgatactgtggtatggggtgccccaaacaagcttctgggagccgatggcagctgggttaggctgttccctggggatggacaaacaagcactcttgattcaacaaaccagagccaggccgcagggcctgtccaccctttccatccgaagatagccatcaggcgtggtgtgctgtcggccgagtgctcagagataatgcagcagttcttccagctgaggaggaagaagaaaccacagtcaccaccgcaggcccaccgccatgggcaccatcatcctgtcaagttcttcagcaagatgcaccacatgttcggcacgatattctgtttataacttcgcctctctgttttattttagcttcctaaatttcgtattatggaagtgtgaaaaatgcaaaaaaaaaaaaaaag

SEQ ID NO: 798 - DNA, 1254 bp, Zea mays
  CDS (106)..(1041)
gagcaagcccagtccccaatcccaccctgccacccaaccttgcttcttctccgatagctatttctctggtttctccccaatcttcccgggtttccctgattaaagatggctgagtcctttgttctcaataccggctcgaggatcccatcggttgggcttggcgtatggcaaatacaacctgacgctgccaacgacgccatctacgctgctgtcaaggctgggtatcggcatattgactgtgcagcagcatacaacaatgagaaggaggtgggcctggctttgaagaaattatttgaagatggtgtggttaagcgtgatgatttgtttatcacctctaagctatgggctgctaatcatgcacctgaagatgtggaagagggaatcgacaccacacttcaagatttgcagcttgactacttggacttgtacctcatccatggtccaatccgcatcaaaaaaggaactagcacgatgacccctgaaaactttctccctacagatatccctgctacatgggcagcgatggagaagttatacgactctggcaaagctcgtgcaatcggcgtgagtaacttctcttgtaagaagctgcatgatttgcttgccgttgcacgagtgcctccagcagtcaaccaggttgagtgtcatccggtttggcagcaagacaagctccggaagctatgccaatccaatggtgttcatctttctgcattctcgcctttaggctcacctggatctccttggatcaatgggccaagtgtcctcaagaaccccattgtggtctctgttgcagacaagttgcagaaaacgcctgcccaggtcgctctacgctggggaatccaaatgggccatagtgtactcccgaaaagcgccaatgagtccaggattaaggagaacattgacatatttggctggtctattcctgaagatttgatggccaagttctctgaaatcaaacaggtcaggctgctgacagctgagtttgtagttcaccctcaggctggctacaatacattggaggacttttgggatggtgaaatataaaagcatacaaatttgttcagaataaaagagccaggcgaggaaacaaccacaaaaaaggggagatcgaatgcataggccccaatacgatgaatttgggggtttacgtgattgttgaacacaagcattgtgtgactaatctgtgttttgatgtggtaaatgtaattgggttagtcacaataagagataagtgcctttgccacaaaaaaaaaa

SEQ ID NO: 799 - DNA, 1205 bp, Glycine max
  CDS (32)..(958)
attcggctcgagggaggaagagagaaaaaccatggcaataacactcaacaatggcttcaagatgcctatcattggattgggcgtgtggcgcatggaaggaaacgaaatcagggacctaattctcaattccatcaaaattggttatcgccattttgattgtgctgctgactacaaaaacgaagcagaagttggagatgcgcttaaggaggcttttgatagtggccttgtgaagagagaggatctcttcattaccaccaagctttggaattctgatcaaggccacgttcttgaggcgtgtaaagacagtctcaagaagcttcagttaacgtatctagatttatatcttgttcactttcctgttgccgtaaggcatactggggttggtaatacttctagtcctttgggtgatgatggggtcctggacatagataccaccatatccctggaaacgacctggcatgcaatggaagatcttgtttcatcgggcttggttcgcagcatagggatcagcaactatgatatctttctgaccagagattgtttagcatattccaagataaagcctgctgtaaatcagattgaaactcatccatacttccagcgtgattctctagtcaaattttgtcagaagcatgggatttgtgtcactgcacacactccactaggaggtgctgcagcaaatgctgaatggtttggaacagtttcatgtttggatgaccaagttctcaaaggtctggctgaaaaatacaaaaagactgccgcccagatcagccttcgctggggaattcaaaggaacactgtggtcattcctaaatcgtcaaaactggagaggttgaaagagaactttcaggttttcgattttgagttgtctaaagaggacatggagctcattggaagtatagatagaaaatatcgaaccaatcaaccagctgtgttttggggcatagatttgtatgcgtgagaatgcccttcctaagtctgtatcatggctgtttgaccttgtgttaagattcagatttggtataagctgatctttcaggctccttagtagctcagtttatttgataatgtaaactttctttgttgatggttgaaaaatcatcttctcatcccatatccaatctcgtggactaaataagagagacttctgaatgttgttgcttaaaaaaaaaaaaaaaaaaaaaaaaaaaaaaaaaaaaaaaaag

SEQ ID NO: 800 - DNA, 651 bp, Saccharomyces cerevisiae
  CDS (29)..(619)
catttatacacgtagacaaaaagacggtatggttgataataggcgtacgtttacggcaccccaaagcttacttgaaacaaatcttacttttccgaatgatgaaccgtcacttactacaatcacagttacgcgagaaagatgtgttgatccaagcttgatagattcatttttgaggtttctaaggcatggaagtgatgatataataagacaaaaattaaacaactataggaaaggctctattaatggaaaaaataagtgtaaggaatttttgaagcaagaactatatccgaactggcaaatacggaataatataatttcattttgcgaaaaagaggcagcagagatgaagaacgagaccgatcagcagtgcggtaataataaaaagactactgcggaaccacttatagacgcaagaattgatccttacgctgcaagagaaagagcggagaaacaggaagctcaatataaggattggacgaaggtgacagagtgggtggcaaataatagaaaaatagaacaaattttaacttctacaacagagggcattttaaggcaaaactgcgagcaaaataatgactacttgaaggagtttacgcaattctgcaaggacaacagttgaacgccctattcttctagtccgctgaaagatta

SEQ ID NO: 801 - DNA, 428 bp, Saccharomyces cerevisiae
  CDS (101)..(325)
gtgaactgcaacgttatataaactaaagtgccagaataaaaataaagaaaggcaaagggagactatccgtcttcgaaacaagtcaaaagagcgaaaactaatgagccaacaacaaggttactaccaacaaggacccccacagcaaggttattatcaacaaggtccaccacaacaaggttattatcaacaaggtccaccgcaacagggttatcctcagcagcaaccagtctatgtccaacaaggtcaaccaaaggaggaaagctgcttggacagttgtttaaaatgtttgtgttgttgtttcttattagaattggtatgcgataactgattcgtttgttcaagaagtggtcaatataaaaaacgaaatcacatagcctttcatctatgctgcgaaagactgtataattacttttaagcaaaaatgtata

SEQ ID NO: 802 - DNA, 614 bp, Saccharomyces cerevisiae
  CDS (101)..(511)
attaaattagataattgcttctcatacaatgtgatttcttacaccgcatgtgataggatactagtacgacgaataacttcaaattttatttcaacaacagatgaacgatggtcaattcttgttccaacgtaacgatcccatcatattatatacatttttgcttaaaagtaattatacagtctttcgcagcatagatgaaaggctatgtgatttcgttttttatattgaccacttcttgaacaaacgaatcagttatcgcataccaattctaataagaaacaacaacacaaacattttaaacaactgtccaagcagctttcctcctttggttgaccttgttggacatagactggttgctgctgaggataaccctgttgcggtggaccttgttgataataaccttgttgtggtggaccttgttgataataaccttgctgtgggggtccttgttggtagtaaccttgttgttggctcattagttttcgctcttttgacttgtttcgaagacggatagtctccctttgcctttctttatttttattctggcactttagtttatataacgttgcagttcaccatcggcctcgagcaaaaaaaaacagtagaaggcaaag

SEQ ID NO: 803 - DNA, 584 bp, Saccharomyces cerevisiae
  CDS (101)..(481)
aaggatgaaaaagaaaaagaaatgcaggaaaaatgaggcaaagtaagccaaaacttatagcactcataagacggcaaagttcccccaagctccacccaggatgtcaagcactaatggaaacgcaccagcgacaccttcctcggatcaaaatcctctccccacgaggttcgaagtggagctcgaatttatccagtcactggcaaacatccaatacgtaacgtacttactcactcaacagcagatctggaagtctcctaacttcaaaaactacttgaaatacctggagtactggtgcaaccccccttattcgcaatgcattgtgtatccaaactgtctcttcattttaaagctgttgaacgggttcatggagtcggcgatcgttaatgaagatggcctgctggaagggctagacgagctgcccaagatcattcaattacaaggcccgcaatggatgaatgaaatggtagaaagatgggccaactgaacacacctaattataactacattcgcacgcattcatatatctattttatacactcatgaatatatatacacacacacacatatatatatcacatatatac

SEQ ID NO: 804 - DNA, 953 bp, Saccharomyces cerevisiae
  CDS (101)..(850)
gctaacatagcaaaattagatgaatgatgagtcctaatgggatctacactttgctcgagaagcggctggtggctgcggtaaaaactagaggactcacactatgcagcatattaaacatatgaggacagctgtccgtttggctagatacgctcttgaccacgatgagacaccggtagcttgcatctttgtacatacgccaactggccaggtgatggcttatggcatgaacgatacgaacaagtcattaactggagtagcacatgctgagttcatggggatcgatcagatcaaggcgatgttgggctcccgaggagttgttgacgtgttcaaagacattactctatatgttactgtagaaccgtgtataatgtgtgcatctgctctcaagcaattagacattggaaaggtggtgttcggttgtggcaacgagagatttggaggcaacggtactgtcttgtcagtaaatcatgatacgtgtacattagtgcccaagaacaatagtgcggcagggtacgagagtataccggggatcttgaggaaagaagcaataatgctgctgagatacttttatgtaagacaaaatgaaagggcgccaaagccacggtccaagagtgacagagtgttggataaaaacacgtttccgcctatggaatggtcaaagtatcttaatgaagaagcattcattgagacttttggtgatgattacaggacttgttttgcgaataaagttgacttgtccagtaatagcgtcgattgggatttgattgactcccaccaagataatataatccaagaactggaagaacaatgcaaaatgtttaagtttaatgtacataagaaatctaaggtttgacgaaaaaaatcagaacatcataaaataatagcaacatttacatatttttatatagatatttttctttttttaaatttctctgttaaatgtgatcagataa

SEQ ID NO: 805 - DNA, 821 bp, Saccharomyces cerevisiae
  CDS (101)..(718)
gtttctggtttaaagctattcgttcattgcaacgctcctttctgctatcctttcgcaaagtggcaagtactgaaaaccgagaagaataaataatattgcgatgagtttatactttacgacattatttttattgctcactgttgaggtggtaatgctcttcatcttcgttttgcctttgccattccggatccgtaggggtatttttagcacctataaccaattgacagcgaagcagcaaataaaaactataatctttataacgggttgtcttgttggcctgttgtttattgattcatggaaaaggtctcaaattcgtgtttcattataccacaacgacaacagtggctcaatcgggtcatctgctgtaactccaatacaggcactagcatcaagagcgtacaatcaaagaaatatgtatatttccgggttcatattgtacttttctatctgtatcccaactgtcatgtctattgtcaagagactggtgaaataccaaggcttaatcaacgaacaagaaaagcaaaaattgaacaaaccttcctcaaacagcaagaaagactcaaatgaagctgattccaccaaacttcaagaggaactaaggaaaaagcaaatttctctggagggcctacaaaagcaagtcaaaaacctggagaaatattttgatgagaagaatcaacctggaaatgtagcagctgctgaagcttccaagaaaggaaactaaatagatatatttatgtataaatgtatatacgtgttacctctggtgctcatacttctctggtcgcgacgcaatacgaaaatgctactgaaataaaaagcaa

SEQ ID NO: 806 - DNA, 557 bp, Saccharomyces cerevisiae
  CDS (101)..(454)
ttttttttccgcgcgcaagcacgttacccggaccccgtcttagcacacgcacacgcacacgcagcgctcacagaccagcgaaacagacctgagagccacgatgcagcacacgcttacccggaccgcctctctgccagaacgctcgagcagcgcccacagcgccgctactgcgttacccgcacttcgccgcccgccagacagctgcgagactctcgtcccgctactgtgtatcttttggttcgtcttcgttagtatgagcccgctcccgccggctcgtgccaacaaatcagacaacaaaggcttaatctcagcagatcgtaacaacaaggctactctactgcttacaataccccgttgtacatccaagtcgtatacaaatgatttatccccactcaaaatgacattgctatccgccggcaagcacccaaggcctttccgccaagagcaccgttgctagcctgctatggttcagcgacgccacaaggacgccttattcgtatccatctatattgtgtggagcaaagaaatcaccgcgttctagcatggattctgactta

SEQ ID NO: 807 - DNA, 926 bp, Saccharomyces cerevisiae
  CDS (101)..(823)
gtgtcctctattgtttatctcaacagaacgcacacattcttgaaacttgctcacataacataagctggagtgacatagcatttatatatatacaagggaaatggtcaaagctgttatttttaccgatttcgacggtaccgttactttggaagattctaacgattatctgaccgatactttaggtttcggtaaggaaaaaagattaaaggtcttcgaaggcgtgttagatgatactaagtcttttaggcaaggtttcatggaaatgctggaatccatccacacccctttccctgagtgtatcaagatcttagaaaagaaaattcgattggatcctggtttcaaggatacattcgaatgggctcaagaaaatgatgtccctgtcatcgttgtttccagcggaatgaaaccaattatcaaggttttattgaccagattagttggacaagagtctattcacaaaattgacattgtttccaatgaagtggaaatcgatgcacatgatcaatggaaaatcatctataaggatgaaagtcccttcggacatgacaaatccagaagtatcgatgcttataaaaagaaatttgaatctaccttgaaagcaggtgaacaaagacccgtttacttttactgtggtgacggtgtttctgatctaagtgctgcaaaagaatgtgatttgctatttgccaaaagaggtaaagatttggtcacttattgtaaaaaacaaaacgtcccattccatgaattcgataccttcaaagacatcttggctagcatgaaacaagttctggctggtgaaaagacagtcgctgaattgatggaaaattagtgcaagactcttacgaaatattaaagtttaataccgtgtaactgcctcttacatatgtatgcatatatacgtacgtactatatttttcttgtatatcttt

SEQ ID NO: 808 - DNA, 1679 bp, Saccharomyces cerevisiae
  CDS (101)..(1576)
gagcttaaaggtaaaggaaaaagatggtaggatgataggtaggatgaagcggtatgaaagtggaagaagcacaatatagcacgtcgaaacagtgctaatcatgagcgatgacttgttttctaaggctttggagaatcccgaccaggacttgaacgtggaattgcccaaggatgatgttgatttaggtcttttaggtgatggtgggaacgagaggaagaccgatgaaccggtagcagacgcagaaagatcaacaggcctaggatccggctcttctgaatccgaatcagattccggttctgattctgattctgattctggctcttcaggtagtgaggatgattctgcagatcaggacgttgaaggagaggacgaaggtggtgacgcgattgaaaatgaagacgaagacgaagacccttcaccttccggtcctatactatcgaagaacgaaatactagaggaaactgttcctgaactaccggaagattatgaaatttcagaaaaaacgatcatcactcctattggtgttttgaagtctgcatttgaaaataatataatcattcacgccacgatgtcgggcgaaaagcgtgttttaaaagagggttccattttctgtctcgaggatagaactttgatcgggatgttgacggaggtgtttggacccttgcaaaacccattttatagaattaagttgcccgattcaaaaaaaaacttattcgatgaattaaaagtgcgtttgggtgagaaagcctttatagtcacccctgatgcccactggatagatactttcgagttaaagcgcaacaaaggtactgatgcgtctaatgggtacgatgaagaattacctgaagaggaacaagaattttccgacgacgaaaaagaggcccttttcaagaaaatgaagaaacagcaacggcaacgaaagaaaagggacaaccgcaaactagccaacgatagtgacaatgtcaaggtaaagagagctcggcagcccaaggccaacagtttacctaaactggtaccgccgttgggcatgagcagtaatgctccgatgcaacatgggtacaaatcaagaaacgcacgtgaaaatatcaagcgtgaatccagtgctacctctaatcggaatggctcctccccagtgccaatcacacagcaccaccaacaacagttttctgcaaataattatcccttccctcaacaaccaaacggtatgccttatccaccatactcacctttccctcagccgactaacttccagtatccacctccaccatttgggcaggcgacaccggcccaattctccaacactgttccatatggtagcttacctcccgcatacaacaatatgtcgccgccaacacagcagtcgttcatgccaatgacccaaagtcaaccgccacttccatatggcgtacctcccatgaatcaaatgcaaaacccaatgtacatccaaccgccacctcaagcacctcctcagggaaatggtaatttccaacaagtaatggaattacatcaaatacttttgcagcaacagcaacagcaacaccagtatcagcatcagcatcagcaagatccaagaacctagagtcacgattgaaatatttaataataaatgctatgtatcatagataaactagaaagaggcaagaaaaatttaacaagtttcttaattgaatattatttta

SEQ ID NO: 809 - DNA, 1139 bp, Saccharomyces cerevisiae
  CDS (101)..(1036)
acggatatattgatagtcggatactacgtggatatggatacacatgtaaacggttgtgttaccctaaagaaacggaggtcagttaacaacacttttacagatgtcatttcaccaacagttctttaccttgaataatggaaataaaatccccgcaatcgccatcattgggacaggtactagatggtataaaaacgaagaaacggatgctaccttttcgaacagtttggtcgaacagattgtttatgctctgaagttacctggcattattcacattgatgctgctgagatctacagaacatatccagaagttgggaaggcacttagcctcaccgaaaaaccaagaaatgcaatattcttgacagacaagtactcacctcaaatcaagatgtcagattccccagcggatggactagatttagctttgaagaagatgggcactgactatgtcgatctataccttttgcatagcccatttgtttccaaagaggtcaacgggttaagtttggaggaagcctggaaggacatggagcaattgtacaaatcaggtaaagctaaaaatatcggtgtttccaactttgctgtggaagacttgcaaagaattctgaaagttgcggaagtcaagccccaagttaatcaaattgagttcagtcccttcttgcagaatcaaacaccagggatctacaaattttgccaagaacatgatatattggtagaagcatactcgccactaggtcccttacaaaagaaaacagcacaagatgactctcaaccgtttttcgaatacgtgaaagagttatccgagaaatatatcaaatctgaagcccaaattatcctacgttgggtgaccaaacgtggcgtgttgcctgtaaccacctcttccaaacctcaaagaatttctgacgcgcaaaatttattctctttcgacttgacggctgaggaagtcgataagataacggagttgggcttggaacatgaaccgctaagattgtattggaataaattgtacggtaaatacaactacgctgctcaaaaagtataaataccggataatttatgtacgagtcatatttgttttgtataactttattaatcgactttttttgtcaggtttatcaccccgttacccatcccgccacttt

SEQ ID NO: 810 - DNA, 512 bp, Saccharomyces cerevisiae
  CDS (101)..(409)
atttaagttagaaatcggcacgaaaaaaatttgacagattacgagagtccagccaaaatatgagtatattactatttccccttggtgaaagaaatgaaagatgttattttttaccggcttagtaatactgagctacttacttgggggaaagaaagattggctacttattatgtatgaagcctcagattaccttgaattcctcaaccgtttgagcagtatgctcttcaaattcgaactttttgaacatctttcctccacattcctgattttttcacattcaaaacgcgctgtgaagctgttagaaatttacagatcgaggcatatttctatatataatgtatttttattaagacacccaaagtacttccaatctgtagatattgcactttatctgaccagaagccagacttgaacagttacatattgtgctttgcagtcgttaaatttcccgaactgttttcgtatttttttttcttttcctcttttccactggatcagatcaaaagccgact

SEQ ID NO: 811 - DNA, 2717 bp, Saccharomyces cerevisiae
  CDS (101)..(2614)
atattcaattgcaaggtgacgtacttcagataaacactttattgtaccatcttaagcggctatataaagtgtcatatacacccttcaccaaatacgcaacatgtctgaatatctagctcagacgccctgcaaatttactatatggtcaagcgagattgatcttatcagaacaaacctgttggtgaacgctcaccctttaagcacggttgggcgactacttcaatatatccattatcaaatatacaagcaattaagagctatctatcaaccagaggaacagtgcacgaactcggaaatacctcacacacccttaaatagtatcaacacttacttcctaagttacgaaggcagagagttatctgcaacgtgtttattaaaggacatcacgtcatctagccacccagattcgaaccatttcataagactacaactggaaaagcgtacttctccttccggttcagcatttgacttggaatatgatatggagggcgaatttaactcgatgaatattcaatttgagataaatacactatcttctcaacgtatattcaattccatggaaccaaatttgcctattggcactacattggctagattagagaaactggcattggaacgtataaaggattttgaaaaatcagcagggaatctctgtggtattaaagaggaccattcagtgtctgatttgcagggatttataataaaggggaaacagacacccatgtttttaaattatggaagtgattctgattactataaagacttgaacctggtagatttgataggcattgattttgccccggcacacaattcttttttcacatttttgttcaagatgaatcacgaacagaattcacatatcgccaacgatgaagagagatttgtgttggaattcatatccgatgccacattatctataactcaaatgaatgttaagcccgataccacggtaaaacaagtgaaagatttcatatgttctgtttacactcactcattaaacttgaggagaaatgatatcaagttgatttataagggacagttgcttcatgaaaataattttgcaggcaactcttcaaagatcagcgagtacattaaagagccacatgaagtgaaggtccatgtacaaatcaaccaagagtatacagaatctgggcctggattttggaatgaagtgttcaacaatccgaatattttccaattcatgcctccagatacaaggtcacagtcacctgttagtttcgctccgacgcaaggacgatctcctgctgcaatacgtggcgaagaacggggtataccatacgtaaccgaatctggaaatgacatcgtgcccacagatgagctttataggaaatgcattatcaacggggatgaagtagtattcattcctgttagcgaactaaatccacaatcgagctatttgtccgtgatcaaaggcgattacggtgaaattaaaatccccatatctagtaatgactacagaattaatggcgataatattttgctatcaccatctgcgatagagcagttagaatctgctttgaacttcaaaatcgagagaccacgggattcgacactcttgcatccgtctggtgagcatgttcgagctgcagataatacctcttcggcaaatgataataatacagttgagaatgacgagtcagcgtggaatagaagggtagtgcgtcccttgagaaacagcttcccgctgctattggtattgataagaacattttacttaattggctataattcattggttcccttttttattattttggagtttggaagcttccttccctggaaatatatcattttactaagcttgcttttcatttttaggactgtttggaatacccaagaggtgtggaatttatggcgagactatctccacttgaatgaaattgacgaagtcaagtttagccagatcaaggagttcatcaattccaattcattgaccttaaatttctacaagaaatgtaaggacactcaatccgctattgatttactgatgatacctaatctacatgagcaaaggctatcggtctattctaagtatgatattgagtacgacaccaacacccctgacgttggacaattgaatttgctatttatcaaggtgctatcgggtgagattcctaaggacgcgctagatgagttgttcaaagagtttttcgaattgtatgaaacgacaagaaacatgaacacactatatcctcaagactctttgaacgaattgctgctgatgatttggaaggagtcccaaaagaaagacatcaatacgctacccaagtacagaagatggttccaaaccttgtgctcgcaaatagcggagcataacgtccttgatgtcgtactcagatacataattccagacccggtaaacgatagggtgataaccgctgtgataaagaacttcgtgctcttttgggttacactactcccctatgtgaaggagaagctggatgatattgttgcacagagagcaagggaccgtgagcaaccggctccatctgcccaacagcaggaaaacgaagatgaggccctcataatccctgacgaggaagaacccaccgccacaggtgcgcaacctcatctctacattcctgatgaagactaattgcaatgcgatgtggccacgttatataatgcgtttaaggtgtacgaaaacccatgctgttctggcccgtcgggttttctgacaaattgtcctttaggga

SEQ ID NO: 812 - DNA, 860 bp, Saccharomyces cerevisiae
  CDS (101)..(757)
agtaaaatataatcaaccataaataggagaatacaggcggtgcttacagcttgatattttgttaccaagtcaagatctataataataactcaatacatatatgttaaagttaacaacaacatccgttactttccacgtactaagatatttccaacttggcttatctgtaactaacttgttgttagctagttttgccataatcacaaactataaagtggatcgaatccttagattgagcttagctgtttcaatcatatcttcagtttattttgggattgtgagatttttgcctgttctgttaatattcgtgatggaaattgttcagaccgtcctgtggtttaccgctttcgtaactctagcttcaaaatttggttctatgtcctgctcaagtatgccacggggtataaactttgattattcaggttcttgtaagattgctaaaatagatattttaccagaagccgttttattcatactatttctcgctaccacatatgcttcttatatcacagtcctatctcaagctaaggaaaatgggtcaagcacaagatctgttttgaaggcttgtgtgaaggcattacgtgataccgtggaccgcttggagaccagtctggaagagagtgagcctcttttagatcttgaagttcaggaagatgcgaggactgaaaccgaaagcattgaggattcaactgatagtgaggataatgctaacatcgaacaagagaaagtgattgatggttcaattgagcattcttcatgatgaaccaaatgtcttgtagtgcatgctgtttctgactttgcttaatggatttttttagttcgacgatgttccgtatattttagaggcacacactttcact

SEQ ID NO: 813 - DNA, 533 bp, Saccharomyces cerevisiae
  CDS (101)..(430)
tataaaaagggactttagcataaaataaagaacttcgtgcagtacttatacgagcattcgcataattatacaaatagacaaaacctcagaaggaaaaaaaatggtatctcaagaaactatcaagcacgtcaaggaccttattgcagaaaacgagatcttcgtcgcatccaaaacgtactgtccatactgccatgcagccctaaacacgctttttgaaaagttaaaggttcccaggtccaaagttctggttttgcaattgaatgacatgaaggaaggcgcagacattcaggctgcgttatatgagattaatggccaaagaaccgtgccaaacatctatattaatggtaaacatattggaggcaacgacgacttgcaggaattgagggagactggtgaattggaggaattgttagaacctattcttgcaaattaagggcagacaaagttttttccatgcacacaggtttataatgagcttatatatatgtatatgtatatgtatacaagcatgtgtttgtatttacaggaaaaaa

SEQ ID NO: 814 - DNA, 1623 bp, Saccharomyces cerevisiae; identical to SEQ ID NO: 770
  CDS (228)..(1226)

SEQ ID NO: 815 - DNA, 1523 bp, Glycine max
  CDS (265)..(1002)
caacatgcgactttgtttttttaacgatgaaaacgaagtgtattgagtaatactccgttccctggttcctccatcgcgaaattagggttcgctcacttgtcttcaatttcccagattcacctagcaccatccataaatccccctattaacgtgtctttcggaccgatttttctacgtgacgcatcgcaattcttcagcggtttcgtttagggaacccgcgaaaccgaatcagatagtgcggcacggaaactaggaattaaagcaatggcagaagatctggtgctggatactgcaatcagagactgggtgttgatccctctctctgtggttatggttctcattggtgtgctccgttactttgtttctaagcttatgcactcttcacaaacccctgatgccaaaattgttaaagaagggcaagtgattgttagagctcggaatttacgtgctggggcgaatttcattccatccaaggcatttcgcgctcgcaaaatttatttctgtaacgaggaaaatggtctgttgtttgttccaaagggccagggccagaatccgcaagcacagatgttctctgatccgaacatggccatggatatgatgaagaaaaacctttcaatgatcattcctcagactcttacttttgcttgggtgaactttttcttttctggatttgtagcagccaagataccctttccattgacacagaggtttaggtcaatgctacagaatggaatagaccttagcaccgtagatgttagctatgtcagcagtcgctcttggtacttcctcaatctgtttggattaagaggattgtttagtctcatattgggtgaagaaaatgctgtagatgatacacaacgtatgatgcaaatgggtggatttggatttgatccttcaaagggtctgagtgctgagaaagacaatcttgacataacccagcatgactgggccttaccaaattttgagcagcgtgctgaagctgtgttgaggaaagttgccagttaaccatgttatggagtaggaagcttcattgctagcattagcaggatacacttactttctattgttgcggtaggaggtgtacctttttgcagaaaagatatcaaagatcttgttgagactgtagtcttgagactgaacattttgcaactatcagaaaacattgttcggttttgttgaagctagaactgaaactattcattcttgcttatttttctgaatgaccattgccataaaaagcatgaaggcttcccaggaaacgttgagtcctgtaatgtgtttcaaggcctattcaactattctatctgtatcccacatcccactcctagaattgtcccctaatatgttaaattaagaaatattacattcgcatctcttattctgcttttgttgcagaattagaatgcaggtgaggtgcacttgattataatcagatgctaaaaaattgtgatgtgatgtaatgcatgctcaaattaccaaaagccgaaagaatgttttaaaatttgaattgagtgattaaaaaa

SEQ ID NO: 816 - DNA, 1521 bp, Zea mays
  CDS (1)..(1425)
atgaacctcgccgtcgcagccgcactgccgtccgtgacgccacgtaccggcgtcgtgctcccacggagcagtcgccgacactgcccccgcggggtcgtcccacgcgcggcctcgagctccgtttcctcctttacctccccctcagcagcggcggcgcccatctacacgcccacgccgcaggaccggtctctccgaacgccgcatagcgggtaccactttgatggcacggctcgacctttctttgaaggatggtacttcaaggtgtcgattccagagtgcaggcagagtttctgctttatgtactctgttgagaaccctctcttccgtgatggtatgagtgatttggacaagttgttatatcgcccacgctttactggtgtgggagcacaaatccttggtgcggacgataagtacatatgccagttctctgagaaatcaaacaatttttggggaagtaggcatgaactaatgctgggaaacactttcatttccaataaagagtcaaccccaccgcaaggggaggtgccccctcaggatttctctaggcgtgttttggaagggctccaagtcaccccaatatggcatcaaggtttcatacgtgatgatggaaggtcaaactacgtgccaaatgtccaaacagctcgctgggagtacagcactcgtccagtttatgggtggggtgatgtcaaatctaagcagttgtccacagctggttggcttgcagcttttcctttctttgaacctcattggcaaatttgcatggctagaggcttgtccacaggatggatagaatgggatggagaacggtttgaatttgaaaatgctccatcttactcagaaaagaactggggcggaggttttccaagaaagtggtattggatccagtgcaatgtcttcccaggagcttctggtgaagtttctttaactgctgctggtggattgaggaaaattggacttggtgatacctatgaaagtccttcactgatcggaatacattatgagggacagttttttgaatttgtaccttggactggaacagtaagctgggacattggactgtggggtctttggaaaatgtctggcgagaacaaaactcacctggtagaaatagaagcaaccactgcagaatcaggaactgctctgcgcgctcctactatcgaggctggactggtaccagcgtgcaaagacacctgctatggagatctaaggctacagttgtgggaaaagaaatacgatggtagcaagggagagatgatactcgacgccacaagcaacatggcagcactagaagttggcggaggcccctggttcaatgggtggaaagggacaactgttgtgaacgaggttgtaaataacattgtgggcacgccagtcgatgtagagagcctcctcccaatcccatttcttaagcccccaggcctataggatcaccaacgaatgtcacaatgaagaagtatcacggatatcaatgttgatcgtacagtaaaactgtgcccagttcaataataattcatgattttt

SEQ ID NO: 817 - DNA, 9795 bp, Oryza sativa
  CDS (345)..(409), (581)..(692), (710)..(827), (2019)..(2098), (3567)..(3646), (5059)..(5228), (5675)..(5772), (6541)..(6645), (7487)..(7603), (7908)..(8057), (9155)..(9328)
  unsure (1)..(9795): unsure at all n locations
gacgaagagggatagaaaaacatagtgaaaaggtagggtccgatgtccgtgaggaaaagtaacggtaggatggggcgaggcgagcagggtggatatgggcacgttcccagatagtggaacgcataagagattagatcgcaaaggcaaacacggttaagtagaggtcaccgggcgaaaatttagggtcaggtggggccgacggcagaataaggatggacctggaagcgtcgcatgggaaggtatcgataccaggcgctgtcacccagcagtaccgttgggcacaatgcggcacgggcagggcccttgatcagggaggggcctcctcctccccctccccctccacgatggtggcggcgcccgtctacgcccccacgccgcgggaccgggccctgcggacgccgcacagcgggtaagccgtcgcccggagactgatcatcataccctcgattctgattcagaaatgtaggattcagtttggattcctgctttagctcggattcttcggcaatccttttaacatcatgcatgtttgagattcagtatgcctaattgaaatgatgtgatgggatgatgctgtcaggtatcactatgacggcacggcgaggcccttttttgagggatggaacttcaaggtgtccattcccgagtgcaggcagagcttctgcttcatgtacttttgcttaaaaccctttgtttcgagatgggatgagtgatctggaatcggttcatacatggatcgcgcttcactggcgtcggggcacacattcttggcgcctttgataagtacatatgccagttcaccgagaaattcaataacttttggggaagtaagctacttttttagatccagtctttttcacattcaccctcaaagacatttcatttaggatatttttatttccattcaatggtgaaaggaatacatatttgcgctaacaatcagctttttgttctgcgcaaaatcctaaccggctgactgtaagatatttaataaagcaagaatagaagaaaggttattaccaactagttcaaaacaataccaccaaccgccctgaaatcatagccgctctttcatggttacctgaactcaacgaacttgttgcatttcccttccatccttcttgtctggtgcagattgatgaaaagaagcttgtcacagagctttattctgaaccatcacctgaatttgcaacggaaaaggttgcttagtacgatgcaagtatgcaacatgtcctctttcacgcacctttagaatttctaatcagcctttttgagatgagacctaatcaactattttgtaaaagcaagctttcttcatattagagattgatttgaggaaataaatttgtgaaaaaaatatgtttataacaacagggaattatattgtgaaaaatatgttgataacaacaggggcttatattagaaagaccttgtggtctagttctcgaaaaagatatagatgtgtacctgtgtagctcatcacaaacctgttctgaccaataagttggttccagtcttgataatagtgttgtgctgccgaatctagttaatgtgcttaacaagtggttattagttagggatacctaacaattactactttacagccttctgtcattatcaaagttaactaagatgtcaatttgacaacaattcctattggtttatattcgcaaaacctaataagatcagaactaatttgaaatcatgttgttcttttgacggacatacttgtactttcatactcatcctacatcttcccaaacagttcaagtgcatatattcttaggagtcttatttgttttggatgtagtgtgcattccatgcatctataaaggtaaaaagtagtaaacaaaactgcagatcaaaagtcagaacaatgcaaactaagatgcagtgcagatattgattacttcatgcttctgttatttgtagttggtattgtttttcctgttcatatggaactttagtagtgcatcacagtatgttgatttccaaattaataagctgcatttcgataggtaggcatgaactaatgctcggaaacactttcattcccaataatggttcaacacccccagaaggggaggttccccctaggtagattctttatggattcttatgaattgcaaaaactcatataatgatcttgaactattcttcgacttaacattttttcctattaacatatttttaaatgccattcccttgagctactccacatttatttgttattcagtaatttattaaaaaatcttagttttcttggttaaattgtgggtataacggactaactcttatatctagcaatggtgggtccttatgcattaaaatttttttgattatttcacaactacctaatggggatgaattttctttcaataacagaataatttccccttccatttaattaaaaatataaggtggcctaaaatgttaacttacactttcttttgttaggggtctgtatttgacactccttggctaattgtgaggcttttgtttaagaatcagataaaaaatgtttttatcacgcgggtgctgaagggaattaagatataatttggagtttgttctttacaggngagtttttatacaaaagagggtttatttatgtggcaccctatttttatatttatgatgtggtgctcaccaccgtatagaggagaagatattgaacgtcatagtaagatcaaaatcccaataaaagccgacaggattttctcctctctcttgtataatatagaagtattgttttcccatataaaagcttatagagtcgccacattattttttatcatatataaacatcttttcaatgagatggatagaaatacgtggagaacttcactttcataaattgtttcactcccgacagagaaggtgtctccacacatggaatattgtaagtgatttctagaatgtcaaaaatcatatttaatatttttgcattatattgacgaataaattttttttcctattaaaattttttaagagccaattcctataagttccccccaatttttataatccaagtatttacttaaaaaatttaaattttcctgtttaaattggggtaaaaaataacaacccttaaaaatcaagcaaggttggttctttatgacataaaattaattatgattttttcccaactactaattgtgcatattttttttttcattaaccaaatttatttttcaccaacaatattaataataaatattaatgtatgtactaaaatgcatatacttaacatcatctagttgtttaggggtgctgcttattgtgaacgttccttgtccatactgtgcagtgcttctgtattaaagaattcaagtaaaaaaatgtttatttagtaactggtgtgcctgtaagggagattcgcagtatacattcttgtaagctttgatcctttctcagcgtgcaagttttttactaaataatgagatgtcttatctattattctgtttaccctgatatttcctctgatttgtaacttatcactctctacattgctttacatgccaatggctttcttcaagtaatcaacggttattatgtttcattaggaattttctagtcgagttttggaaggcttccaagtgacaccgatttggcatcaaggctttatacgtgatgatggaaggcatgtgcatcttgatgtttatctaagatctattcttgtaactattattatgtttctatgttttattgaaaagtcattacagtttacttactgagcttttttttttgccaatttagtgcgaaatgcttctttccatagctgaactataaagaatagttggatctgcatgttgagaatttatttatttttagctcatcaacacaatgctaaatgaaataacctgagaattgtattctggtcaatcaaaatataatattgtagaatcatgtacaaaatttgaaatatctgcttagtacgaaactatttggagaggaaggtttgcttgtttgtacaaaaggataatagatattagtatccttcgaataccatgatggcaggattttctgccaatctgaattttgaaatcaggcagatggatttcctaatctgtaaaatggaattatgcatttatgcaattgaaaatatgacaagacaaaatgatgagtaaattttagaaaactaaaactatttgtcaaaactattaatttgctacaactttagctaggcatttcagagaactgcaactacattttatgattttatcataaaactacaactttatttgcttgacaagtttggaccaacatgctatacacatataccatactcatgctcctgcaagttgggcccacatgtcataaacacatagggggataaagtcgtagctttcttataaattcgtttgcaattgttgcaattttgtgaaatatgttgttaaagttgcagcaaagtgatagttttaaccatataattgctgttttgttaaatttaccgtaaaatgataaaatgaacatagctctttcgctgtcacttttgaagttcatgaaagcaaacacacttgatacgcttattgccttgtcagaaagggatataaaagtttctatcctttaggtgctccaaatttcttgaactatatattgtgcccaaacacatttttaatagcaaattcaactgtagagaggaaaggtgatgcgacaccatctttgctcatacattgcacttaacttaatataaattttttttaggaaaaaacagtagttcgtgtgtaaccacgattgcaggtaattaagaaaattgctctggatggtttgattgtatcgaatgttacatattataagaaaaaaaaagaccttgacaatgcttttagatttatttagtaatgttatgcaatgtgtttattactactatgatgatgcttatattacatgcaaatcctagagaacaactcctagcagtttatgtcaggactggatacaataccgtaattaatgtttcccttcaaaatgtaaatggggattgagtagaaaagagagtttacactttattgctattaaatgaacaattaaaatttaaattacctgttgctcccctgtcaggtcaaagtatgtgccaaatgtccaaacagctaggtgggagtacagcactcgaccagtatatggctggggtgatgtcacgtcaaagcagaaatcaactgctggttggcttgctgcttttcctttctttgaacctcattggcaaatatgcatggctggtggcttatccacaggtttgtatttctttgtatttgataaactgaacagagagatatttaatttttctttttacctactggttttcattctaggtagatggcacatgtgccactgagtaatttactgaatgatacattcatctctcatgtgtaaaactatcatgtacgatggagttgtatttcttagcctaaaatgtgaaaattggttttccattgatgaagctttatttcaaattttttctttaatatttctgtaggaatccaaattgcactaaaaaataccaggaaatgtggctagtcctatctatatgtccaatccttttattccattcagtatgatttctccagttcagtcctgtagtagcgcacgattgattgaggtgatatgatatagtgttaggaaggttataataatattaagttaatagttcaatactaacttctgcaacttaactactcaggatggattgaatgggacggagagcggtttgaatttgaaaatgctccttcttattcagaaaagaactggggtgcaggttttccgaggaagtggtattgggtgcgtttttctatcttctttctgaccattaatcctgatgtaatggatacactggaatactgaataagttttgcttcatttacagatagaaaatatgctgtttcttgctgtaattctgtgttttgtgttgccagtaatgttcacccgtagtagcttttgggctgtttagatcccttgcctcacctggatttaagagtttaggcctccagtaacaacaaaaatgcttgctttgcctggcaatctcacctcattgagcaaggatattgttagttccttgctcacagggcaatgtttggcttgcatctcatcctgcatctctttatcaaaggaagctgggtgaaggttctgaacaaacccaatatgcatgaaggtttcaagaatggcatgcaatatgatggttgtagtggtcatgataaaaaataccttctttaaacatagtgtggtcggttgaaagtagtcaattttactggtacatttagtcatagttatagaggttatgcacttttaaatattcatgatatagctaggttacaaatacttgtcgcttcacggttcgtaatgcacattttccaattttatccatattaattatctagttagttgtggagggtaatatggtcatttaacatgaaaacaaatgattacacaaatttatgtgccatggttaaaagtgacaagtaaacgtgaatggagagagtatgttttagtttgactcaaaacttcacatgaatgaccaaacttactgattgaacacctttgctcatacaggtccagtgcaatgtcttctcaggcgcatttggtgaagttgcattaacggctgctggcggattaagaaaaattggattgggcgaaacctatgaaagtccttcactggtagagtcctgatactttcagcttttaatctgatgcatacttctaatttgttctgcaacttagctcatcatgcaagcttgattgctggatgtctgccagactgccagtaaggcaaaagggaatattattgatcaaccagttggcctaaaaattttgactgacaaaatcttatccatttccgaagtatgggtttattttcatttcaggactggtcattgatacaacattttatggatttagtggataaatgtattgctggtgatggttatgccacaaattagaatcccctttaccgcagtggttttaagtttagatcttttttgtgtatgtatcatgaaagttacactaattgtatgtatctaggcgacttttcatcccacagaacatttacatctagacctttgacagtcgaaacaaccaacgtacagaaaagccaccagggtgagtaaaaagcattggcagcataagcttgtgtgcagcctgagacagggttggaataatctcttgttccaaaaagaagtgcagcatgctttgtttcctttaaatgtcctgtggtgtttctgtgatgttattatggattcttcctcttttatagaaggtccaacgtcattcttatccactttcttgctttgcttttgtactcacatccacatcaacaaaaccatgtatttattgagaccaggtaatagatatattttctttagccagtaatttcaatacgatgcttgtttgctttgtgccctgcatattaactttcataagaggaagcatacaatgatcagacagaagatttacgaatttaactatgcacatacataacagttctgtttgttccctgcagattggaattcattatgagggaaaattctatgaatttgtgccttggaccgggacagtgagctgggacattgccccttggggtcactggaagttgtccggcgagaacaaaaatcatctggtaattatcatccagcgtgctgaaaatgtaatgcagtgcctgtgctagttggctactgttcacattcgagcaagattcccacttagctttcttacttgtattatagattctcttaggttgtaaggttacttatgtggttctatgttccttgattagcattcaatgttctaaaagcagattatctaggtgctaggcagcctgctggcctagtatccaattaagtgccaggagctgatctatcaccggactagtgcctagcacctggtgaatgcgacccttaacatgcattgctacttttctacaggttgaaatagaagcaaccacaaaagaaccaggcactgctttgcgagctccaaccatggaggctggactagtgccagcatgcaaagacacctgctatggtgatctgaggctgcaaatgtgggaaaagagaaatgatggtggcaagggaaaggtatgcatgcatgataataaggccatcagaatttttcagatagctgatgtattattgcactattactcttgttgcaaaatctaaggtgccagttgggttagctgcctcgaaaattgaactttattatgcaattcacaaggagggccagatgtagcatataatatgcaaatcagtatgcggcccaaaagtccactactaccttcgttccaaaaagagtttatacatgaatttggacaagcacttgtctagataggtgtagagaaaacgaactcttttgggacggaagtagtaatactatttttttctagattagcttggggctgtttggatgggactaaaatttttagtctctgtcatatcggatgtttggacactaattagaagtattaaacgtagactaatgacaaaacccatttcataaccctggactaattcgtgagacgaatctattagccctaattaatccatgattagcctatgtgatgctacagtaaacatgtgctaattatggattaattaggcttaaaaaaattgtctcacgaattagctctcatttatgtaattagttttgtaagtagtctatgtttaatactctaaattagtgtccaaacatccgatgtgacagggactcaagtttagtccctggatccaaacaacctaatgccactattttgccttaggaaatattgaaagttaaggacacaatgaactctgatggattgatggcctctatagttatctgcccccggagcaactgaaaatttattaattcatatatgataatatatgcatgatactatctgtcctgtcaggctctccatattcaaatactagaaaatattttaataacactctttagcctttacctaagcacattgtgggatcaatttctgattctgcacatacatggtcactgttcagtatagacacttttattgaacagaatatagtgaccgacttcattgatagtcatcaaggcatgtaaccatgatccaaatcaaaaaaactctgcttatttactctaaaaaactgtaacaagattatatggtgcattaccaacaaggctacaatgtataaaaattcctagttgttttcagatgatactcgacgcaacaagcaacatggcggcactagaagttggtggaggcccttggttcaatggttggaaaggcacgactgtttcaaacgagattgtgaacaacgttgttggtacccaggtcgatgtggagagcctcttccctatcccatttctcaagccccctggtctgtagcattgttcaggtcgagccatcgataggtagagatgaataggccctccaatcttgtcacaccttgagtcttgatctgttcctcacttagcatcatgttttcagccagagaactacagaaacagtaaaccaatcagcatggagtttattctcgttgggttagagaaaggcgcctttcgggtgaaatcatgttgcacaaatttttacagatcaggaatggatgctgtaattcaagaaaataagtataattcatcttaggcagttccatccttttgtgctcatctgaacttctgaagtatcataaagaagtgatagctggatgcccgggcctgcatctgcaattgtggaggtctttctggtcagaattggctggaaacaattgttgttagcacacttcatatggtaaatctttggggatcctctagagtcgncctgcnggctgcgggatgcagttgtacaaacaaagccag

SEQ ID NO: 818 - DNA, 1467 bp, Arabidopsis thaliana
  CDS (1)..(1467)
atggagatacggagcttgattgtttctatgaaccctaatttatcttcctttgagctctctcgccctgtatctcctctcactcgctcactagttccgttccgatcgactaaactagttccccgctccatttctagggtttcggcgtcgatctccaccccgaatagtgaaactgacaagatctccgttaaacctgtttacgtcccgacgtctcccaatcgcgaactccggactcctcacagtggataccatttcgatggaacacctcggaagttcttcgagggatggtatttcagggtttccatcccagagaagagggagagtttttgttttatgtattctgtggagaatcctgcatttcggcagagtttgtcaccattggaagtggctctatatggacctagattcactggtgttggagctcagattcttggcgctaatgataaatatttatgccaatacgaacaagactctcacaatttctggggagatcgacatgagctagttttggggaatacttttagtgctgtgccaggcgcaaaggctccaaacaaggaggttccaccagaggaatttaacagaagagtgtccgaagggttccaagctactccattttggcatcaaggtcacatttgcgatgatggccgtactgactatgcggaaactgtgaaatctgctcgttgggagtatagtactcgtcccgtttacggttggggtgatgttggggccaaacagaagtcaactgcaggctggcctgcagcttttcctgtatttgagcctcattggcagatatgcatggcaggaggcctttccacagggtggatagaatggggcggtgaaaggtttgagtttcgggatgcaccttcttattcagagaagaattggggtggaggcttcccaagaaaatggttttgggtccagtgtaatgtctttgaaggggcaactggagaagttgctttaaccgcaggtggcgggttgaggcaattgcctggattgactgagacctatgaaaatgctgcactggtttgtgtacactatgatggaaaaatgtacgagtttgttccttggaatggtgttgttagatgggaaatgtctccctggggttattggtatataactgcagagaacgaaaaccatgtggtggaactagaggcaagaacaaatgaagcgggtacacctctgcgtgctcctaccacagaagttgggctagctacggcttgcagagatagttgttacggtgaattgaagttgcagatatgggaacggctatatgatggaagtaaaggcaaggtgatattagagacaaagagctcaatggcagcagtggagataggaggaggaccgtggtttgggacatggaaaggagatacgagcaacacgcccgagctactaaaacaggctcttcaggtcccattggatcttgaaagcgccttaggtttggtccctttcttcaagccaccgggtctgtaa

SEQ ID NO: 819 - DNA, 1092 bp, Nostoc PCC7120
  CDS (1)..(1092)
atgcgatcgcctacaatgttcaaaactctgcaaactccccatagcggataccattgggacggtagtagtcgccgtttctttgaaggttggtattatcgtgtaactttaccagactgtggtcaaacctttgctttcatgtattccatcgaagaccccattggtggtaaagcctacagtggtggtgcagctcaagtccttggtgctgatgatgaatatatttgtcggacttttcccgatgtcaacaaattttgggctagtccagatgttctggctttgggtcattggggcgaaacaaacctcaacaccaaacctatttacctgttaccagcagagtttgaacgccatgtacagcaaggataccaagctacagccaccatcaatcaaggcataattgctgaccctgcaacaggtaattattgccgttggcgttacgaaattcaaccgatatacggttggggaaatcaagatggtatccagcaatcaacggctgggtggctgtcctttttacagatttttgaaccaggatggcaaattttgatggctcatggcttggctaccggctggattgattggaatggcaaaatctatcaattccagaatgcgccagcttacggggaaaaaaattggggtggtgcttttcctgaaaaatggttttggcttaactgcaacagctttgatggcgaacctgacttagctttaactgctggtggtggtagacgcggtgtactgtggtggatggaatctgtagccatgattgggttacattatcaaggcaaattctacgaattcgttccttggaactcaaaagtagagtggaatattcagccttggggtagatggcaaatgaaagcgaaaaacttagattatgaggttgaattaactggaactacccatctacccggtacagacctacgtgcgccaacagtccagggtttacaatactgctgtcgagacactatgcaaggaaaactagatgtagagttacgacagatccgagggaaaaatcctctagtcatcctgaaagcacacagttatctttgtggtttagaaataggtggtgattcttggagcaattcttggcagtctagttag

SEQ ID NO: 820 - DNA, 1092 bp, Synechocystis sp. PCC 6803
  CDS (1)..(1092)
atgaaatttccgccccacagtggttaccattggcaaggtcaatcacctttctttgaaggttggtacgtgcgcctgcttttgccccaatccggggaaagttttgcttttatgtactccatcgaaaatcctgctagcgatcatcattacggcggcggtgctgtgcaaattttagggccggctacgaaaaaacaagaaaatcaggaagaccaacttgtttggcggacatttccctcggtaaaaaaattttgggccagtcctcgccagtttgccctagggcattggggaaaatgtagggataacaggcaggcgaaacccctactctccgaagaattttttgccacggtcaaggaaggttatcaaatccatcaaaatcagcaccaaggacaaatcattcatggcgatcgccattgtcgttggcagttcaccgtagaaccggaagtaacttgggggagtcctaaccgatttcctcgggctacagcgggttggctttcctttttacccttgtttgatcccggttggcaaattcttttagcccaaggtagagcgcacggctggctgaaatggcagagggaacagtatgaatttgaccacgccctagtttatgccgaaaaaaattggggtcactcctttccctcccgctggttttggctccaagcaaattattttcctgaccatccaggactgagcgtcactgccgctggcggggaacggattgttcttggtcgccccgaagaggtagctttaattggcttacatcaccaaggtaatttttacgaatttggcccgggccatggcacagtcacttggcaagtagctccctggggccgttggcaattaaaagccagcaatgataggtattgggtcaagttgtccggaaaaacagataaaaaaggcagtttagtccacactcccaccgcccagggcttacaactcaactgccgagataccactaggggctatttgtatttgcaattgggatctgtgggtcacggcctgatagtgcaaggggaaacggacaccgcggggctagaagttggaggtgattggggtttaacagaggaaaatttgagcaaaaaaacagtgccattctga

SEQ ID NO: 821 - DNA, 1501 bp, Nostoc punctiforme PCC 73102
  CDS (294)..(1388)
gatgaagagggattttcagaagtgggaggttcggatggattttctgatttgagcttgttgtaagctacgttaattaatttgattttttcctcagcttcctgtttttgcttttgatcgaaaaagcgatcgggatgccaaatttttaccagtttacggtaagttcgcttcacctctgcttgagatgcaccgggttctagcccaagaatttcataagcatgattaatatcggagcgtagacgtttcggcttgtcgttagacatcgcgcatactgaaaaaatccgcaactatatactatgttaactattcccctcaatttcctccaatcaacccaaacgccccattctggttatcactgggatggtactagtcgccgtttctttgaaggctggtattaccgcatcactttaccggaaattgagcaaacgttcgcctttatgtactccatcgaagaccccatcggcgggaaaccccacagtggcggtgcagcccaaatccttggcccagatgatgaatatttatgccgtacttttcctgatgtgaaaaaattttggggtagtcgagatgttttgggtttaggccattggggtaaaacagatttacaaattgctcctctgtaccttttaccagcagagtttgagcatcatgttcaagaaggatatcaagccacagccaccttgaatcagggaataattcgcgaacttgcaaccaataattattgccgttgggagtatgaaattcaaccaatatacggttggggtaataaaaatagcattcagcaatcaaccgcaggttggctgtcattctcgcagatttttgaacccggatggcagattttgatggctcacggtttagccagtgggaaaattgattggaatggcaaaatctacgaattcaccaacgtcccagcttatggagagaaaaattggggtggtgcttttccgcaaaaatggttttggataaattgtaattgctttgagggcgaacccgatttagcattaactgctggcggtggacggcggggtgtgctgtggtggatggaatctgtagcgatgattgggttgcactatcaagacaagttttatgaattcgttccctggaattcacaagtagactgggaaattcagccttgggctagatggcaaatgaaagctacaaattctaattatgaaattgaattgacaggaaccacagatttagctggtacacctctgcgtgcgcccacagcagaaggtttaagatattgttgccgagacaccatgcaaggaaagttaactttagagttacgagaaataaatggcagaaaatctcaaataatcttaaaagcagaaagttttctttgtggtttagaagtaggtggcggctcttggcataatgtttggcagtctcggtaaaagtactgctataattatatgtgcttcatagttggggttgtagctcagttggatagagcggacgcctcctaagcgtcaggtcgtgcgttcgagccgcaccagtcccgtaa

SEQ ID NO: 822 - DNA, 5001 bp, Oryza sativa
  CDS (45)..(1040), (2559)..(2738), (3841)..(4098), (4927)..(4998)
ctgccgccgccgccgctaaaaccctaaaacctccaacctcacccatggcggcgagcagcgccgatctcgccgacgacggcttcccggcgccgcgcctcttctcgcagggcgtctcctacacctacgacgacgtcatcttcctcccgggctacatcgggttcccggccgacgccgtggacctctccacccgcctctcccgccgcatccccctctccatcccctgcgtggcctcccccatggacaccgtctccgaggccgccatggccgccgccatggcatccctcggcgccgccgccgtcgtccactgcaacaccgagccccacctccaggcctccatcgtccgcgccgccaagtcccgccgcctcccgttcgtctcctccgtccccttattctcccccgcctccaccccatccctctccgacttcgctggccacgactacggcctggtcacggagcgcggcgattcgctctccaagctcgtcggcgtcgctgttgcagccgagacctcctctcgtcaggctcccctccctgtctccgagtacatgcgccccgccccgcgctcggtgtccgcctcttttgatttcgagcaggcggccgcctttctagcggacgagggtttggattatgcccctcttgtatccgatgatagcgaggtaatcgacctcatcactgtcaatgatgtggagcgcatccggagctatccgaagctaggcaagccgtctcttggagcggacgggaagtttgttgttgcggcttccattgggacccgtgaggatgacaagcgaaggctggagcagctagttaaggcaggggcaaatgcgattgttgtagatagctcgcaggggaactctatctaccagattgatatgatcaagtatgcaaagaagatgtacccggaagtggacttgattggaggtaatgtggtgacgattgcgcaggcacagaatttagttgcttctggggtggatggattgcgtgttgggatgggctctggctcaatttgcactacccaggaggtttgtgccgtgggccgaggacaggtaaatgctcgataaagttcccataaattttttcttcctgagtttttaaattcaattacacaatacattcaaccttctggagaatttattagttatctagtttgtggatcctctgccatgtataggatgaccagcatgcccgtgctgcctcttgttctgagaaccatctgatgcttttgttttagagttaattgcactttggtccaccttttattaccaaagtttcactttggactattctctagctcatattttcactttggaccaggtaagattacctttggtgcactttggaccaccccaagtcattttctttagctgtatttactctataaatgttgtaaagaattacctgcgtaagttggaaaagattactgggttacgggttgctgatgtgtttaaagttggaacagtcttttatgtattcctaaaaaagtttatgggggtggtccaaagtgaaagaaaggtaaagtaacctagcccaaaatgaaaaaatgtgttaaagggtggtccaaagtgaaactttggtaataaaaggtggccctaaacgcaatttactctttgttttatttagaggtctggtaacgagacagaaacattgtttggttacttgtatccccacttttccacaatcccgtgccgaaagtgtgacaaactgcagattttgtgtctcaaaattggtcaccacacttgtggcctattttggctatggagagagttgatgacaagtggggctaaagggttagaaagtgtggcacaccgtagtgatagtaacaaaccaaaagcaccagccatatttggtcaaatccacctaactgatgtgcgacaatacttggcagccatccaaataggcccagaatctgatgccttactaaaatttctaatccttcatctctgccttgctatcccaagcatctaaactagattctgatgccttgctctaatttataatccttcctctctgccttgttatcccaagcatctatccaagcatctaaactagttggatgcttcgtctctgcattgttatcacaagcatctaaagttctaaactagttggatgatctatagcgtcttccatttccaccaacactcaggaggatatggatatcctgtttcatatttttagatggcacaaagtgagaatgagtaggtgttaggttcttcttgtttaattaggctgggttgtccagacgttacattttaagtgtgaactttgtgttagttgctacaacctcccattcatacccgtggaacctgggcattatgttgtttacgagattttgttctgtgatgtattgagaccttgtccagctcattccttttctgctgtttttagacctaaacttgaaatgaggtttgtataataagtggatcatgggacatgtggcggatacaaatgttatagggatacaacaaatatggtatatatatggtatatatcgtataccaaagaattttggcactgctgtgtgctgcatgtgtttgatacttgtttcttgcatttctgtgcgacaggctacagcagtgtataaggttgcatcttatgccaaagatcacaatgtgccagtcattgcggatggtggaatttcaaactctggacatattgtgaaggctttgtctctgggggcatccactgttatgatgggtagcttcttggctggcagccatgaagctcctggtacttacgagtacaaggtattcaattttttaaagcttctgcaggaatttttaggttcagcatgtgattttatttctgatatgcttttaccatgcataaactattttgtagttctttagcaatgtctgtctgagtctgtacaaccgtacgtattgaattgatactttgaaggacgacccacatgccatgcacatgcaaatgtacatcccatgtgaccactgcaatgaaaacatgctatcaatgtttaggcaatattttggtctaattgatgccataaaagtgctaatcaggccgtcataaaagttcctatataagatgattgtgtgtttagatatgttgcttctgaatatttgcttcatggatgacaatattagtaacatggctgctgaaaatcacagttttttaaaacacaacaaacctagtagcgagagacactgagacaatttgcctcctgtgctttgtatgagattgctctgtctgaaccaattgccagcacatattctgttaagtgtaaatactagatatatgtgtgttctattggtctttcacatcactcttggtgatcacaatctgtgtgcctgaagtattcatgttagttcttaattatttctgcaagtgcaaccagtggcatggctagattgttctagctagttgttttaaggtcatatctggtaattagaaaccattgttttggataaccactcttattcttcaatgatgctttgggtgaaaccacaccttagcattttccatttgcagatgtttcagtaaatttgacctgctttaggattattactacaatatactagtaaaaatggggtgataagctgccaatatattagtagctattattgtcctatcttagattgccaatgtgatgcatgtagttgataggatcatgtaatttaatgggcaacattaatccttaaaatattttgaattattataattaagatgtcttcagcattttcctgtgtcatttctagcactgtgtcgtagaagtgggtttttaattgcttattgtgttggttggtcgaatatatttatgttactcttatcacacgtacctgttgtttcactccctcctgtctgaaattatggttcttggaatgcttttaggatggccaccgtgttaaaaaataccgaggcatgggctctctcgaagcaatgacaaaggggagtgacgccaggtacctaggcgataccctcaagcttaaagtcgcccagggagttgttggagcagttgctgataaaggttctgtgctgaggttcattccttatacaatgcaagctgttaagcaagggttccaagatcttggtgcgtcatctttgcagtcagctcatgagctgctgcgatcggagactatcaaattagaggtatctccatgctggacaacatttttaaattatgaaatggaataataatgttaagaatgttagattggataaaatgctttttaacagtacaatttttagaagataatgaacacattccctgtttctaggactacacatgcttgcaggctacagtataaacgctgcctttctgcctctaaattgaaaaaaaaaaggtttagtatcagaagtaaacagctaagatatggtgaataagctgttccactccctattttatagagtatgaatcttatttcccgtgcagtactggctgcttttgagcttattctctgccagctaaaacatagtaaaaattccaagggattagagatcgataaattttaatgttgtgataaggcttcaaggcatatgattttcacccccaagtgaaattcagattgcaatgctcgaggaatgttctattgttgttatgcttgacctttgttttcaagattaagggacgatttacctcatctcgcgaccaaactgtccctgccaagtataatcggtcgtttgttcataccaccaaatgaagtctcctttttagtaaaaaccaaaacggcatactagtagctaactgaacattgtggtcgaataaaactgaaaatgcacaagacgccttgctcgtggatgatgtatagtccataaagtacatgaactgatttaaaattccccaaattatttatgttcatagcattgttaccatgtgtgtttctcttgaaatgctatactgattttgtttaacccccctcccctcccccccaaaaaagaacagagaactgatagaacttttaccatcttccttttcaggtgaggactggcgccgcgcaagttgaaggggggatacatgggctagtgtcgtacgagaagaaggcattctagttc

SEQ ID NO: 823 - DNA, 1772 bp, Saccharomyces cerevisiae
  CDS (101)..(1669)
aataatactttttaactgtcataaacgcattttgtttattacaaattaaaagaattaaatataatcagtgcaattaataactccacaagtagcaaaagcaatggccgccattagagactacaagaccgcactagactttaccaagagcctaccaagaccggatggtttgtcagtgcaggaattgatggactccaagatcagaggtgggttgacttataacgattttttaatcttaccaggtttagtcgattttgcgtcctctgaagttagcctacagaccaagctaaccaggaatattactttaaatattccattagtttcctctccaatggacacggtgacagagtcagaaatggccacttttatggctctgttgggtggtatcggtttcattcaccataactgtaccccagaggaccaagctgacatggtcagaagagtcaagaactatgaaaatgggtttattaacaaccctatagtgatttctccaactacgaccgttggtgaagctaagagcatgaaggaaaagtatggatttgcaggcttccctgtcacgacagatggaaagagaaatgcaaagttggtgggtgtcatcacctctcgtgatatacaattcgttgaggacaactctttactcgttcaggatgtcatgaccaaaaaccctgttaccggcgcacaaggtatcacattatcagaaggtaacgaaattctaaagaaaatcaaaaagggtaggctattggttgttgatgaaaagggtaacttagtttctatgctttcccgaactgatttaatgaaaaatcagaactacccattagcgtccaaatctgccaacaccaagcaactgttatgtggtgcttctattgggactatggacgctgataaagaaagactaagattattggtaaaagctgggttggatgtcgtcatattggattcatcccaaggaaactctatcttcgaattgaacatgctcaagtgggtcaaagagagtttcccaggtctggaagtcatcgctggtaacgttgtcaccagggaacaagctgccaatttgattgctgccggtgcggacggtttgagaattggtatgggaactggctctatttgtattacccaagaagttatggcttgtggtaggccacaaggtacagccgtctacaatgtgtgtgaatttgctaaccaattcggtgttccatgtatggctgatggtggtgttcaaaacattggtcatattaccaaagctttggctcttggttcttctactgttatgatgggtggtatgttggccggtactaccgaatcaccaggtgaatatttctatcaagatggtaaaagattgaaggcgtatcgtggtatgggctccattgacgccatgcaaaagactggtaccaaaggtaatgcatctacctcccgttacttttccgaatcagacagtgttttggtcgcacaaggtgtctccggtgctgtcgttgacaaaggatccattaagaaatttattccatatttgtacaatggtttacaacattcctgtcaagacatcggctgtaggtcgctaactttattaaagaataatgttcaaaggggtaaagttagatttgaattcagaaccgcttctgctcaactagaaggtggcgttcataatttacattcttacgaaaagcgtttacataactgaatgttaaaatggcatcatcaatacagtattactgatgttatgttatttagtgctgtccgtatgtcctcctgttcttttttgggctacaatttaattgatg

SEQ ID NO: 824 - DNA, 1467 bp, Escherichia coli
  CDS (1)..(1467)
atgctacgtatcgctaaagaagctctgacgtttgacgacgttctcctcgttcctgctcactctaccgttctgccgaatactgctgacctcagcacccagctgacgaaaactattcgtctgaatatccctatgctttccgcagcaatggataccgtaacggaagcgcgcctggctattgctctggctcaggaaggcggtatcggctttatccacaaaaacatgtccattgaacgccaggcagaagaagttcgccgtgtgaaaaaacacgaatctggtgtggtgactgatccgcagactgttctgccaaccacgacgctgcgcgaagtgaaagaactgaccgagcgtaacggttttgcgggctatccggtcgttaccgaagaaaacgaactggtgggtattatcaccggtcgtgacgtgcgttttgttaccgacctgaaccagccggttagcgtttacatgacgccgaaagagcgtctggtcaccgtgcgtgaaggtgaagcccgtgaagtggtgctggcaaaaatgcacgaaaaacgcgttgaaaaagcgctggtggttgatgacgaattccacctgatcggcatgatcaccgtgaaagacttccagaaagcggaacgtaaaccgaacgcctgtaaagacgagcaaggccgtctgcgtgttggtgcagcggttggcgcaggtgcgggtaacgaagagcgtgttgacgcgctggttgccgcaggcgttgacgttctgctgatcgactcctcccacggtcactcagaaggtgtactgcaacgtatccgtgaaacccgtgctaaatatccggatctgcaaattatcggcggcaacgtggcaacagctgcaggtgcacgcgctctggcagaagctggttgcagtgcggttaaagtcggcattggccctggctctatctgtacaactcgtatcgtgactggcgtcggtgttccgcagattaccgctgttgctgacgcagtagaagccctggaaggcaccggtattccggttatcgctgatggcggtattcgcttctccggcgacatcgccaaagctatcgccgctggcgcaagcgcggtgatggtaggttccatgctggcgggtactgaagaatctccgggtgaaatcgaactctaccagggccgttcttacaaatcttaccgtggtatgggttccctgggcgcgatgtccaaaggttcctctgaccgttatttccagagcgataacgctgccgacaaactggtgccggaaggtatcgaaggtcgcgtagcctataaaggtcgcctgaaagagatcattcaccagcagatgggcggcctgcgctcctgtatgggtctgaccggctgtggtactatcgacgaactgcgtactaaagcggagtttgtacgtatcagcggtgcgggcattcaggaaagccacgttcacgacgtgaccattactaaagagtccccgaactaccgtctgggctcctga

SEQ ID NO: 825 - DNA, 1512 bp, Agrobacterium tumefaciens
  CDS (7)..(1512)
ttggtcatggcacgcatcattcaaacacccactggtttggacgctctcacatttgacgatgtgttgctgcaacccggacattccgaagtcatgccgggacagacaaatatcgccacccgcattgcccgcgatatcgatctgaacctgccgatcctctcttccgccatggatacggtcaccgaaggccgcctcgccatcgccatggcccaggccggcggcatcggtgtcattcaccgtaaccttacccccatcgagcaggccgaagaagtgcggcaggtgaagaagttcgaaagcggcatggtcgtcaatccggtcaccatcggccccgacgcgacgcttgccgaagcgcaggcattgatgaaggcgcacggcatttccggcattccggtggtcgaaaacggcggtgccggcggccacaagaatggccgcctcgtcggcattctcactaaccgcgacgtgcgcttcgcctccgatccgcagcagaagatctacgaactgatgacccgcgaaaatctggtcacggtcaaggaaagcagcgtcgatcagcaggaagcgcgccgcctgctgcacaagcaccgcattgaaaagctgctggttgtggacggaaagggcaattgcgtcggtctcatcaccgttaaggatattgagaagtcgcagctaaaccccaatgccaccaaggatgcgcagggccgccttcgcgccgccgccgccatcagcgtgggtgctgatgccatcgagcgcgccgaacgcctcatcgatgccggcgttgaccttctggtcgttgataccgcgcatggccattcgcagcgggttctcgatgccgtggcgcaggtcaagaagatgtcgaactcggttcgcatcatcgccggcaatgtcgccactgccgacggcaccaaggcgctgatcgatgccggtgcggacgccgtcaaggtcggtatcggccccggctccatctgcaccacccgtatcgtcgccggcgttggcgttccgcagcttgccgcagtcatggccgcagtcgaagcggccagcctcgccgatattcctgtcatcgccgatggcggcatcaagttctcgggcgatctggccaaggcgatcgccgccggcgcttccgccgtcatgatcggctcgctgctcgccggtacggatgaaagcccgggcgaagtgttcctgtatcagggccgttccttcaaggcctatcgcggcatgggttccgttggcgccatggcgcgcggttccgctgaccgttatttccaggcggaagtgcgcgatacgctgaagctcgtgcctgagggtatcgaaggtcaggtgccctataagggcccagtctccggcgtcctgcaccagctggccggcggcctcaaggctgccatgggttatgtcggtggcagcaacatcaaggaattccaggagcgcgccaccttcgtgcgcatttccagcgccggcctgcgggaaagccacgcccatgacgtgacaatcacgcgtgaaagcccgaactatccgggcgcggtttga

SEQ ID NO: 826 - DNA, 814 bp, Zea mays
  CDS (102)..(599)
attcggcacgaggcaccgagctgccctgctacacggtcccctgccaagatccatcttcccggttacgccgcctgatcgaagtgaacaagcaaggaagagccatggcgagcgagcacgcggcggggggcgaggctaagcatgaccagaagcagagcctgatggacaaggcgaaggggttcgttgtggagaagatcgcgcacatccccaagcccgaggcgacgctggacggcgtgacgttcaagggcctgagccgggagtgcatcacgctgcacagcagcgtgaacgtgtccaacccctacgaccaccgcctccccatctgcgaggtgacctacacgctccggtgcgccggcaaggaggtggcgtccggcaccatgccggaccccggctggatcgccgccagcggctccaccgcgctggagatccccgccaaggtgccctacgacttcctcgtctccctcgtcagggacgtcggccgggactgggacatcgactacgagctccaggtcggactcaccgtcgacctccccatcgtcggcaacttcaccatcccgctctccacctccggcgagttcaagctccccaccctcaaggacttgttctgatctagtagtagctcgcttgccttctgttctgtgcgggcgcgcaccagcgatctgtacgacgagcttttgcaaataaacgacgcagctcctctgttctatatatctcagtgaatgcctaagctaaggggatggatggtttaataaataaagagctggatttcattcaaaaaaaaaaaaaaaaaaaaaactcgagcatcatcagaggccgcatc

SEQ ID NO: 827 - DNA, 765 bp, Zea mays
  CDS (69)..(461)
gaagtggtttccaaagccaagtgtgtgtactagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaagaaggaccacaaggacgccgaggaggccagcggcgagaagaagcaccaccacctcttcggctgaccgtagtaccggccggcgcgcgaccgagctagctagctccggcgcacacaaccacacacctgtttaattctgtactgcatgcgtgtgtaatttgatggttcacaataatgagtccctctccggaccttggtagctgcttgcttgtggtgagtgagagtgtgagactgagggagaagaggtggtgggcgtggggctacgtcgagagaggcgtgttcctgtaatcctgtactcgcttcgttttctctgcatgcgtctataattgtgttcaataataagtgagagcggtgtgatgtgtgggctc

SEQ ID NO: 828 - DNA, 836 bp, Oryza sativa
  CDS (71)..(487)
attgtcacttccatctcattctcctaattgtcatcactagcttctagctagcttaattaattaattagccatggcggaggagaagcaccaccaccacctgttccaccacaagaaggacgacgagccggccaccggagtagactcctacggcgagggcgtctacacgtcggagacggtgaccaccgaggtggtcgccggcggccaggacgagtacgagaggtacaagaaggaggagaagcagcacaagcacaagcagcacctcggcgaggccggcgccctcgccgccggcgccttcgccctgtatgagaagcacgaggcgaagaaggacccggagaacgcgcacaggcacaagatcacggaggagatcgcggccacggcggcggtcggcgccggcggctacgccttccacgagcaccacgagaagaagaaggaccacaagagcgccgaggagtccaccggcgagaagaagcaccacctcttcggctgatcgacctcatcacaacgtcgccggcggcggcgacgacctcgccgtacgtcgccggccgccgtgtcgtcgatttgtgtgtgtaataatttgtcttcttctgcatgcgtggtgttgctgtttttcacaagagtctccggcctcgaccagtgagaggctgacaggtggggccgtgagttcagcttgtgttgcttgattttctctgcagccttgccctctgtgtgtccaaataagtggtgtgcatggctctctccgtgtcatgtatcaatgtatttttatctgtactttgtacaagtgaagcaatatctatcgaaccttgactttctccaaaaaaaaaaaaaaaaaaaaaaaa

SEQ ID NO: 829 - DNA, 801 bp, Oryza sativa
  CDS (37)..(326), (451)..(703)
cgatccgtcacgacgtgcgcgcgcgcgagcgagaggatgagcgcggcggaggagagaggagatcggcaggagcgggacgatggggaaggtggagaggaggagcggcgggagcgaggcggggtgggcgggctggtggacagggccaaggggttcgtggcggagaagatcgcgaaaatccccaagcccgacgcgacgctggaccgcgtctccttcaagggcgtcagccgcgagtgcatcacgctccacagccacctcgacgtcaacaacccctactcgcaccgcatccccatctgcgagctcacctacaccttcaagagcggcgacaagtgcgtgcattatttacataattgttagccggcgcatccagttagttcgtgttcaaattatccgaagcaaattaaaaaagagtcagctggctggttctcgcgcgatttgcgtcaatttttgcagggtgatagcgtccggcacgatgcctgacccagggtggatcgcggcgagcgggacgacaaatctggagctgccggtgaaggtgccgtacgacttcatcgtgtcgctgatcaaggacgtgagcggggactgggacatcgactacgtgctggaggtcgggatcaccatcgacctccccgtcgtcggcagcttcaccatcccgctcgccaccgagggtgagatgaagctccccaccttccgggacctcctcttctgaaaacctttctgattcatcggggcatagcccaagtggtttgttaatttaacttgcgtgtaataaggaatgtacgtacggtgaaaatcttgttgcagcat

SEQ ID NO: 830 - DNA, 795 bp, Zea mays
  CDS (151)..(690)
gcgcacggctcacgttgtccgcctcacgtaaaggtcggtgccttcgtctcctatctctcctcgcgcagttccacttcccatttcctccttcgtccgcatcagggacacactgcctccgcatgcggcaagatcctccctcattccccaaacatgagaggagcagaggaggagagatctggcgccgccactgatgcgggaggagaggaggagaaacgggagaggagcgtcggcctgatggccggcctcatggacaaggccaagggcttcgtggtggagaaggtgacgcaaatccccaagcccgaggctgcgctggatcacgtctccttccagagcatcagccgcgagggcgtcgagctgcatagccacgtcgacatcagcaacccctactcgcaccgcatccccatctgcgagatcacctacacgttcaagagcgccggcaaggtgatagcgtcgggcacgatgcccgaccccgggtggatcgcggcgagcggcagcaccaagctagacctgcccgtgaaggtgccgtacgacttcatcgtgtcgctgatgaaggatctcggaggggactgggacatcgactacatgctggaggtggggctcactgtcgacctccccgccattggcgcctttactatcccgctcaccaccgagggcgagatcaagctccccaccttccgggacctattgttctaagcaattcagatgtttggtgtatgaatcgatttgttttcataccataatcagtgctgatgtggatttgcaaaaaaaaaaaaaaaaaaaaaaaaaaaaaaaaaa

SEQ ID NO: 831 - DNA, 748 bp, Zea mays
  CDS (89)..(511)
gaacagctgtcgatccaattgtcacttgctctccctccaacaagctaattaaggccggtcatccctcttctagctcgtttcattatccatggcggaggagaagcaccaccaccaccacctgttccaccacaagaaggacgaggagcaggaggagcagctcgccggcggcgggtacggcgagtccgccgagtacacggaggccacggtgacggaggtcgtgtccacgggcgagaacgagtacgacgagtacaagaaggaggagaagcagcacaagcacaagcagcacctcggcgaggccggcgccatcgccgccggcgccttcgcactctacgagaagcacgaggcaaagaaggacccggagcacgcgcaccgccacaagatcgaggaggaggtcgcggcggcggcggccgtcggctccggcggcttcgccttccacgagcaccacgagaagaagaaggaccacaaggacgccgaggaggccggcggcgagaagaagcaccacttcttcggctgattgatcctcccgtatcgtcgtccctccccgtgtgctacgcgtgcgtgtgtgagagtgatatcgagcgcccgccgtgttgtgcgcgcgtacgtatgtatgcgctcgtgtgatgcacgaataagcgtggctacgtaatctatcgtatgtatacgtgtgtgtatgcatgtgcttgtgtatgatcgtggtacgaggaccgaaaaaatgtatgcaactctgatttacttaaaaaaaaaa

SEQ ID NO: 832 - DNA, 1320 bp, Zea mays
  CDS (220)..(1254)
attcggctcgagcgccaccatccaatcgaagctctggaacctcctccactcccagcttccgccgacgctcgcttcagctgctgctttccttcccatccttcaacaggtgcaatttgcatttcccatggagctcactgattaataacgtgtgagctgaacttgcttttctgtggacaatttggaacttcagtactagtttccgataggattcagggagaaatgatctcttttaacaatttattttggagctcccttcagccttctttcaagttttacagaaagtgcctgacaaactgcccatattttgcactgaccatgcattcaactacaaagcccttgggttcatctatgccggtaaagagggcgcatttgaagccacatgccgcagacatcaagaggaacccccatgtacatgagctttacaaattggtttaccgacttccggagaaccttagctggctgttggcaccaccagaaattcctaaaagacctgcctcaaagaagaaaaaacaaaaagacgaaatagtggccggtaacagctttggtgtgatcttggagtgggagggagttgttgtggatgatgatgatccagacttggagccccgggtttggtatgttctatcactagaagaggggaagtctttccctccagatgcattgctgaagaaaatcgagggaatgagaactgaccaggctattgcagaagtcttatgttggtcagaagatccagcagaaatccaaaggttggcaacacacaaggaggttatatatcaaaaacttcaaggtggatactaccagctgcgaccacatgtgcttgatttcttgaacacccttgtgggttttgacattccaatagcaattgcagctcctcgctcaaggaagagccttgaagaagggatcaaaactgttggtctgcaaggctacttcgatgctatagttgcattggaggacttctgcttagggaaacctgatggtgagatgtttgaagtcgcagcggagcaacttggtctggaaccagatgcctgtgttgtgtttggtaactcaaacttgacgacggaatctgcacataacgctgggatgaggtgtgtggcagttgcaggccgacaccctgcctatgagctccaatcagcaaaccatgttgtgagatggcttgatcagctctctattgttgacttgcagaggcttgctaatggtgaagttattggtcgcaggggtagagaatctgacatggatatggaaattgtgattgaggaatgatgatgtttctgcaaaaatgacgcactaatatattgttgtgcttataaaaaaaaaaaaaaaagg

SEQ ID NO: 833 - DNA, 1710 bp, Glycine max
  CDS (365)..(1495)
attcggctcgagggaaacgtatagaaaaagcttttccaagaattggcaaaaagagaagaagggagagagattcatgttcatattttccccttcgtgcccgtcaagtttctgattctctttttcaattcctttctctttcaggtgattttttctccacgataaagttgcgatttcgccggtgtcgttttgccgcaagatggtgtcgttttcgggaatataaaatcagggttgaagttctttcttcagcattgaatctttggttacataggttggtttctttagaactcgattcaatttcaaataattggtcctccctttttgtggaactcaattctattaggttagtggaaagagaaaaaaaaacatggttgaatcaattgctgcaacttcactccttggccaccgtccaatttgtggtggaaatttaaccagggatgtatctgttaaacgcaaatctttgaatactgttcggttcccaacaactgagtttcttggtggtggaaggattgtggtttctctggctttgcctaaatctgataagcaagataggtttgtgttttcatcaattaaggccttggctgtggagttaacaagagaagcacatgcttatagggaagagaaattgcccaacagggataccaagattgatcgtggatttgatcaaaggcctgattcgtggcctcctgcgaatagggcagataaaccgtcgcttcggaatccactactccgtcatgagaggatgggatgtggttggttgggtgctatatttgagtgggagggtgttctaattgaagacaaccctgatttagagaagcaggcttggctggcactctctcaggaagaaggcaaaccctctcctcctgcttttatcctcaagagaatagagggcatgaagaatgaacaggcgatttcagaagtgctgtgttggtctagggatccggcacagttgagaagaatggctaatagaaaggaagaaatctaccaatctttgcagggtgggatatataggttcttgtctggatccaaggagtttgttagtgttttgatgcattataagataccaatggcattggtttccacgcggcctaggaaggctcttgagtctgctataggggagattgggattgaggacactttcagtgttattgtagcagcagaggatgttcataggggaaagcctgatccagaaatgtttgtgtatgctgcacagcttttgaacttcatacctgagaggtgcattgtgtttggtaactccaatctaacagtggaggctgcacatgaagcgcggatgaagtgtgtggctgttgctagcaagcatcctgtatatgagcttggggctgcagacttggttgtcaggcgcctagatgagctttcagtggttgatttgaagaatcttgcagacattgaaatgactgaatttgggtctgtggagcctgagatggagctggaggtggaaaaagattatggctcatcatcagttgatgacaatttctggtaaatcctataatgtacagttgattgaacctcatctgattgttgatgatattagttacaggttagttacttgtgtatatggtaatcagaataaatggggggaaaaaatgataagtggtatgcattgaacattgatgttactactaatgcattttctgttcatatacattcacgaatttttagatttaaaaaaaaaaaaaaaaaaaaaaaaaaagg

SEQ ID NO: 834 - DNA, 1201 bp, Oryza sativa
  CDS (110)..(1159)
tgtttttaagacaggtcaagtttgattcttctcttgttctctttgttctttataggagcagaaccagacttgccacgaaggatttgataatctaggggttcgggacgagatgatattttcagtcagcttatttggtagttcccaccagtccattcacaaactttacaggaaatgctggtcaagtaactcacattctacactgaatgtgctttcacttgcaaaaactgtgggtcaaagtatgagaatgaagaggatacgtgtcaagcctcatgccactgacctgaagaatcgcccccaggcccatgaggataatgtgttctacaaattggtttataggctccctgaaaacctcagctggctgttggcgtcaccagaaatggctagaagaccaccctcaaagaagaaactaaagaaggaagaaatggtaagtagtaatcaatttggtgtgatcttggagtgggaaggagttgttgtggaagatgatgatccagatttggagcctcgagtttggtacgtgttatcacttgaagaggcaaagtcttttcctccagatgcagtgctgaaggaaattgaggggatgaggactgatcaggctattttagaagtcttacattggtcagaagatccacaagaagtacaaaggctggcagcacgcaaggaggtaatatataaaacattacgtggtagattctaccaactgcgaccaggtgttcttgatttcctgaacacccttgtggattttgacattccaatagcaatcacaactcctcgcccacggttgagcctagaagaagggataaaagctgttggtcttcaaggctactttgatgctatagtggcagcagaggatttctgccgagggaaacccgagggggagatgtttgaggtcacagcagggcaacttggtcttgagcctgatgtttgtcttgtgctgggtaactcaaattcgacaatagaatctgcgcatactgctgggatgaggtgtgttgcggttgcaagccgataccctgcctatgagctccaagcagcaaaccatgttgtaagatggcttgatcagctatctgtcgctgacctgcaaaggattgccaatggcgagattcttgggctcaggggcagaagatctgacatggacatggacatggagattgtgatcgaggagtgatttttctatatgtatggtgtgctaatattgccctatgta

SEQ ID NO: 835 - DNA, 401 bp, Escherichia coli
  CDS (35)..(373)
gatcaaaagacaggcgaccttttcaaggaatagcatgaaaaagattgatgcgattataaaacccttcaagctggacgatgtccgcgaagcactggccgaagtcggtattaccggcatgacggtgaccgaagtgaaaggctttggtcgccagaaaggccataccgagctgtaccgcggcgcggagtatatggtggattttctgccgaaagtgaaaattgagattgtcgtaccggacgacattgtcgatacctgtgtcgataccattattcgcacggcgcaaaccggcaaaatcggtgacggtaaaatcttcgtctttgacgtggcacgggtcattcgcatccgtaccggtgaagaggacgacgcggcaatttaaaccgcgtcaagggttgccggatgtttcc

SEQ ID NO: 836 - DNA, 2493 bp, Nostoc PCC7120
  CDS (1074)..(1412)
tccattaccacaaagcacgaattggttcttttgcttggttggtgtcactagatacggtgtctcttgattgaacttctgtagtactagtatctgatgtattgtcagaagatgatgaatcagtggaattgttattttgagccacactagtctgttaccagtggatctgcgctcttcctgattgctgttgcctctttcttcagtattagtgttgaaattatcttgcgctacaccacttctgttttcattggtagtagcattggtgcgattgcgattggcagaggagctattaacattaatgttagctgggagtactttcgatgctttgcctcctggagcattattactagttgaagtattgttactagctgtttgttgctggccgcccattgggaagttaatgcctagcaatgttcccatgagaattgccaagcctccggccataagaattagcggtgtccatctacccatcttgatttctccttgttaacctaaccttctggttgccacactagctgagaaccttgaccccaaaatccgtcaaattttgttatcttcacatcacctaatacctgagtctgacaagctaaacgcaggtcttttgtaggagaatgaggaggaagcgaacgccgtgcttgatctcgccaattcgccacagacacttcaccttctacttggacagcacaggtaccacaacttaccaataccccgacagtttattaccttagcaccgctattgtagaggtcaatacccactttttagcagaactttgcgtaaattctctccgcgatcgcactcaattgttttacccctgagctaataccttaaggcatattttaatcagcaaactggcgttttgttgtatcttggcacattgcctttacagttgtctccaaagtcttagtcttatgaccaaaaatccctcaccccacatttggctttatgacaccacactacgggatggcactcagcgcgaagggctatcaatttctacagaagacaacgtacgcattgcccacagactcgatctggttagatatataaacgaagctactagaaattaggagtcaatgcaatgaaaaaagtagaagctattatccgcccatttaagctagatgaagtgaaaatcgctttagtcaacgcgggtattgtgggtatgactgtttctgaagtccggggttttggacggcagaaaggacagacagaacgctatcgcggctctgagtacactgtggagtttctgcaaaaactgaaggtggagattgtagttgaagataaccaagttgatatggttgttgacaaaatcattgctgctgctcgtacaggcgaaatcggtgatggtaaaatctttatctcacctgtagaacaagtaattcggattcgtactggagagaagaatacagaagccgtgtaagtaaggattattgttagtgttagcagggcgttatgctcgtgctgagtcttggtagagacgcgtttaatcgctgtctctacagaaaattttttacgcaaaacataatttcattcacagtcatcagcaggactcgatactaagttaagaattttatggtaatactgaaaagcaggcgtgatgacagccgttgagtaagagagcagatcatgactctggtttggcaagcagatttttatcgcagtcctcggcaagatttagatggaaaaatcttgtgggagttattaatttgtgatgtaaatcgtggtttcgagtatacggcgacttgtccccagtcagaagctaattctagttggttgactacccaaattcaattagcagcaggtgaaaaactaccagatattatccaagtttttcgcccccagtctttgagtttgattgaggcggctggacgcaatttggggattaatgtcgaaccgcaacgccaaaccccagctttgaaacaatggttacaagaaaagcaatattccatagcaatagataagccaccacctacaccgttaccggacaacttatggggcgatgagtggcgctttgctagtatccaagctggtgacatcgtggatttgtttagcgatcgcccaattcccattttatctttaccagaacccctcaaaccaattaatttaggcttggcatcaacagtggcgattcctggtgtggtaatttatggtggtaagcgatcgctaaatctagctagatggattgcccaaacccgcccagtagccttgaattatattgccggtgcgcccgatggtttgatactagaagctggtttggtggatagatggattttagttacttttgaagatgcagaagtaacggcggctgcaaaagtttatgaacaacgtcaaaaacaaagtcggggattacattttttattagtacagcctgatgattcaggtatgacttacactggcttttggttgttgcaagcaatatgatcttgactacctcatccaaataaaaacttcacccacaaggggatggaagtttgtcaagtggtcagtggtcaagtaccgta

SEQ ID NO: 837 - DNA, 880 bp, Brassica napus
  CDS (49)..(639)
gaattcccgggtcgacccacgcgtccgattttactactctcatcaatcatggcggcttcaatcgcgaaacccatctctgcaacctctctccgtttctactccgaccgaaagaacaacatttccttctcagattgcatctcgatatcttctgggttccgacattccccaccgtcttccctcgatttggtcgcaaaaccaccaccgaccaaggctcgcgtttcccatctcgttagagcccaaagctcttatgattatattccagactcaaagttttacaaggtggaagcaattgtcaggccatggagaatccagcatgtttcatcggctttactgaaaattgggattcgaggtgtgacggtttctgatgtccgagggtttggtgcacaaggtggatccaaagagagacatggtgggtctgagttctctgaagacaagttcgttgctaaagttaagatggagatcgttgttaagaaagaacaagtggagtctgtaatcaacaccataatcgatggagcaagaacaggagagatcggagatggcaaaatattcgttttgcctgtgtcagatgtcataagggttcggacaggtgagcgtggagaacaagcagagaagatgactggtgacatgctttcgtcatcttaggcacaaacaagagcttaagaatggcgtaataataaaatgaatggatgtgtttagttttctgttttgttgctgagttgatcaagatgtgtgtttaaactgtacatgaatgatgcagaaacatctgtcttggttctcagactgttcctagtaaaaacatgtagtccctgtttcatgtccttgtccgattatgaatccactagtatctatgttgtcaaaaaaaaaaaaaaagggcggccgc

SEQ ID NO: 838 - DNA, 1888 bp, Zea mays
  CDS (239)..(1717)
caagccgtatcgtcttctccctcttgtccggttcgggtggtccgcggtcggggtgagtgagtgagcagctttgcttctccatctccccgttcccttccctccccagccccccggcccggcggcggtacgtgaccctgacgccgcagcgctagctagctcgccggaacggcaggtggcggcgcgcgacctgagagcacagcagcaccggaccggctcaggcaggcgaccggcagaaaagatggcgggagcagcagctgtggagacggcggcggcggcggcagcggccaacggaaaagcgtgctgccacgccgccaaggggcccgggtacgccacgccgctggaggccatggagaagggccccagggagaagctcgtctacgtcacctgcgtctacaacggcactggaattaacaagccggattaccttgcgacggtggatttggatcccagctctcctacatactcccaggtgatccacaggctcccggtcacccacatcggcgacgagctgcatcactctggctggaactcctgcagctcctgccacggtgacccatcggccaagcgccgcttcctgatcctgccttccttgctgtcaggccgtgtgtatgtcgtcgacacagcgacagacccaagggcgccatccttgcataaggtggttgagtctgaggacattgctgagaatactgggcttgggttccctcacacgtctcattgccttgcgtctggcgacattatgatttcttgccttggggacaaggaggggaatgcagctggcaatggcttcctgctgttggattcagagtttaatgtcaaaggacgttgggaaaagccaggtcacagtcccttgtttggatatgacttctggtaccagcctcgccacaagacgatgatcagttcgtcatggggagcccctgcagcgttcaggacaggtttcgatcttcaacatgtccaggatggcctgtatggaaggcacctgcatgtgtacgactggcctggcggtgagctcaagcagacacttgatctaggtgacactggactccttccccttgaggtgaggtttttacatgatccatcaaaggacactggctatgttggctgtgctttaacaagcaacatggtgagatttttcaagaccgcggatggatcgtggagccatgaggttgctatctctgtgaaaccactgaaggtccgcaactggattctgccggaaatgccaggattgataactgatttcgtcatctctcttgatgaccgttatctctactttgtaaattggcttcatggcgatattaggcagtacaacattgaggatcccgcaaagcctttcttggctggacaagtatgggttggtggtcttcttcagaagggcagtgatgtcgtctatgttactgatgatggtcaggaacagcagtacaatgtgcctcaagtcaagggtcatcgacttagaggtgggccacagatgattcagctgagcttggatggcaagaggatatacgtgacaaactcacttttcagccgatgggatgagcagtttttcggtgatgatcttgtcaagaagggctcccacatgttgcagatcgatgtcgacaccgagaaaggaggcctggctgtcaaccccaacttcttcgtcgattttggcaccgagcctgatggtcctgccctggcccacgagatgagatatcctggtggggactgcacctctgatatatggatctgaggtcaaggattcggcgtaattaacaggctgctggagaatccctgttgttgtatgcactgtaattaacatggtatccgtgcggtgttctgtcttgtactgcgactgttgccagtggaataaggcatggtttcatgagaactctagattaataaaagaagtcctgattct

SEQ ID NO: 839 - DNA, 988 bp, Zea mays
  CDS (103)..(771)
gttccagctgctgatcttgatcctgcaccccgagccgtacacaagagctagtcggtagaacttgcaggagcggagcagaactaagtgcagagaacaggacatatggctacgccggcggtgaaggtttacgggtgggctatctcgccgttcgtatcgcgggctctgctggccctggaggaggccggcgtcgactacgagctcgtccccatgagccgccaggacggcgaccaccgccgcccggagcacctcgccaggaaccctttcgggaaggtgccggtgctcgaggatggcgacctcacgctcttcgaatcacgtgcgatcgcgaggcatgttctccggaagcacaagccggagctgctgggcggcggcaggctggagcagacggcgatggtggacgtgtggctggaggtggaggcccaccagctgagcccgccggcgatcgccatcgtggtggagtgcgtgttcgcgccgttcctgggccgcgagcgcaaccaggcggtggtggacgagaacgtggagaagctcaagaaggtgctggaggtgtacgaggcgcggctggccacgtgcacgtacctcgccggcgacttcctcagcctcgccgacctcagccccttcaccatcatgcactgcctcatggccaccgagtacgccgctctcgtccatgcgctcccgcacgtcagcgcctggtggcagggcctcgccgcgcgcccggcggccaacaaggtggcgcagttcatgccggtcggcgccggagcgcccaaggaacaggagtgacgatgaagcgatcgaagcgacttgtgttgttgtgcttgattagttaattggaaaccttctcactcatctagtccatcatggtgcctgcttttctttatactatttgtcttaattttgctgctttctccacggaataatagtagagatttggaaatgtaatgtattttatcaaaatatattggattttcaagcaatatagtatggttttcgctgc

SEQ ID NO: 840 - DNA, 1988 bp, Zea mays
  CDS (177)..(1844)
ccagtttttctcctctcgcccccgttccccgtcccgactcccgacccaacccatatcagaggttccgtccgttggtggcgctggcgttcccgtgagtcggcccgcgcgcgaaggcggccgtgaccgaccgtccggagcttcatgcgccaggggcggcggctccaccccgtcgtttgatgggcaacgcatgcggcggcgcccttagatccaagtaccagcacagcttcaagcacgccgcgtcgtcgcagcgccgcgcctcctccgagtacagcgccagcgccgtggccgacgactcgcccaggaagcccacgcagccgcccgccaccacggacgcccacgcgccgccaccgccgcccgccaccgccgcagccgccatgaggcgcggcggggccggcgcgccgccggacctggggtccgtgctcggccaccccacccccaacctccgcgacctctacgcgctcggcaggaagctcgggcaggggcagttcggcaccaccttcctctgcaccgagctcgccacgggggtcgactacgcctgcaagtccatctccaagcgcaagctcatcaccagggaggacgtcgacgacgtgcgccgcgagatccagatcatgcaccacctctccggccacaccaacgtcgtcgccatcaagggcgcctacgaggaccagctctacgtccacatcgtcatggagctctgcgccgggggcgagctcttcgaccggatcatacagcgcggccactacagcgagcgcaaggccgccgagctcaccaggatcatcgtcggcgtcgtcgaggcctgccactcgctcggggtcatgcaccgcgacctcaagcccgagaacttcctgctcgtcaacaaggacgacgacctctcgctcaaggccatcgatttcggactctctgtcttcttcaagcctggtcaagttttcaccgatgttgttggtagcccatattatgtagctccagaagttttgttgaaaaattatggaccagcagctgatgtatggacagctggcgtcattctttacattctactaagtggcgtgcctccgttttgggcagaaacacaacaaggaatatttgatgctgtattgaaaggtgtcattgattttgattctgatccgtggcctgtcatatctgatagtgcaaaagatcttataagacggatgctgaatcctcgctctgccaagcgcttaacagcacatgaagttctatgccatccatggattcgtgatcatggagtagctcctgaccgtccactggatccagctgtcttatctcgcattaagcaattctctgcaatgaataagttgaagaaaatggctttgcgagtaatagctgagagcctatcagaagaggaaattgcggggttgaaggaaatgttccagaccatggacactgacaacagtggcgcaattacctacgatgaactaaaagaaggattgagaaaatatggttccacactgaaggacactgagattcgtgatcttatggatgcagctgatatcgacaacaatggaacaattgactacattgaattcatcgctgcaactttgcatctcaataagctggagcgcgaagaacatctcgtggcggccttttcatatttcgacaaagatggtagtggctatatcacagtggatgaactacagcaagcttgcaaagagcataacatgccggatgcttttcttgatgatgtcatcaacgaagctgatcaggataacgatggccgcattgactatggagagtttgttgccatgatgaccaagggcaatatgggagtcggtcgacggacaatgagaaacagcttgaatatcagcatgagggacgcacctggtgcattctgaaacttaacacgatgtacagcttgtggcctagtcacttcggccctgtttgtttcggcttctggcagcttctggccaccaaaagctgctgcggactgccaaacgctcagcttttcagccagcttctataaaattcgttgcggc

SEQ ID NO: 841 - DNA, 1284 bp, Zea mays; identical to SEQ ID NO: 749
  CDS (178)..(993)

SEQ ID NO: 842 - DNA, 830 bp, Zea mays
  CDS (46)..(747)
atttagaccaactagcaacatagaaagcacaatagtgtaccaacaatggcagccaaaatattttgcctccttatgctccttggtatttctgcaagtgctgctacggcgaccattttcccgcaatgctcacaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgttgcctacccccagcaatttcttccattcaaccaactggcagcattgaactctcctgcttatttacagcagcaacaactactaccattcagccagctagctggtgtgagccctgctaccttcttgacacaaccacagttgttgccgttctaccagcacgctgcgcctaacgctggcaccctcttacaactgcaacaattgctgccattcaaccaacttgctttgacaaacctagcagtgttctaccaacaacccatcattggtggtgccctcttttagatttcttatgagttatagttcaataataaagttttttgtctgatgtttgtggcttcccagaaataagaaagtacatttct

SEQ ID NO: 843 - DNA, 1516 bp, Zea mays
  CDS (114)..(1196)
tagggcccacgccccgtccgcgctctccaaagtttcgtccaccatttcgctctcgcaagtcgcaagccaccgatttgtttacaggcgccggagctcccgacgacgactgagccatgtgcggcggcgcgatccttgccgagctccgcgagccggcgccgcgccggctcacggagcgggacatctggcagcagaagaagaagcccaagaggggcggcgccggcgggaggcgctcgttcgcggcggaagacgatgaggacttcgaggccgacttcgaggactttgaagccgactccggtgattcggatttggagctcggggaaggggctgacgacgacgtcatcgagatcaagcccttcgccgccaagagtactttctccagagatggcttaagcaccatgactactgctggttatgatgcccctgcagcaaggttggccaaaaggaagaggaagaatcaatacaggggtatccgccagcgcccttggggtaagtgggctgctgagatcagagatccccagaagggcgttcgtgtttggcttggtactttcaatagtccggaggaagctgcaagagcttatgatgctgaagcgcgcaggattcgtggcaagaaggccaaggttaactttcctgatgcaccagcagttggtcagaagtgccgttctagttcagcttctgctaaagcactcaagtcatgtgttgaacagaagccaattgtcaaaacagatatgaacatccttgccaacacaaatgcacccttctaccaatctgttaactacgcatccaacaatccatttgttccagcaatgaactctactgtttcttttgaggatcctatcatgaatctgcactctgaccagggaagtaactcccttggctgctcagacttgggctgggagaatgatactaagacaccagacatcacatccattgctcccattcccactattgctgaaggcgatgagtctgtatttgtcaactccaattcaaacagctcgatggtgcctcctgtcctggagaacaatgctgttgatctcactgatgggctgacagatttggaatcctatatgaggtttcttatggatggcggtgcaagtgattcaattgatagccttctgaaccttgatggatcacaggatcttggtagcaatatggacctctggaccttcgatgacatgcccatcgctggcgatttcttctgaggaatttgaagcttggccataggactatgtacatagggactagggaataaagactgggagattgggaagcacctgcttggcaccttggggtagcatatgctcgtgtctagctcagatgcagaagtcgcattctgaaactctttggttatcgacctgttccctattttaactatctctgtatgagagccatttatgagactgaaccattttaccattttgttttcccccttctttcgttgttacagtatatggtttaacattatgatttatggatatgtggccaaacatgccttttatatgcgctttgtgcttggttg

SEQ ID NO: 844 - DNA, 1605 bp, Zea mays
  CDS (145)..(1275)
cctttgcgtgaagagagctaggtgggccgtagaaaaggcttcagttcagatctcatttcagatagcacaggaccaatctggtctgcagtgttcaactggaatataagatttcgctgcataggtcaaagactagcagatactgtcatggctcaggatgaagctgtggctacccaaaagactggaaatacaacatctccttctaaggattacccaactccttctccatatcctgattggtcaaccatgcaggcatattatggccctggtgtcttgccaccaacatattttactcctgcaatagctccaggtcatccaccgccatatatgtggggtcctcagcctataatgccaccccctttcgggacaccatatgctgcagtatacccacatggtggagcttacccacacccccttgtgcccatgatgtcaactccaatgagcgtggagccagccaaatctgcgaatagcaaggagaaaaattccaataagaaacttaaggaaatagatcggactgcagtgtctgctggcagtggtaacagtaaaagaacagtgtcatccattgaagattacagtgcagaaggctcaagcgatgtaaacgatcagaatgtgaacgaaacgtccaggaagcggagctcagatggtggacctggcgcagaaaccaccacaggtggaaacacggaatgtgttttagctcctaaccatacgctggggaatgctaccattttgccacaacactgcttttcagctccagtaattaagcccagtgctacaaatgtcgcgaactcgagggcgataggcacggcattatctccaccacctggtgtgatggttccagttcataatgcagtaccatctgacttatcagttaaggatgagagggaattgaagcgcgaaaagaggaagcagtcaaatagggagtccgctagacgatcaaggctgagaaaacaggctgagacagaggagttggctacacaagtggagtctcttgcagcagagaacacgtcccttagatctgaaatcggccggctaacagagagctcagagaagctcagactagagaactcagctctaatggtgaagctgaaggacaccgcagaaccgtctcccagcaaagcagccgcatccccatcctctccccgtgcctcggcggagaacttcctttccatgatcgacagcgccaacgcgccgagcgtcagcaggcacacggagcacggcggtcccaggctccggcagctcctggactccagtccggcgacagacgtcgccgccgtaagctgatgatgaagccggtccggcaaatacgccacagcacatgcatgtggcctggggattccgcaggctcatgcggctcgagtgctcgccgtaaacgtcagcgttacggactcggactctgtactccagtttaggcactgattccaccgagggtaccggtaattttatctgctctcgcgccagagtgccgggctgcctgcgaccactcctgtgtacccagagttgtaacgtagtagggtgttgtgctgcatgccgaccttttgaaacttttcgagaccgtcatttggaccatttttttcgtcgcaataacacaatacagatcggagtttgtac

SEQ ID NO: 845 - DNA, 970 bp, Zea mays
  CDS (145)..(615)
ccccttccctccctccctctccccgcgggccgccagaggcaatttcgccctcgattcgaccccgattcgtccgcccgcgaccgggattccctccgccaagcgcggatctgaacgctgcgctccgtgtcgccgctcgaatccgccatgaagggggccaaatccaagggcgccgccaaggccgatgccaagctggcggtgaagagcaagggggcggagaagcccgccaagggcaggaaagggaaggccggcaaggaccccaacaagcctaagagggctcccagcgctttcttcgtgttcatggaggaatttcgcaaggagttcaaggagaagaaccctaagaacaagtctgtcgctgcggtggggaaagctgctggcgacaggtggaaatccctgagcgagtcggacaaggctccctatgtagccaaggctaacaagctcaagctcgagtacaacaaggccatcgctgcctacaacaagggcgagagcactgcagctaagaaggctcctgccaaggaggaagaggaggaagatgaagaggagtctgacaagtccaagtcggaggtcaatgacgaggatgatgaagagggtagtgaggaggatgaagatgatgacgagtgatggagctcctcgagacaatggaccgtgcttcatccaacaatggagcggctacacaaggccccgtggcgatcacaaaaaaggagcctatatccatgtactagaattattcagtttcactccacatcgtgatgttttatttttacttttgtcgtgctataacggatagcgctcctcgttggcgccactggcgggtggttctgcctctggtctggtgtgtttgtgtgtggtcacacttgccagccagcagaggcgcctgcttgtacctagattactgtttccattgtcgtcatcatcggctaacattgtcataatgtcagtttgggtaatgttagattaagtaattattgtgttc

SEQ ID NO: 846 - DNA, 695 bp, Zea mays
  CDS (70)..(492)
ctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtcccgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggctacggcggtcggcgcgaaggtggcggcggcggctacggaggcggtggcggctacggcggtcggcgcgagggtggcggtggcggctacggcggcggtggcggcggcggctggagggactgatgtgtgggcccatcctggcttcggccgagttatcttatctatctatagtatcgtgttaccgttcgcttctgtcaccgtgttagtgtccgttctacctttggattaggtgttggtaccctgttgttcgctttggttgctcccgctatgaaacgagacgagagaagaatgagcaaggtttttgttcgcagctatttttgtcc

SEQ ID NO: 847 - DNA, 1672 bp, Zea mays
  CDS (86)..(1423)
ggcgaggcaaaagcgcaaacgcgaccacagacagagcgcgcttcaaggccttttttttttgagataacaaggaggagaggaggagatggcggtcacgatcacctgggtgaaggcgaggcagatcttcgacagccgcggcaaccccaccgtcgaggtggacgtgggcctcagcgacggcagctacgcgaggggggccgtacccagcggcgcatccactggaatatatgaggccttggagttgagggatggaggatctgattatcttggcaagggtgttcttaaggctgtcagcaacgtaaacaacattattggaccagcgattgttggaaaggaccccactgagcaggttgagattgacaacttcatggtccaacagcttgatggaacctccaatgagtggggctggtgcaaacagaagcttggagcaaatgccatccttgcggtttcacttgctgtgtgcaaagctggagctatggtgaagaagattcctctttaccagcacatcgcaaatcttgctgggaacaaaactctggtgctccctgtacctgcctttaatgtgattaatggagggtcacatgctggaaacaagcttgccatgcaggagttcatgatcctcccaactggtgcctcctcgttcaaggaggccatgaagatgggagttgaggtgtaccacaacctgaagagcataatcaagaagaagtacggtcaggatgcgacaaacgttggggatgaaggtggttttgcacctaacattcaggaaaacaaagaaggccttgaactattgaaggcagccatagaaaaggctggctacactggaaaggtggtcattggaatggatgttgctgcttctgaattcttcggtgagaaagacaagacttatgatcttaatttcaaggaggagaacaacgatggctcaaacaaaatttcaggcgacagcctgaaagacctgtacaagtcctttgtttctgagtaccctatcgagtcgatcgaagacccatttgatcaggatgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagccccttgccggtctgagcgcctggccaaatacaaccagctgctcaggatcgaggaagagctcggtgatgccgcggtctacgccggagcaaagttcagggcaccagtggagccctactaagaaaggaagaggatgaggatgttttcttgtggagctatactagctcgctgctgccttttgttacaatgtttgtacggtcgcaataaatgtatggtcgtgtttgctcgagagctactcaggtgattttgtcgtgggagcaccaaaagcagaaaagaacccttttttttcaatctctctagattctgacgagtggtggtctgcactcgtcgtaatgtcgtttgcctaaactgattttgatggaacagg

SEQ ID NO: 848 - DNA, 1078 bp, Zea mays
  CDS (72)..(680)
cgcacgcacgcacgaccagttgccacggcagaccaccccgcccagcggccagcttgctcgccacgaccacgatgggcttccccgtggggtactcggagtcggagatgctgctcccgcgcgtgctgctgcaggtgctcctcctcctcggccacttccaccgcttcctcctctgggccttccacgccgtggggctcggcgacctgatcgacctcggctgcaactacccgccgccgccgccctccgcgtccacggcgcacgagatgatggagcaccagcaccagcaccaggggcgcgacgacgtggcctccccgctgcagcaccagcgcccggagttccggcccgtcgcggcggcgctcatcgaggaggcgctccccgtggtgcggttcgacgagctgggcggcgcgccgtgcggcggcggcgactgcgcggtgtgcctgagcggcatcggcggcggcgacgaggtgcggcggctcggcaactgccgccacgccttccaccgggcctgcctggaccgctggatggcgcacgaccagcgcacctgcccgctctgccgcgcgccgctcatcccctgggccgccgacgccgactacgacatgtcctatccgtctcccctgccgcccacgccactgcggcggcctcacgagctgctgctgctgcttaccggcctgggcggcttccagtgatgcgcctgcgcgtgggcagcgtggctggcacttgggcaggccggccacgcgaatccgatccgtggcgaggcaaaccgcgtgctcatgtgcggcccagcacgcccggtcggtcaggcgggtgaccgccgccaaacctgctcagttgccagccgtacacgcttgccggcctcgtcttcggtcgtgtctccgactccgttggtttttttacagaggctcccagtcccaggtcaaacaaaaaaggaggcgaaacagacaaagcagtcggaaattaggcaggtactgtactaggttgatctgtaggccgattgggcgactccaaatctgtggagctgtgaatcctttggcagattaaactaaaaattgtctctatagatcagaccatccaaaaaaaaccc

SEQ ID NO: 849 - DNA, 1224 bp, Zea mays
  CDS (123)..(1079)
gggcgccgccgccgcaagccgtccgccttgcccttcacgaaggcttggtcctcctccttgtatctccactccccccttcacagatccgttcctccagctagggttagcgttcctctgcagcgatggcgatcaagcggaccaaggcggagaagaagatcgcgtacgacaagaagctgtgcagcctgctcgatgagtacaccaaggtgctcatcgccctcgccgacaacgtcggttccaagcagctccaggacatccgccggggcctcaggggcgactcggtggtgctcatggggaagaacacgctcatcaggcgctgcatcaaggtgtacgccgagaagaccggtaaccacacctttgacccgctcatggacctcctggtcggcaacgtaggcctcatcttcaccaagggagacctcaaggaggtgcgcgaggaggtcgccaagtacaaggtgggggctcctgctcgtgttggtctggttgctccagttgatgttgttgtgccccctggcaacactgggctggatccgtcccagacctctttcttccaggtgcttaacatccccaccaagattaacaagggtaccgtggaaattatcacccctgtggagctgatcaagaagggtgaaaaggtgggctcgtccgagtctgccctgctcgccaagctgggtatccgccccttctcgtacggcctccaggtcaccagtgtctacgaggatgggtccgtgttcagccctgaggtgctcgacctttctgaggaggacctgattgagaagtttgccactggtgtctccatggttgcctccctgtcactggcgatctcgtacccgacccttgctgctgtgccccacatgttcatcaatgggtacaagaatgtgcttgctgttgctgtcgagacagactactcatacccacatgctgacaagatcaaggagtacctcaaggacccaagcaagtttgctgttgccgccccggttgctgctggggactctggcgctgcagctgctcccaaggaagaagagaaggctgcggagcctgaagaggagtcggacgaggaaatgggcttcagcctcttcgacgactagagctgctgttttcgtcaaactgctgcaagttttggctttttttatcatctacaagtactgtttcctatattttttagcagacaaattatcgtgtgtaatcgacaatgatatctccttaaattttaagtacctgtgttgtgtc

SEQ ID NO: 850 - DNA, 1446 bp, Zea mays
  CDS (223)..(1266)
cttggtcgccgaagctcaagaccacagtgtcaggaagttctccaatcttccagccaaacacaattcatcagtcagatacactttgaccgaggaattattcagaatcactccacgagaggatcagctttcgaagctagagaagcagagctctaccaaacaggccaggacgtctctcaaatccccagttcagtaactggctaactgtaggagaaggagagagagatggagaacggcggcgctaaaggcgacgtccccgacgatgcgaacgagcattgccctggaacacagtctgaggaggcaggcaaggcagatgcctgcgctgggtgccccaaccagcagatttgcgccaccgcccccaaggggcctgatcccgatgtggttgctattgttgagaggttggctactgtgaaacacaaattgttagttttgtctggaaagggaggtgttggaaaaagcacattctcagcccaactctcgtttgccctagctgaaatggaccatcaggttggccttcttgacatagatatatgtggccctagcatccctaaaatgctaggccttgaaggacaagatattcatcaaagcaaccttggctggtcacctgtgtatgttgagtccaaccttggtgtgatgtcgattggtttcatgctgcctaatccagacgatgctgtcatatggaggggtccccgcaagaatggactgatcaagcagttcttaaaggatgtcgattggggggagattgactatcttgttgtggacgctcctccaggaacatctgatgagcacatctcgatcgtgcaataccttcaagccacaggaatcgatggcgcgataatcgtcacgactccgcagcaggtctctctgattgatgtgaggaaggagataaacttctgcaagaaggtcggtgttcctgtcctaggtgttgtggagaacatgagtggtctgaggcagccgctttcagacctcagattcatcaagtcagatgaggcgggcaagacagatgcgacagaatgggccctgaactacatcaaggagaaagcccctgagcttctgtcggtcatggcctgcagtgaggtatttgatagcagcaagggaggcgccgagaagatgtgccatgaaatgggggttcctttccttggtaaggtgcccatggatccgcagctgtgcaaggcggctgaggaagggaggtcatgctttgctgatcagaaatgcagtgccagtgcgccggctcttcgaaacatcgtgaagaagctgatcaaggccgagtgagaaaataatgttggcctgctggggaatctggtagtgagaaatgagatgaaatgacagatgccagagttctcgttaccaatatatatatatgttacggcgttacacactgaatctgtattagtgcttgtgttggacctgtaagtttttgttcgtgaataatcagtgggtgcacagact

SEQ ID NO: 851 - DNA, 2022 bp, Zea mays
  CDS (217)..(1563)
tcggccgccggactctccccccgtcgagcacacaacacaccctcctcgtcctccaatccaatcaacctggtagactcgcttcgcttctcccccagccgtcggacggagctcctcgcagtcgcagcagccgccgatcagcctgcgctcgggctcagcgctggaaggtgttggaagagaataacctgaaggttcacagtaaccttcatctgtcggaagatgtatcgggctaagagggctgcattgtcaccgaaggtgaagcgccgcgtcggcaagtacgagctcggacgcaccattggggaagggaccttcgccaaggtccggtttgctaagaacactgaaaacggggaacctgttgctatcaaaatccttgacaaggagaaggttaagaggcacagattggttgagcagattaagcgtgaaatttgtatcatgaaattagtaaggcaccctaatgttgttcgactgtttgaggtgatgggaagtaaagcaagaattttcatcgttctggaatatgttaccggcggagagctttttgaaatcattgctactaatggaagattgaaggaagacgaagcacgtaaatacttccagcaactgattaatgctgttgattactgccacagtaggggagtgtatcacagagacttgaagctcgagaatttgctgcttgatgctgcaggaaatctcaaagtttctgactttggtttaagtgctttaaccgagcaagtgaaggctgatggtctgcttcatacaacatgtggaacccccaattatgttgcccctgaggtgatcgaggatggaggctatgatggtgcaactgcagatatctggtcttgcggagtaatcctctttgttcttcttgctggatatttacctttcgaggatgacaacatcatcgccctatacaagaagatttcagaagctcagtttagctgcccctcttggttttcagctggggccaagaacatgattaccagaattcttgatcccaatcctacaactagaatcacgatttctcagatactggagcatccttggttcaaaaaggggtacaagcctcctgtttttgacgagaaatatcaaactagcttggatgacgtggatgctgcttttggagattcagaagaccggcatgtgaaagaggaaactgaagatcagccaacctcaatgaatgcattcgaactgatttctctaaaccaggcactgaatctggagaatttgtttgaagcaaaggaggagtataaaagagagacaagattcacctcacagtgccccccgaaagagataatcacaaagatcgaagaagctgcaaagccgcttggctttgatgttcagaagaaaaaatacaagatgcggatggagaacccgaaagcaggtagaaagggcaatctgaatgttgcaactgaggttttccaaatagccccatccctgcatgtagtcgagctcaagaaggcgaagggggacactctggagttccaaaagttctacagaagcctgtcgacccagctgaaggatgttgtgtggaagtgcgacggcgaggtggacggcaacagcgcggcagcatgaaagtgccctttgaactttccactggacggcgccggttttcctttgtacatagcttctctttcggatgatcccgtgtccattgcagagtcggttttgcaagcaagttctttggtttatttgtagtaagcccggtgaaacaaccgccctggaggctgttgtggatgagcttactggcgtgtttagttcgtttcatggtcgggaggttggatggaatggaaaccacaatcaaggctgtagtagtgtgtgtagtaacgaagtagatacatgcatcagatggtgtaagggagtaccagctgttagttcatggtttcaagcttagccccccttcaatttgttcgatgatgtattacttcacaataaacattattacttagatgtatgaggtgagcacacttggtctttagacaacagacaaccgaattgcgtgctcattgaattttagcaggggcggattca

SEQ ID NO: 852 - DNA, 3111 bp, Zea mays
  CDS (649)..(2424)
ctcgcagggcagccagggctcctagaaaagagaaagtagacgaccaaaagaaactggagaaaaagagaggagctcaaaagcaaggcgaggcctcctccgcccctttttctcccctcccaattcacacaggattcttcactcgcccgcccagttgtttcttttagtgccgcccccattccgctctgatccgagcctttcgctcaaagcctccagcttttgcaattgtttggtcacttcgggaatcaaggaataagttcttgcgctgtgcgcgatagagagcctgatccatctttccccatcctcttcccgtggcatttcggtgtgcttgcgctctgtgcgtggccactgctaggggaggatttttggcctggtttctgtcttcttggggttccaaaatttcgggcgagatcttcgcctcaaggaggttccttgcttttctggtattggcgactcttgttgctccctacaagtccaagaaaagaatttggaggccatggtgggggtcccttgcgaccggttctggtcgattattcgtgctgttgaattcaatatgccgctgtgacccacctctgcctggtttcttggaggaaatttgcttcagttgtgcgtcgttgagttagagctctcctccagctcttgattcggtccatggggctttgccatggcaaaccgacgcaaatcccggaggccgaggcgggggaggatccccatgtagcctccggagcgggtgacagcggggacgggccgacctcgccgtcggcggcggcgcccacggcgaagccgggcacgccgaagcagcccaagttcccgttctacctgccgagcccgctcccgccgtccagctacaagggctcgccggcgaactcgagcgtcgcgtccacgccggcgcgcggcgggttcaagcgccctttcccaccgccatcgcccgccaagcacatccgcgctctcctcgcgcggcggcacggctcggtcaagcccaacgaggcgtccatccccgagggcggcgagccggagctcggcctggacaagagcttcggcttctcgaagcacttcttcgcaaagtacgacctcggcgaggaggtcggccgcggtcacttcggctacacgtgctccgccaaggccaagaagggcgagcacaagggccaggacgtagccgtcaaggtcatccccaaggccaagatgacaacagctatcgccattgaagatgtgagaagagaagtgagaatattgagttctctgacaggccacagtaatttagtgcagttctacgatgctttcgaggatgaagataacgtgtatatagttatggaattatgtaaaggaggtgaactgctggacaggatattggctagaggtggaaagtactctgaagaggatgcgaaggtcgttatggtacaaattttgagtgttgtatcattttgccatcttcaaggtgttgttcaccgtgatctgaaaccagagaatttccttttctcttcaaaggatgaaaactctcccttgaaggtcatagattttggcttgtctgactttgtgaagccagatgaaagactaaacgacattgttggaagcgcatactatgttgctccagaggtcctccacagatcttatgccaccgaggcagatatgtggagcattggagtaattgcctacatcttgctctgtgggagtaggcctttctgggcgcgcacggagtcgggaatcttccgagctgtcttgaaggcggaaccgagttttgatgaggccccatggcccactctcacggctgaagctaaagattttgtaaaaaggcttcttaacaaggattaccgcaagagaatgacggctgcacaagctctcagtcatccatggatccgtaattctcaacaagtgaaggttcctttggatatgataatctataagctaatgagagcgtacatcagctcgtcttcgctgcggaagtctgctttgagggccctagccaagacgctgacgacggaccaactcttttatgtgagggagcagtttgaattgctgggcccgaacaagaatggttacatctcattgcaaaatctgaaatcggctctagcgaagaactccacggatgcaatgaaggactccagggttgtcgattttgttaacaccgtgtgcgctcttcagtacaggaaactggatttcgaagagttcgccgcttccgccatcagcgtctaccagatggaagccctggagacctgggagcagcacgcgaggcgcgcgtacgagctgttcgacaaggaaggaaaccggcccattgtgatcgaagaacttgcgtcggagctcggacttggcccgtcagtgcctctccacgttgtcctccaagactgggtcagacacgccgacgggaagctgagcttcctggggttcatcaagctcttgcacggggtctcgtcgcgctcgatcccaaaggcctagcattgtacaccatccatccctgcatatctatatccatcgaccgagggagacgagtgatggctgagccagtctctggctgcaggtgcgtgcgtgtgtgttcagtgttctgttccacggtggacggcctgaaaccaaacgcaaagaccaagagaaatgcctgacgatagtcctgtgtaagaagagtaaggcagcacagggtctggtgcctgtgcaccacttgtaccacatcccttgccacgtggatagatgacgtcgtcgtcgtcgttgttgtagttgtactgaagtaaagctggttgtgtagacgagtgtacagatgaggatagggaaaagaaatgaacatggtggaagactggaagggccgtaagatttgcggctgctgtttgtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccctttttaaagaatcaaattttacttccccgtgtttgcaaagaaaaagtttttttttggggcccccaaaattaaattaattggccggggtttaaaaacgtgggaattggaaaaacctgggggtacccaaattaaatcgctttgaaaaaaatccccttttcg

SEQ ID NO: 853 - DNA, 1008 bp, Zea mays
  CDS (127)..(813)
attcggctcgaggagattagctcttcaactagtcgcgctgtcacggtgccgaacagcgtgtcatcgccttcccctccctacaagccaaacgcgaataccacccccgtgacttcccgatctccggcgatggccgcgcggcgcctcggatcccccgcatctaggtggctgcgcccgtccgcgctgctcctcctggtcgcctctgctctcctctcggccccgtcgccggcccgggccctccggttcgacctcgagtccggccacaccaagtgcgtctccgacgagatcaaggtcaacgccatggccgtcggaaagtaccacatcgtcgggcccgaccccaactcacccgacgcccagctccccgagtcgcaccgcatctccctcagggtgacgtcgccgtacgggaacagcatgcactacgcggagaacgtgcagtcgggccacttcgccttcacggcggcggaggccggcgactacctggcctgcttctgggctcccgaccacaagccgccggtcaccatcgggttcgagttcgactggaggagcggcgtctccgccaaggactatcccagcgtcgccaagaagggcaaggtcgatatgatggaattggagctgaagaagctagaggaaactataaaaaatatacatgaagagatgctttatctgcgtgaaagggaagaggaaatgcaggacgtgaacaggcgaacgaactcaaggatggcttggctagggttcctctcccttggcgtctgcttatcagtggcaggtttgcagctgtggcacctgaagaccttctttgaaaggaagaagttgttgtagactgtagttggcccatggttcacggtagacctcagcgcaggtgtaacctatttttgggtgaactgccgatctgttacggagcttgaaatcccatgtaacaaacggtatgtcgtacttgagaaaatatgctttagcctgtccagttgaaattctaagaaacttgaaatagatactaaaaaaaaaaaaaaaagg

SEQ ID NO: 854 - DNA, 1564 bp, Zea mays
  CDS (153)..(671)
cccacgcgtccgcacctccacgcaactggaagcttcgcttcaatctgccctactcctccgccgcctccaacaccgcagacgcagctgccgcgggcgggagcttggacgtgctactctgctctcatctcgtttccgcgcaggaattgttcacaatggcccgcgtgtatgttggcaacttggattcacgggtgacttctggggaactcgaagatgagttccgtgtgtttggagttctgcgaagtgtttggattgcacgtaaaccacctggctttgcatttattgattttgacgacaggagggatgcggaggatgctattcgtgatctagatggtaagaatggatggagagttgaactatctcgtaattccagtggtcgtggtggtcgtgatcggtatggtggatctgagtcgaagtgctatgaatgtggtgagactgggcactttgcacgtgaatgtcgtctgcgcattggctctggaggtctaggcagtggaagacgtcgcagtcgcagtcgcagtcgcagtcgcagcaggagcagaagccgcagccgcagccgcagccctagataccgcaggagtccaagctatagtagaaggagctatagccctcgttatcgctctccaaggcgccgtagtccttcgccaactcgcgcgcgcagctatagcaggtcaccatagtacaactgcaacgagtaatggtggcaggtactggtgtagcaggagctaggcctgaagcccgtgcctgatacttcttggtgtgagaacttagtccttggtttggctgtcaggaacaaatttggaactgtcgtcaactgcatgacttcagttcaggcatgttctgcttaaacgactcggccaactacggctctcagttagtcttcatggttttgttcctccattcttggcacgtccttatctgcaaacaaatgtcaacgttccattactagctgccttcgatgtttcatcatgaaattcttcaccgaagatgcaacttcatcacaaattagtaacatcctttcccctcatatagttgataaggtttgagtgtactgagcactaacaaatgcagctcgcgaaagtaagaccccttttcgtcatagaacaagacagctattttaattgcagcactcgtgtgaaaatatatctactctgcatggtgggattggggcgattgaagtgtgtggccttcagctgcacctagttgggcatcccaggaacctagtcaggctgactacagcaagaggcgcatcctttgactaaacatgtttgttttatttcttgtggtttgattcttcacttctgttcattgtgttctgccttcactgcaccctattggattggtagtggtcgaacaatgcttctgtctgtggtaagttattcttggtacaatggctcttctttacccctgatcagtgtatgttggactttctgatagagttagcaccaattgtagtataaatatgttcttttttctctggaaggtaattgtaattctatctgaatactccgatttgagatataatctgctcttgtcaaatggttttttaaagatcaaaaaaaaaaaaaaa

SEQ ID NO: 855 - DNA, 2188 bp, Oryza sativa
  CDS (120)..(1769)
cggacgcgtgggcggacgcgggggcggggctcccagcccaaacccccccacctcgagctctagggtttcgcggatcgaggggcgccgcggctagggtttgggtggggggtgcctgcgcgatggccgctccggcggcggagtcggcggtggtgggggtaggggtggattcggcgacgagcgcggcggtgagggatggcttcgcggagctggagcggcagcagcagctgctcgcgacctgcacgcgcctgtaccagcagctcacggagcacttcggctcgctggagcgccgtctcgccgcgcgctccgagacgctccgcaccaagcgccgcttcctcgacgtgcgcacctcccgcaggctcgaggcgctccgccgccgggaggcctccatcgacggctccgtctcgctcgcgctctcccggctcgattccctcgccaagggcgacgcggggacgaccggctccgcctccgccgacgccgctggaatcgccgaggggctcaggtcgctctgcgccagcatggactcggccgggttcttcaccttcgtggtcgcgaggcgcaaggaggtggacgcgctccgcgccgagctccccgacgcgctcaagcgctgcgtcgatccggcgaggttcgccatggacgcggtctccgaggtgttccccatcgacaagcgggcggtgaggtcccccaccgacctggcgtgggcgtgcgtgctcatcctggaggcggtggtgccgtcgctggccgatccggacccggagatcggggcggcgcgccccatggtgccgcaggcggcgcgcgagagggcgcgcgggatggcgagggagtggaaggacgcggccgagaagaagggcggggtggagggcgccaagccaccggatgcgcacgcgttcctgcagcacgtcgcgacattcgcagtcgcagagaaggaggacaaggagctctacaggaggatcgtcgtgagcttctcgtggcggaggcagatgccgcgtctcgctatcacactcggcctcgaggatgagatggatgatatcattgaagagcttatcactaaggggcagcaacttgatgctgtgaactttgcatatgaggctggtcttcaggaaaaattccccccagcccctcttttaaaagcctaccttgaagattcaaagaagataccctcaaattcagataacctgagtactagcactggccaatctgggagcaatgccaataagaaggagcagtctgcactgcgggctgttataaagtgtgttgaggaccacaaactcgaagctgagtttccattggaggatctccgtgagcggctggaagaactggagaaggccaagaccgagaagaaaaaggcggcatcaagcagttccagcggtggtagctctggtccagccaacaagcgcatccgggcaagcaccggaggaccgatgccccctgccaaggcaggccgtctcaccgactacaccggtacaccgtcttcgcctgccaccaccacgaccaatgccacattcattcgctccccgtcccatgcctcctacggtacagcatctccttactcttatgataggccagctgcacaccccctctactgtggccagaacacactggcaatgagggagccctatgcataccaccacccatctgaggtatccagcgtcggcctcggcatgtcatacccatcccctcccatgacctacccggcctatgctggatacagcaatggaatcggctacagcaatgcaatggccccagcctttcaccaccaggcttactaccggtaggatcagtcgaagccgatgaaatgacaatgagctgaatcgctgatggtggcagggcggctcgccaccatggccatgttttgtagtgactgactacaacggtaggtgggtgggggcgtgtgttccttaatactagaagatgcttgtgttggttagttctccccgttattagctgctctcgctacttcgcactgaagaaactgaatgtaaattatggacgtgttgtccctggaccctcgtcgtcatcttgtgttgtaattcagtctaaaccactctaaaacccacaaaaaaaaatccggcatgtaatcttcaagcactgaactatctcggcttaattaatgactatcttatgttagttaaaaaaaaaaaaaaaaaaaaaaaaaaggggggcctcgtgccgaattcctgcagcccggggg

SEQ ID NO: 856 - DNA, 11783 bp, Oryza sativa
  CDS (605)..(719), (800)..(864), (1161)..(1503), (1666)..(1732), (1833)..(1986), (2283)..(2450), (2553)..(2663), (2773)..(2883), (3025)..(3042), (3078)..(3179), (3748)..(3978), (4551)..(4625), (4905)..(4976), (5758)..(5943), (6029)..(6187),(6412)..(6504), (6891)..(6962), (7497)..(7587), (7830)..(8008), (8413)..(8494), (8687)..(8797), (8876)..(8982), (9355)..(9432), (9518)..(9613), (9788)..(9883), (11533)..(11700)
gaattcggtttggatggatggatcgggtatgtatgatctgggagctgcgggccaatgcgatctcagttctgtcactggtggatgtcggatgtgatttagtagggaggttgagttggccggtctgagaggaggcatggatcatctcagtttgtgcattcttgaatgaatcatcagttggccactgcatggctgtcatttccatttcctttttaatagcgagagtttgtgaatttgtacaggcaaaatggaccgattgtaggatcagattcatgattcactagctattttcaacataaactgttcagccccaaccgatttacgcaccccagcactttttcatgtagttaaccccttttgttttgcaggagagcgatgctggctgaaagcgacttggggtgcttccaacagtgtttctgaactcagattgctgtctcccctgcacacgatatggacgagtaatgatcgtttcagaataggtattatagatcagtatatgcatgttcaattgtgagctaagctttttctatatatcaacttaaccagagaaaatgttgttgagctgctgcaacgttatcgccgtgaccgtcatgtattgctcaactacatgctttctggtaacttgatcaagaaagttgtaatgcctcctggtgcgatctctttggatgatgtggatatagatcaagtcagtgttgattacgtcctcaattgtgctaagaaaggtgaggtggttttagatttacccaagtatgccactctgtatttttcatatgtatattctgaaaattattcgaccgtgtaggtgaagcacttgaccttggagatgccatccggctttttcatgacagccttgactacccttacgtggtgagctgatctatagtagctgctgcatttattttgtttcattgaaaagtttgtcagccattttgcaatgtaggagctatttgagttgcccattttaaagctccaggataaaagacctaaccattccactaaactccatggatacaattatgttcatatatggacattttaatatgtgttttcctattttaatagagaatgtttcatgtttagttgatatgctgtgcacatcatttcagaatcattaaagttcatttcttatgattttgaatgccttgacattatacttttgtcagaataacagtggaactgtggaggaattctttttacttacaaaaccagagtactctggaccagctccagcgagagaaccaccccctgtccctgctattgcaccatcacctgttgtgataccggcaccaattgtggatccaccaccagttgctgtgcactcaccagtctctaccacaaatttatcaaaatcacaatcatttgattctccaactgagaaggagttaaccatagatgacattgaagattttgaggatgaagaagatgaattcgatagccgaagggcttctagaagacatcaaagtgatgccaatgatttatcattgcggttaccactatttgaaacaggtaatagtgatgactgttatgtcattatggtattcagatatccaataacagatagaagtgaaattttcatgacttattttctttagaagtcttcatgctggtatggctacatacattgggtcaagaaagttattgacaacggaaactgtgctgtttttccaggtataacagatgatgacctccgtgaaacagcatatgaaattcttgttgctgctgctggtgcttcagggtaggcttatgcatttctttgtgctcatttttttttccaattagaagattgaaagtcttccaggtataccatatcatttaccttatttccatacctacaggggacttatagttccacagaaagaaaagaagaaagagaagagaaacaaattaatgaggaaactcggacgtagtaagagtgagagtactcaatcccaaactcagcggcaaccaggtttggttggtttgcttgaaaccatgcgagcacaacttgaggtatattgtcttagccttctgcttctggtgactgaataataaacgaataaaagaagttcacctttctgttccctgatgttcattaatgcttcacacaacttaaattagattagcaagtttgagtgttagcagcttataagcttcttttgtcgcttgaaagtccataaactacaactctttgagtttaaggccatcagtcccttcattatgtttctgtgcatccaggttttttaaagcatctcagcatgctaatcttacatacattgacctccgtgttccctgctgtttttggatagataacagaatccatggatattagaactagacaaggattgctcaatgctatggtaggcaaagttggaaaacggatggacaatctcttgattccattggaactactatgctgtatctcaagagccgagttttcagacatgaaagcatatcttcgttggcagaagagacaggttagccatcttattgtgccttaaatgatcttgaattctacagtatttggggccaccctatcatgccttaacattatatgtttcatttgtatctttgcttagctaaacatgctggaggagggccttataaaccatcctgttgttggatttggagagttaggtcgaaaggtcaatgagctacgaaacctcttcagaaagattgaagaatctgaggttttattatttagagattactcagtgaatactcttatagttgacttttagaacaattgtgtaaaactatccagtatactgaggctcatcgtggtgttttacttgctagtccttgcaaccatctgctgtggaggttcaacgcactgaatgcctaagatcactgagagaagttgctacttctctctctgaaagacctgcacggggtgatcttactggtgaggtttgtcattggtctgatggctaccatctgaatgtggcactgtatgagaaaatgctcggcagtgtttttgatatcttggatgagggaaagcttacagaggccagtacttaaaatcatcttttgtaattttcctctgtctagatacactatcagttgcaggtatttctcttaacatttttgcttcaatctaccaggaagtggaagaaatcctggagctcctaaaatcaacttggcggatactaggcattacagagacgattcatgatacatgttatgcatgggtattatttagacaggtatagctctagccaagcagtactattacttgaggttacccttactggaatattttgtggttgcattatggatttatgataggccctaagtacctctacattctgcaataaccctatgtgtttccataaccactgattgaggtctactctgatatctaatgttcttctcttaatagcccaaataagccaaaagcaagtgagttcctcaagcataaacagttttttatgaaatgatttcaaaccttttctgttcataatgtcagacacggtcatctgaaaaggagatcggtgcaaaatcttggttagcctttactattttgtggaaatggtgatgtgtagttccagttaagcatgtcatgaagtaggatgatccatcactagtgttcgttgccagtggatcatttgtctcttgataccataggtgctcttgcataaagactgcttcactaacaatatggcccatatatacttgtaaaccatatcccatggtgtgcaattgacctttttagcttataaactaagtaaccttctcaatagtatggtatttaatggatgttctgcaatacagtttgtttttacaggtgagcaaggactcttgaaagttgtgattgagcatttgaggaagatacctttgaaggaacagcgtggtccacaggaaagattacacttgaaaagtttgcgtagttctgttgatgctgaggatagctttcaagacttcacatttttccaatctttcctatctcccgttcagaaatgggtggacaagaaattgaatgattatcacctacacttctcagaggtttgttttgccaactcctggtttgctcacgtgcttcataacatgcatgagttgtggaaaggatctcctttactctttcacagtcatcttttttattccattgggttcgtactttataaataaaatatttatcattcagtgtagatcaattatatcccctggtattggcttttgcttcttttttttttgttagtgtgcaactcatatatgcataaggcagtcaatcattacagctgagtactatttagtcattcatgcatattgtcttttttagatcctcgatttcatattgtaccaatactttccgtgcctcatggttttgactttcactgttaagcttatcattttcttcaattgttcttcttagggcatttttatgtgtatgacttggagctgtaatttccttctaatcaatttcctcttttcacgctgctgtttctgttcagacttcagccgttcaacatttggtgtttactgaaaccaagtccatagatcacactgaaccattatatctggactttgtttgcaacaagggattattttcccatattaatatttattttcatttacagggccctagcatgatggctgatattgtaacagtggcaatgcttattaggagaattcttggtgaagaaaataacaaggtatttatacttcacttcatttttcatctattacaccatttttaatctaaaattagatcgtttattgccggctcgtgcactagtgtagctagatatttcatgagcaaaagtcatttccgctatataataattcaggggtggctctcacaaaaaaaaaggatataataaattctgttctaaatagtaaatacaggccatctggaatgtagaaagcaatacttctaccatctgcacatgtggaaaattctgatgtcgcgctttatttgttttgtacatcagggaatggagtcgcctgatcgagatcagattgaccgttacatcacttcttctgtcaaaagtgctttcgtaaaggtgactttcttagcggcttcttttgatagcagagctatacactttgcctcctacacttttcgcaattgagatggatgtaaaatcgcttacataatcatgcttgtatgtatgtgaaaccttcagtctcaatccgttattttgtacatgtacttcaattttgaagttccagtaatgtcgtatctgaccatgttcgctcgtaggaaatcatcataccatattattgtcaacgttagcaattttctttgtagttggggtgtttaattattgaaatgtctatttcatgtattagaaattataacatgaccatagtttgatgagagatgtccaagcctaaatattggtggatgttatggtttatgtgattgaatttcagttttttatattttccaaattactttttgtctatatcttttagtagcattaaataaactgaattccgcttttttaccactaccttcctgaaaagtcattatgaaatgtcttgaatgcaatattactatgccacattcatataacaaaatctcagtacatggctgtcctttacatatcaagagatagaaactccgggatctaaaccttgtaactatgctctgtccaaaccaatatttttgtttgttttgtttaccggattggacactcactgtgtgcacctaaagtggacagcatcatccatgtcaagattctgcaatttggagttgtcatagacttgtctagttccttccccttatgaattatatctataatatggactaaagaaacatttatttctttttttattcagatggcacactcagtagaggctaaagcagacacatcacatgaacatgttttagcatctctagctgaggagacaaagaagcttctgaagaaagatacaactgtgttttcatcggttttgtcaaagtggcacccacagtctgcagttgtttctgcttcacttctccataaactttatggaagcaaattggtaagctatgtcagacactcttatctgaaatgtctgtatatccaccaccataggattcttaatgcttgcatgacatttgtgccagaaaccgtttcttgagcacgcggagcatcttacggaggatgtggtttctgtatttccggcagccgatgctttggagcagtacataatgtctgtgatggcttctgttgtgggagatgatggtttggacagcatatgcagacaaaagctagctccttatcaggtttgcttatttaactgtatcttcttcaagtagcagcactcacaacagtgcaaaatggtatccaatccatttgcttgattgttcaccttgacatgatgtgtttatcaatttatgtcagtatttgccattttatcatccagcatacgatgctcagcaatgaactgttagtttattttgtgttaagagttcatatgttgttcatcctagtccttgttttatcccagattgaaagtaaatctggcacgttgatattacgctgggtaaatgggcagcttgagagaattgaaacttgggttaaaagagctgctgaacaagaggtaacactatttgactcaagttacttttttacaaagctcttactgtctcagtatgtttgatttatctatatccaacatcctctttcttaccatgatatgaatgacctaaagtaatttctggtctattccacatgctatacgaatggcctaaagttatttatatccattttattacctttcaatcccatgcttttcggttagtgaagtgaaccagaatgtttcgtggtatattgcgaaagtgatctatttttcatgatatatttcaaacataaatgtcatgttacatctctcaaagcctgccatcgcttcttatacattatttggatacaacattatcttattcattctgtcatcttttttatgccaaacttttttttgctcaacagacttgggatcctatatcccctcaacaacgccatggggcttctattgtcgaagtctacagaatcatagaagaggtgctcctttttgtccctcactccattatctccttgaataaattttgcttaatattatcttacgggataaagtctgtttttgttttcatgtagagatttttttatgccacaacatttcaaagatatttgcatgccttagggcctgtttggtttgttaccaccttcagccttaccaaattttggtaaggcaataaaacaaacatatcccaacaattgctaccataacaaaattccataattctggaagcttaccactcttaaatttatacctttatttggtaaggtttcaaaccaaatgtatccaccaatgctaccaaaatttggcattaccaaaatgtgctaaaatttggcattaccaaatttttttagtgttcgtttgggttgcaacccaaagatgcccttagttttctttagatttattttttttgcttggtagttgaatatgttatggattgatttccatccgtctctaaagagcaatcatttgccccttgcaaactattgcagactgcagatcaattttttgcattcaaggtccccatgagaactggagaactaaatagcctctgccgtggttttgacaaggcatttcaagtttacacacaacttgttacaggaccgataggtttgcatggcaccctttttctgtgaagtactttctgtatatctttcggtcatcatatttttgttcctttcttccttgtctgagtgatttcaaaggaaaatattctcttttacatgagtatatggcaaataatcaatgctgtagatggtgcatcgcttccaagatcataacttaaaagttattactgtggatgtggacgccagaataacttttctgtaattgttggttttgtttgcttgcagttgatagagaagatttaattccacctgtccctgttcttactcgatataaaaaggagcttggaatcaaggctttcgtaaaaaaggaaatacatgaagttagaacagttgacgagaggaaagcaagtgaaataatacaacttactatgccaaagctttgtgtacggcttaacagcctatatgtgagtctttacaacagagcactgctatatggatttgttgctttgactagaatgacttgtcaagttcccgagcaatttctgtgagatataaaacgatatatcttctttatatgccaatcttaataaaaaatttaatttaaaactatgacatttggggatcagtgtatgtatctcattaaaattattttctaggcttcaagtgtgttgataattatgctgctataacctataggtgaatatcttcaccttccagcctggcttcctttgaatttagctattgctagttttttttttcatgatctacatcagtgtcctcatggcatcttttgacttttctcttccctttgaattgtgtccattttcattagttttgaaccagaagcacttttttttttgtcaaacagtatggtatcagccagctaagcaagctggaggacagcataaatgagcggtgggctaggaggaaaagtgagagcattaacatcagtaagtatgctgttatgcgttttcaagaaaaaaaatgtatactgttatgattttctttagaaaaaaaatattttagttgccaatttatctgttgaatattctgataagtttgcaaatcaatctatttgatctaccccttatagataacatcagactaaatctgttatattgaaaatatttgaactttgtcaggacgatcaatgagtgaaaaatcaaagagtgctgtctcgagtcagaagaatcaatttgatggcagcagaaaagaaatcaatgctgcaattgatcggatatgtgagtttacaggtaagaaaatatacatgccccagtgctttcttggaagctgacagatatctattaacatgttaaccttttctttcttagggctaaaggttatcttctgggacctacagcagccatttattgataatttgtacaaaaacaatgtttctcaagctcgactggatgctattatggaagtacttgatacggtatgctcatgaatcgtgcaacctttcaggaacattaaattggagaaacaaaaccctatgatctgacagctagcatgaaacctaccatttatctatgtactaatgctggttagctacttagatgatcaacttttcacagaacacatattgtattctgttatgaatatagtttatttcctcaaaagatatggataagttaattatctgtggccaaagtgcaaaccatttgctatatcacaaaaatcgataatcaatcttgaatcctgtacctctggttattagtgtttttttgataaatatatatattgtgatttggtttgtaagattcgcttgaactaatggagatatttgattccacgcctcaatatttaggtgcttaatcagctttgtaatgtcattgtggagcaactacgggatcgtgtggttacagggcttctacaagcatctctggtaatctttccggataataaattctgtaggattgttgtgacagcttgtgagctatatgttatcttaaagttaccttgcttggcaggatggcctactccgtgtgatattggatggaggtcctacgcgtgtcttctctccaagtgatgccactcttttggaagaagatcttgaaattctgaaggtatatcattatctgaagtacaacctggctgttttttgcgttataaggaacatagtattacctggatgttggttgttttgtgcttattatgcctctggaacatttaatgttgtcttctctttgctggccaaacaaaaaactgttagtcttgatgtaaattttcacttcgcataggaattttttatatctggtggagatggcctacctcgtggaactgtcgagaatttggtctcacgtgttcgccctgtaatagatctgatcaagcaagaggtaagtttggatttaatttctcattttgacactgggtaaaccggtgaacagaacctagggtgtggaactccagatcgtggaggtaacataatgacgtagctccaatggttacataggtgtctagcagttgttagtgaacagacattagcttcatgtcaacaacgaacctaatcatgtcccattcctatttttggtaaaaaaaaacagtagaatcttcactgtttggattgtaggcacctgtataacttgttcgtttagatggaacttctctgttccattagctagttatctctaagtcgtaggcacagaacacacattagcttcatgtcaaactcaaacgaacctaattatgtcccatttcttattttggtaaaaaaaaagtagaatcttcactgtttggattataggcacctgtataacttgttcgtttagatggaacttctctgttccattagctagttatcccaggctgagtttggcactccatcttcccaacccacctctctcgttttccgcatgcacgcttttcaaattactaaacggtgcgtttttttcaaaaaatttctatacgaaagttgctttaaaaagtcatattgatccatttttcaaagaaaaaagttaatacttaattaatcacgtgttcttcccccccattttcccaacccacctctctcgttttccgcgcgcacgctttttaaaatgctaaacagtgtgatttatgcaaaaactttctatataaaagttgttttaaaaaatcatattaatctatttttcaaaaaaaaagttaatacttaattgatcatgcaataatatgagcttcgttttgcgcgccggggagaaggggttcaacacagcctaagtcgttggcacagcaaacaaaccaattcaggatttcaggtagctggtccgcccagatctggttacaacccaagctgcatgtaatcgtgccacattgttccatgccctttgccctagagcagaaatcagtcccaaaatcacactacctccgttttttaatatataacatcgttgattttttttatacatacgtttgtccatttgtcttataagtcacgcttaaaagaaccttgtacgataaataagacataacaaaatgaatgataactacataaagtttttgaataaaatgaatagtcaacgtatcttaaaaggttaatcttaaaatgtcaatggcgttatctctgtctctcctattataaaaattaaagatgtttctgttgatactttggtacgtcatttgtatttgagtcggtttttaagtttgttcacttttgggaatacataataaggagtcgtataagaaatccttaaaaaactcgcatgttaatttggaacaagagtcggactcctaattgctacaaaattcttgccaggcctaataagagttccaaattagatatcaatattatcaaaataaaaatcccatatactttttagacaaaaagatctaacaataatatgattaaaataaccttcacccgtggcaatgcacgtacaatttttctagtatattaaaaatgaagggagtaaaatttagccgtaggaaactcttatttcccaaaaaagactagtgcgtgccaagtcataatcatcatctgtaacggtttgcttctgcatgtttttaccagacacgtgtgctcatcgatgacctacgagaagttactcagggcgctaaaagtaagtttggaaccgattccaaaaccctgcttagggtcctttgccacagaaatgattcggaggcttcgcactatgtgaagaagcaattcaagattcccagctcagctcctgccacctgatttgcaaaaccaactggatttttcggatactgtacagccaatggaatgcgtcttggccttgcgacctggaaatcgtgtccagt

SEQ ID NO: 857 - DNA, 2296 bp, Zea mays
  CDS (87)..(1147), (1229)..(1919)
ccctcgaggccggccgggaactgctaaaaccacccaccttctcagtgactcacgaactcacgactccagatctcccaccgctcgccatggacctcgacgcgaggcaccgccacacgccggattcgagctcctccccacatgccgcctctgacatgggtctcccgctcgccggggctgcctaccagccctacgtctctgagctcctctccttctccatcgagcgcctccacaaggagccggagcttctgagggtcgacgcggagcgagtgcggcggcagatgcaggaggtggcggtggagaactacggcgccttcatcgccgcctccgaggcgctctccttcgtccgcgcgcagctcgagagcttcgatggccacctcgaggccatgatagaggagataccaaacttaacatctggctgcactgagtttgttgagtctgcacaacaaattctggaggagaggaagcttaaccaaacattactagccaaccacactacattgcttgacttgcttgaaatcccaccattgatggacacgtgtatacggaatgggaactatgatgaagcacttgatctagaagcttttgtgagcaaaatatcgaagctgcacccagatttacctgttgtccaaggattagctgctgaagtcaagaagacagtacaatcattaatttcccagcttctccagaaactccgatcaaatattcagttacctgagtgcctccgtattgtagcacatctgcgtcgaattggagttttcagtgagtcagaattgcgcttacagttcctgaggtgcagggaagcttggctttctggaattcttgaagatctggaccaaaggaatgtttatgattacctcaaaggcatggtgacttgccacagggtacatctattcgatgttgttaatcaatatagagcaatattcaacaatgataaatctggaaatgatgagaactccgaaggtgggctgcttttcagctgggcaatgcaacaagttagtaatcacctcgctactcttcaagttatgttaccaagcataacagaaggtgggtctctgtccaacattcttgaacaatgcatgtattgtgcaatgggccttggcttagttggattggatttccgtggcctccttccgccaatctttgaggagtaattggtgtttaaattattgaattttatcaccgactctaaaggggctttgttattgatgctgttatctgcattttgcagcgcggttctaaatttattctcaaagaatatgagtatggcggttgaaaattttcaggttgttttggattcgcaccgctgggttccgatgccatctgttggctttgtagcaaatggtgttgtcgatgacacttctgatgatgtgactccaccttctgttttaatggagcatccacctcttgcagtgtttgttaacggtgtttcagcagcaatgaatgagctaagaccgtgcacaccattgagcttgaaagtcgtccttgctcaggaggtggtcaagggactacatgcagtctctgactccctagtaagatacaaagctatgcggatgcttcgtggaaatgagtccgctcttttcctgtcactctgccaggcatttatcgaggttgtacatccttattgtgccgcatgttttggtcgatgctactcgaatggggcaacattgatctcagagtgtcaaggcacactggacgctgtccgtcagctattgaccataccggcaagatctaacagttccagtatcgaaagaaagcagtcaggagccattgaaagaaagcaatctgttgagagctctgggacagcagtcacgtataacgagctgtcagccgatggacctgggctagagatcaacgatgctgctacaaccaccaccccaccggtagaggacgacgtgagtacccatccaccaggaagtaagtagcttggacctccgtttgaatttgttaaagctctttatcaaggcctggtttagtcaaccagagaagaaattgctgcaaacattatattcatcgataataattcatagttttgctccagttctacagtgtacacaatatctcactggatatttgtatcttatttttttatcactcattaaatttttagctgttcattgttatagtcaatacctagatgttgtagagtgtgtccaacccgaacattcagtaatatgatgagtacaaaccgtgttcatcgtgttgactgcacacttctgaaatcaaagatctgattcatgagtcatatatatgtaattgatactactgaccataaaaaaaaaaaaaaaaagcggccctc

SEQ ID NO: 858 - DNA, 2155 bp, Zea mays
  CDS (553)..(1797)
gacgtcgccgagaaaactcaaatcgaatccccaaatccttcgccggcgattccactccaagtctcgatcggaaaagcgcagaagagcaacggaatcccaattcccaaagggacaaggcaaagctaacttctccttcttcccatccttcctcatcccgtcggatcaatgccagcgggagcaaattcgaagccgctgccgaaattgtggccggttgaccggtgtttccagcccatccccccgttgcacgcggcgaggtagaggagtttccgccgtcaactccatccgatcggcgtagggtcgcggggtgccgacaactttggtccccgctccccacttgggcgccacggtcgctgcgcatgccgcgggctcccgcgcccactggaccccggtaacaccgacggcgcctcgctccgcgtgcccgcccgctgccagctccatgccaaccgccgcggctacataggtagctgcgcgctggctgaaggctcctgcagtgcgcgttgaaggctttcgctgcgtgttgtgcgttctgcttgaatttcggtctgagtttggatgggccagatgatttcgggtgataaatccgacgaacagacagcacgcgacgatggaatcatcaagaatggaagggaaatcctatttcaggcttttaactgggaatccaataagcacaactggtggagtattttggaggaaaaagtaaccgatcttgcggaatctgggtttacgtcagtgtggcttcctcctccaacacagtcattatcccgagaaggctatctaccacagaatctgtactgccttgactcatgttatggttccctccatgagctaaaattgttgcttcataaaatgagcgaacataatgtaagggctatggcagatgttgttatcaaccatcgaattggaactactcaaggatccaatggcatgtataatcgttatgatggcatcccagtatcatgggatgaacatgctgttacatcttgttctggcgggaagggaaacaagagcactggggataactttgatggggttcccaatatagatcatacacaaccatttgtacgcaaagatattatcgaatggttgatctggcttcgaaaatcagttggttttcaagattttcgctttgatttcacgaaaggttatgcagccaagtttgtaaaagaatacattgaggaatcaaaacctctttttgcagttggggaatactgggatagctgtgaatatagcccccctgactaccgactgaactataatcaagatatccataggcagaggattattaattggatagataacactggaggactttgtgccgcatttgatttcacgacaaagggcattcttcaggaagctgtcaaaggagagttgtggcgtttgcgagattcagaaggaaaaccacctggtgtgatgggatggtggccttcaagatcagttacatttattgaaaatcatgacactgggtccactcagggtcattggccttttccgtcagatcatattatggagggatatgcttatatactcacccaccctggcatccccacggtgttctatgatcacttctatgaccagggtgtgcctctccatgacgaaattgctaaactgatgcaaatcagaaaatgccaagatatacatagccgttcatcaatcaaaattctggaggttgggtcagatctgtactcagcaatcatcgacgataagttgtgcatgaagatcggggacggctcgtggtgcccaagtgatccagagtggaggctggcagtctctggtgacagatatgctgtgtggcacaagtgaagcatataagtgccctcgatacagtttatttctgctctcaggaacaggagtaattagcatgttagctgaataacagcacggtaaaacatgccaaaaatgaccctcttcgaggttttacctgtacaagaggagtgcctaaatgcaatgcttaattagaaatacgtgagatcgtgcggctggtcccgaggtgagacatacattttgctaatcgcaacaactatggattacctgcaaaagaaatatatatagggcatgtgatgtctctgtggaatattttatcctggaaccagaaatttgaattatttttataaaaaatgcatctgtgcaatttacattcaaaaaaaaaaaaaaaaaa

SEQ ID NO: 859 - DNA, 3859 bp, Oryza sativa
  CDS (805)..(3510)
atccgcgccctctcctcctcttccccggggatccagcacggctacgccgccgccgccgccgctgccgccgtgcaatgcccgtggcgcctgctctcccaagaaaagcttcccttcttggtacatggtcgtcgtctccccttccccgattgcctcgccgccgacattcccctcgcctcgccggaccgccgccccccctgctccgaggtactcgctctctgtctcccctagtagtactagtgcactactactgctactactactagtactactacttgagctgcatgcgctggtgagttggtgagctttgcggtgattggagtggagatccaatccgagatactgctagattcgtttcaaacttttttcttcctcatcaaatgtagtagatttcttgcattgtcttgaggctaaaagctctggccttttatttgctagctacaggagtatgtctaatccaagcctttttttctctctgttcaatccatccaggttagtttgctgcggattgggattcgtttgctgctgctgttgcaaaggtggaggagcaccagcagtcgcattttatcccgaaagattggggattgtatgcttccactgaaccccgatgcgccacgttagccgctgcaccatccctgattggtatgcaccgagagagagagagagagagcgagaggaaaaaaaaagttccaaccttttcgtttcggttataataagactcgcctgatttccgctgattcttagcccaaaatgttgcaacctttgcaggaaaaataattttgtgtagacccctccaagtttcaagaaatggacattgtgcctgttgtagcattgtgctgctgcctggtcttgctgcccagttgggcctatggccttggatccatggcgtccatcgccgtgtcctacggcgaggacggccccgtgttctgcgggctcaactcggatggttctcacttggtcacctgcttcggcgcggatgcctccgttgtgtacggtgcccccagcaggatcccgttcgtaggggttactgcgggggatgggtttgcctgtggcctattgctcgacaccaatcagccttactgctgggggagcaactcctatgtcaagattggtgtgccgcagccgatggtcgagggagccatgtactcggagctcagtgcaggagacaaccacctttgtgccctacgaacatctgtcaaggggtttcacagcgtgaatggagatacatcggtgattgattgctggggatacaacatgaccgccacacataccgtcaccggagctgtatcggccatttcagctggttctgtgttcaattgtggcttatttgcacggaacaggacggttttctgctggggcgatgaatcggttagtggtgtcattgggctagctccgaggaatgtgcggttccagtctataggagcaggtggttaccatgtctgcggggtgctggagaatgcgcaggtattctgctggggtaggagcttggagatgcagcagatgtcaacacccagttctactgatgatggtgatgtgaacatagttccgatggatgcaatggtctccgtggtcggtgggcggttccatgcttgtggcatcaggagtcttgatcaccaagtggcttgctggggcttcacacttcagaacagtacacttgcaccaaaagggctcagagtttatgcaattgtggctggagattacttcacttgtggggtgccggccgagacatcgttgaagccaatgtgctgggggcatagtggcccattagcactaccaatggcggtatcccctgggatttgtgtatctgattcatgcagccatggctactatgaatacgcaaaccatggtgaagttggcagtggtagcaagacatgtaaacctgcaaattctagactctgcttgccctgcagtgttggttgcccagatgactcatatgagtcatcaccttgcaatgccacagctgaccgtgtttgccagtttgattgctcaaagtgtgcctcagatgagtgcgtgtcattttgtttgtcccagaaacggaccaagaaccgcaagttcatggcttttcagctgcgtatttttgtggcagagattgcatttgccgtcatattggtgttcagtgtgaccgctattgcttgcctgtatgtccggtacaaacttcgacattgccagtgttcaaagaatgagttgaggctggcaaagaatacaacatattctttccggaaggacaacatgaagattcagcctgatgtagaggacttgaagatcaggagagctcaggaattctcatacgaggagttagagcaagcaacagggggcttctcagaggattcacaagttggcaaaggcagcttttcatgtgtgttcaagggcattctgagggatggtacagttgttgccgtgaagcgtgcaattaaggcatcagatgtgaagaagagctcaaaagagttccataccgagcttgacctcctctccaggctcaaccatgcgcacttgctgaacctgcttggctattgtgaggatggcagcgagaggctcttggtttatgagttcatggctcatggatccctctatcagcatcttcatggcaaggatccgaacttgaagaagagactgaattgggccaggcgggtcactattgctgtccaagctgctcgggggatcgagtacttgcatggctatgcttgcccaccagtaattcaccgagacatcaagtcctcaaacatactgatagatgaggatcacaatgcgcgtgtcgctgactttggtctatctatattgggcccagcagatagtggtaccccactatcagagctgcctgcagggacacttggctaccttgatcctgagtactaccgtctgcattacttgacaacaaaatctgatgtgtatagcttcggagttgttcttctagagatcctaagtggcaggaaagctattgacatgcagtttgaggaaggaaacattgttgaatgggcagtaccattgatcaaagctggagacatttctgcccttcttgatcctgtcttatctcctccctctgatcttgaggctctcaagaagatcgctgctgtggcatgcaagtgtgtcagaatgcgagccaaagaccgcccttccatggataaggtaacaacagctctagagcgtgcccttgcactgctgatgggtagcccgtgcattgagcaacctattctgccaactgaggttgttcttgggagtagcaggatgcacaagaaggtatcgcagaggtcatctaaccattcgtgctccgagaatgatctcgttgacggggatgatcagcggattgagtacagagcaccatcttggataacatttccaagtgtgacttcatctcagaggaggaaatcctcggcatctgaagctgacatggatggacgaacaaccacagatggaaggaacgttgggagcagcataggtgatggattgcggtcgctggaggaagaaattagcccggcctcaccgcaggaaaacctgtacttgcagcacaacttctgatgaaatgtcaagaacagttgaaaattcaggcaactgtctgctgtttatggtcagcattgtgaattcagccaatgtgacctgccgttgctatattggaaattgcattgaaatgtttataaatccaatggtacctggccatctaaaagggagagagaactagctatagagagcactggaagaaattttagcagccggaggcatttctttgtagattattttaaatttttttggctctctttcctgatgttatttatatgtggatggtaacatttgatggatgctcatctgtagcttacagatctgtaccctaaacatcttttgcatgtctagtcttgctttttcctgcaaa

SEQ ID NO: 860 - DNA, 2401 bp, Oryza sativa
  CDS (89)..(2395)
attttgctaggagttgggtatctgggacatcaagaatatccacattgttagtaaggggtctaactagatggagaagagaagcaaggagatgttttcactgttttcctttgtggtaatatttctctgcttgataaccaacgccatatattcgggtagtaaatttgtgcatgcaacagatactctccttccaggcaaatctctaagtggtaaccaggtcttgatctcaaaaggcggtgccttcaggttgggtttcaactgcctatctcctccatgttattcagattctacctttggtatatggtacatcaaatcatcaacttgtaggtcactactagtttgggcacctgttgcaaatttctgcatctttaacccatggtcctcttcgtttatcctctcagaagatgggaagttaaacctaatcattgatggttcgcttagctggtcatcaaatggtgtggagacctctgtttctgcagttgcaatacttcttgacaatggaaatctcgtaataagagaccaagtgaatagtaccatggtgttctggcaaagcttcgataacccaattggtattctgctacctggagggtggctaggatttaataggatgacaggaaagaacgtctccctttcttccaaatattcgaccgatggatatgacgcatatgacactggaaattttattttggatataaatgcgaacgaaggtagagggtttaccatcaatgctcctgacttcgattctggcaatacatacaagataaaatattctggggcctttcctagatggatgggcgttcgtgcagatggaggttcgtttctccttttcaatgacgcagatatatatgtacaattatatcctgatggtaatgttactgctgcgaaactaggggattgtggatctgtgctgtggtctgctccagaaaattggtgcgactttgattcatactgtggttcaaacagcttttgtataatacccagcaaagaatcattctttgaatccccatgttatgatttttctgatttgggttatttgatgaatgtctcgttaaactgtagatataatgctccccataaacaaaatgtttcttttcatccgatggttggagtttacaaatttccccaaaatgaatggtcaatagaagtcagaagcataagagagtgtgaagctgcttgttacagtgactgttcatgtacttctttcgctttcaacaagacatgcttattatggtacggggagctgcagaacacaatagtgtttgattctagatcagagggatatctcatgtacatgcgcgtggtcgagcaaaagcaagaaaaatcagaatataaggttgcaattattgttgtaacagtgataggtgggttggtcctcatacttataagcatgattcttttgtggagaggcaaaagaaagctattcacagaaaaaccagtgaattctgatagcagacttatgatcttctcaaattcacagctaaagaatgcaacaaaaggtttctctgaaaaacttggagaaggtggtttcggatgtgttttcaaggggacattgccaggtttttctgtggtggccgtcaaaaagctaaaagaccttagacaaggggagaagcagttccgatcagaagtgcagactattggtatgattcaacatatcaatcttgttcgtttacttggtttctgtgctgaaggaagcaaaaggttactggtatatgagtacttggttaatggttctttgaattctcatctgttttcaaactattctgcaaaattaacatggaacctcaggtactgtatagcacatggaattgcaaaaggcttggcttatctgcacgaggaatgtaggcattgcatcatacattgtgacatgaagccagacaatgtacttcttgatgcagaattctgtcctaagattgcagacttcggtatggcaaagcttcttggtcgagatttcagcagggcactgacaacaatgcgagggactataggatatcttgcaccagagtggatctcagggttgcccattacacacaaggcagatgtttacagctatggaatgatgcttcttgaaatcatatcagggcgaaggaactcggagaagatcaaggaagggaggcacacttactttcctatctatgctgcatgtaaggtgaatgaaggtgatgtcatgtgcctgttggataggaggttggatggaaatgctgatgcagagcaactggagaaagcttgcaggattgcatgctggtgcattcaggatgctgaggatcacaggccaatgatggggcaagtcgttcacatgctggagggtgttatggatgttgaggtccctcctattccgaggtcacttcagtactttgtgggcatggaggataataatactcaatctgcggaatgtaactaatatctg

SEQ ID NO: 861 - DNA, 2501 bp, Oryza sativa
  CDS (89)..(2437)
tgcaactgcaagcaaagccatggccgctgatggtgatggcgacggtgagctagtgcggcgcgttcggtcgccgtcttcccgtggaagaatggcgccgacgctggcgttcctcctcgtcctcctcctgctgctcgccggcggcggcggcggcggcgcgttcttggcggcggccgcgtcgacggacaccgttgtcccggggaaggggatggccgggaaccagacgctcgtctccaagaacgggcggttcgagctcgggttcttcaccccgggctccggcatccactacttcctcggcgtccggctgaggaacatggcggagtacagccccacgttctggatcggggacagggtcggcgtcatcgacctccccggcgtgtcgctcgaggtgttcggcgacaagctgtacatcaaggaggacggggtcagcctctggtggtccagcgtcgctgggaacggctcctcctcctcctcggacggcggcgccgtcgccgtcctcctcgacaccggcgacctggtggtgagggaccaagggaacccctccggcgtcctgtggcggagcttcgactaccccggcgactcgctgctccccggcggcaggctcgggctcgacgcggccaccgggacgaacgtctccctcacattcaaaggcttttcccacaatggcagcctccaggtcgacgcgagcaggaggaacgggttcgtgctcaccaccgatggcatcgacagccgcggcgccttcccggactggatggtgacctcccaagacaacggcagctcgctggtgctcaaccaccctgacgccccgaactccaccgagttcttgcagttcaatcttgggctgatcagcctgatgcggtggtcggattccaccgccggctgggtggctcgctggacgttcccctccgactgcaagtccggcgccttcttctgcggcgacttcggcgcctgcacggccggcggcggcggcggatgcgagtgcgtcgacgggttcacgccgtcgtacccggacgagtggcggctcggctacttcgtcaccggctgctcgaggtctctcccgctgagctgcgaggccaacggtcagaccgagcacgacgactccttcgccattcttgacaatctccgaggcctcccttacaatgctcaggatgaaccagtgaccactgatgaagattgcagagctgcttgcctgaacaaatgctactgtgttgcatactcgaatgaatctggatgcaagctgtggtaccacaacctgtacaatctgagctcagctgataaacctccatacagcaagatctatgtccgtttgggttccaagctcaagagcaacagggggttggccacaagatggattgtgctcttggttgttggatcattagctgtaacttcggtaatgttgggactggtgcttctatgcagatacaggagagacttgtttgcatccagtaagtttgaagtagaaggctctcttattgtctacacttatgcacagatcaggaaggctacggggaatttctctgataaacttggtgagggaggttttggaagtgttttcagggggacattgcctggatcaaccactgttgttgctgtgaagaatctgaaaggtgttgggcaagcagagaagcagttcagaacagaagtacagactgttggaatgattcgacacactaatcttgtccgtctcttgggattttgcgtcaacgggaatagaaggttgctggtttatgagtatatgtcaaatggatccttggatgctcacatcttttcagaaaaatctagtttgctgagttggcatgtccgataccaaattgcacttggtattgcaaggggtctagcctatctgcatgaagaatgtgaggactgcatcatacattgtgatattaaacctgaaaacatactacttgattatgaattttgccccaaaatctgtgattttggtatggcgaagcttcttggacgagaatttaactctgcattgaccaccgtccgagggacaatgggctatcttgcaccagagtggatatatgggcaacctattacaaaaaaggcagatgtttatagctttggcattgtgctttttgaaataatctcagggagaaggtctacggagacagtgaaatttgggagccatcgctattttcctacgtatgcagcggtacaaatgaatgaaggagatgttttgtgcttactagatagcaggctggaaggaaatgctaacgtgaaggagcttgacatcacctgtagagtggcctgttggtgcatccaggatgaagagaatgacagaccgtcgatggggcaagtcgttcgcatgttggaaggcgttgtcgatatggagatgccaccaattccagcttcatttcagaacctcatggagagtgaagacagtggtatatactctgaagaaagctggaatttcaggacccgagatcagttctagcttcccctccagtttctcagaatgatactctcggtttctccgtggacctgcttggtgtgagcag

SEQ ID NO: 862 - DNA, 2601 bp, Oryza sativa
  CDS (98)..(2539)
gcgattttatcgcacgaattgcaacttatcatgatcgtgaccgcaaaacagcggcgagttcagaggtgatgatcgcgacagcacttccgatcaatccatggcgtgctcgtttctctgcaagccatggctgccattaacggagagcgcgaagcccgctcgctcgccggcgccgtcttcccgcgcaagaacggtggtgcagcagctcgccgtcctcttactactgctcggcggcgtcggcggcggcggtggcgcgctgcttgccgcggccgcgtcgacgacggacaccatcctccccggcgagagcatcaccgggaaccagacgctcgtgtccaagaacggtgagttcgagctcgggttcttcaacccgggcgtcgggatccactacttcctcggcgtccgcctcaggaagctcgcggcgtacagccccacgttctggattggcgacagggtctacgtcgtcgacctgcctcgcgccgcgctggagctcttcggcgacagcctctacatcaaggaggacggtgccagcctctggtggtcgtcgccgtcgtcctcctcctcctcctcgggcggcggccgcggcggcggcgcggccgtcgccgtcctcctcgacaccggcgacctcgtggtgagggaccagaggaactcctccctggtgctgtggcggagcttcgactaccccggcgacgcgctgctgccgggcgggaggctggggctcgacgtcgccaccggggagaacgtgtcgctcacgttcgaggggttcacccacaacggcagcctccgggccgacgcgagcaggaggaacgggttcgtgctcaccaccgacggccgcgacacccgcggcgcgttcccggactggatggtgaccacccaagacaacggcggctcgctggtgctcaaccacccggacgccacgaactccaccgagttcctgcagctcaaagtcgggcaggtcagcctggtccggtggtcgggcgccgacgccggctgggtgcctcgctggacgttcccctccggctgcaagtccggcggcggcttcttctgcggcgacttcggcgtctgcacgacggcgaccggcggcgaatgccggtgcgtcgacgggttcgcgccgtcggacacgaaggagtgggggctcggttacttcgtcaccggctgctcgaggtctctcccactcagctgcgacgccaacggccagaccgagcacggcgactccttcgccattcttgacaatctccaaggcctcccttacaacgcgcaggatgagccagcgaccaccgatgaagattgcagggaagcttgcctgaacaaatgctactgcgttgcatactcaactgaaactggatgcaagctctggtattacgacctgtacaatctgagctcagctgataaacctccatacagcaagatctatgtccgattgggttccaagctcaagagcaagaggggattggccacaagatggatggtgctcttggttgttggatcagtagctgtagcttctgcaatgttggcagtgttgcttctatgcaggtacaggagagacctgtttggatccagtaagtttgtagtagaaggatctctggttgtctactcatatgcacagatcaagaaggcaacggagaatttctccgataagctcggcgaaggcggattcggaagcgttttcagaggtacattgcctggatcaaccactgttgttgctgtcaagaatctcaaagggctcggctacgcagagaaacagttcagagcagaagtgcagacggttggaatgatccggcacactaatcttgtccgtctcttgggattttgtgtcaaagggaacagaaagttgctggtctacgagtatatgccaaatggatccttggatgctcatatcttttcacaaaagtccagtcctttgagttggcaagttcgataccaaatcgcgatcggcatcgcaaggggtctagcatatctacacgaagagtgtgagcactgcatcatacactgcgacattaaacccgaaaacatactactcgacgaggaattccgccccaagatcgcggatttcggcatggcaaagcttcttggacgagaattcaacgcggcacttaccaccatccgaggtaccaggggctatctcgcgccagagtggctgtatgggcagccgattaccaagaaggcagacgtgtacagcttcggcatcgtgctgttcgagatgatctcagggataaggagtactgtcacgatgaaattcgggagccatcggtattaccccagctacgcggctgcgcaaatgcatgaaggagatgttctgtgcttgctggacagtaggctggaaggaaatgccaatgtggaggagctcgacatcacctgcagagtcgcctgctggtgcatccaggacagagagggtgacaggccatcgatggggcacgtcgttcgcatgttggaaggtgttgtggacacggagatgcccccaattccagcttcgtttcagaaccttgtggatggtgatgacagtgatatatacgaagaaaactggcgtttgaggacccaagattagtgccagtttcccttcctgttttcaaagggagaagtatattggtttcttgctggacctatttg

SEQ ID NO: 863 - DNA, 2401 bp, Oryza sativa
  CDS (72)..(2321)
ttttcttcagggatagtgcttgaagataagaaatgaaccacaagcattctttctctgccctctgtgcagcaatgatactcaacgtgatcatattatttgtggatagctatgttgcagttgcatcagataccctttttcctggccaatctctctcaggctctgaaaccttagtatcagaaaatggtatttttgagttgggccttttcccctcagccccagctggtacaaagcactacctgggtattcgatacaagaacatgtcaagcaacaatccaataaccttttggctgggaaacagaattcccatcacctacttcattaatgcaacgctgtacatcgatgcaggtaaactttatattgaggagctcggctctattctatggacctcaaattcaacgagaaatgaatcaaacactgctgtggcagttattcttaacactggaaactttgtaataagagatcagctcaactcttctgtggtcacatggcagagctttgatcacccagctgataaactgctcccaggagcatatcttggactggacatggtcatgggaaccaacatcttgcttactctgttcaagcctccttataattgtaccctcatgattgaccaaagtaggaagaggggattcatcatgttcattgatgggcatgacaagtatcttggaacctttcctgaatggatggttacctacgaagaaaatggtagtctggtacgattaaacgatccaggaattccaaatgatactgaatacatgaaattgcaactggggcaactcagtttgttgaggtggttagataatgcaacaattagtggttggcaatctgtgtggagccacccttccagctgcaaagttagtgcttttcactgtggtgcatttggtatttgcacaagcacaggaacatgcaaatgtattgatggtttcagaccaacggagccaaatgaatgggagctgggacattttggtagtggctgctctagaattaccccctcaaattgtctaggtgttgtttccactgacttgtttgttttgttagacaacctgcaggggcttccttacaatcctcaggatgttatggcagcaactagtgaagaatgtcgagctatctgtctaagcgaatgctattgcgcagcgtactcctatcattctgcctgcaagatatggtacagcatgttgttcaatttgacttcagctgataaccctccgtacactgagatttatatgcgtataggttctccgagtaaacgcaggatgcacatactggttttcgtactaatttttgggtcaataggggttattctttttctgctgatgcttcttttgatgtacaagagatcctcatgtgttgcaagacagacaaaaatggaaggttttcttgcagtgtactcttatgcacaggtcaagaaagctacaagaaacttctctgacaaacttggggaaggaagctttggaagtgttttcaagggaacaattgcaggttcaacgattgttgctgtgaagaagctcaaaggcctagggcacacagagaagcagttccggacagaggtacagactgttgggatgatccaacataataatcttgttcgtcttttgggattctgtactagagggactagaaggttgctggtctatgagtatatgccaaatggttctttggattctcatcccttttcagaaacctcaagggtattaggttggaatcttcgccatcagattgtcgttggtattgctagaggtttggcctacctgcacgaggaatgcagggactccatcatacattgtgacattaagcctgaaaacatactactagatgcagagttctgccccaaaattgcagattttggtatggcaaagcttcttggacgggaattcagcgctgcactgaccactatccgaggaaccattggctatcttgcaccagagtggatatctggacaggctattacccacaaggcagatgtctatagctttggtgtcgtgctcttcgaaataatatcagggcggaggagtactgagaaaattcgacatgggaaccattggtatttccccctttacgctgccgctaaagtgaatgaaggagatgttttatgcttgcttgatgacaggatcgaaggaaatgcgagtttgaaggagttggatgttgcctgcagagttgcatgttggtgcatccaggatgatgagatccacaggccatccatgaggaaagttattcacatgttggaaggtgttgtcgacgttgaattgccgccaattcctgcttcctttcaaaacctgatggacgattatgatagtgatatatattccgtggaagtttgatatcggatcttttcagttgctagtagtttttattgcttgtttcttgaccttgatgttgtctatttaatcagaactgatca

SEQ ID NO: 864 - DNA, 3501 bp, Oryza sativa
  CDS (28)..(44), (145)..(173), (272)..(397), (1180)..(3476)
aagaagccaaaatgatcttatactggaatggagattgcaagacagtaagcagcaactgagttactaagccaggaggaataaacgtttcaccctccttctctttcgttgccactgcatttcactttctttctgcatttcctgcaggttgtccgtcgcctattaccaacggccaggtagccaggtccaagctccgtcccttgaattcagagactggaaacaatggcgccgccctgctcctctgctctcgttcttccttgcctgcttgtcatagccatggccgctctgcaaagtgctgtggtgtttgccgataccgtcactgccaaacgcccgttgtccggcagccagagtgcactggtgtccaagcgtcgcaagttcgcgctcggtttcttccagccaggtaccgccacattctatgtgtttgtttccggctttaattgtttgtgttacaagaaaagagcgtagtaaggaaaattttagaatgtgtatagcctctagaggaaatatgtcggtgctttaatttctaacaatccaaatacgtggagcgagatcgtagcaacaagaaagaaaataacatgaacaaggttcatagttactccatttcatctagttaacatttatacgagatttggttaaatttttaaaaaattgatcatcaataattgattcaattgtttagttttaaaaagtggtatgtgaagatagatatgccttgaaaaatactattacgatagattcattatattttatagacttatcctaatataaaattaatggccaaagctccaagagttcggctgaattttgtcctaaacaacaaatatttataactggagggagtacatgtggttttccacaacaacaaaacatgagttattgtggtgcaaaacaactttgaatgagaggagaatagttttgtcaacttttttttcttaaatatattatagttactacaaattaccattggtataagatttaatcttttcagatgcacttgatagtgtagtggtaaaaggtttaaccctaaagttttgtgttcaattttaatacgcttataactttttctaattaactaattgataaccaagttgccccttagttgttcttgtttcttttatgagatttatgcttttgatttttgtgtgcttactaagaggtactactccttttgatgtgcaacagaaaattcacagcattggtaccttggcatctggtacaaccaaatttccaaacacacacctgtctgggttgcaaacaggggcactccaatctcgaatccggacacctcacaactaaccatagcaaccgacggcaacatggtattactcgacaattcaacaactgcaatttggtccacgaacatctccaagatcgcctccaactccacggtcggtgtcatcctcgacaccggcaaccttgtcctcgcagacgaatcgaacacctccatcatccactggcagagcttcgaccatttcggcaacacctggctccccggcggcaagctcggccggaataacaagctcgccggcgtgagcacccgtctggtcgcatggaaggctcgcaatgacccatctccaggcgtcttctccctcgagctggatccgaatggcacgagccaatacctgctcgaatggagcatcacgcagcagtactggacgagcggcaactggactggccgcatattcgccgacgtgccggagatgacgggatgctacccgagctcgacgtacaccttcgactacgtcaatggcgagaacgagagcgagagctacttcgtgtacgacctcaaggacgagtccgtcctcacgaggttcttcctgagcgagatggggcagatccagttcttgacatggatctacgcagccaaggactggatgccgttctggtctcagcccaaggtgaagtgcgacgtgtactcgctgtgtggcccgttcagtgtctgcaccgagaacgcactgacatcttgtagctgcctccggggattcagcgagcagaacgttggcgagtggttgcagggagatcacacttcagggtgcagaagaaacgtcgagctgcagtgtagcagcaatgcctcagtgatggggaggactgatggtttctacacgatggccaacgtgagattaccaagcaatgcagagagcgtggtggtcataggaaatgatcagtgtgagcaagcatgcttaagaagttgttcttgcactgcttactcctacaacggcagctgctcactgtggcatggagacctcatcaacctgcaggatgtgtctgccattagtagccaaggaagcagcactgttttgattcgcttggccgcttcagaattgtctggccagaagcagaagaacaccaagaacttgatcactattgccatcgttgctactagtgttctagtactcatgatagctgctttgtttttcatcttcagaagaagaatggtaaaggaaacaacaagagtggaaggttccttgatagcattcacataccgtgacctgaaatctgtgaccaaaaatttctccgagaagctcgggggaggcgcattcggtttagtgttcaaagggtcgctacctgatgcgaccgtggtggccgtgaagaagctcgaaggttttcgtcagggggagaagcagtttcgcgcggaggtgagcacgatcggcaacatccaacacgtcaacctgattcgattgctcgggttttgctcggagaaatcgcgaaggctactcgtctacgagtacatgccaaacggttcactggacaagcaactttttgacaataaaaaacatgtcctgagttggaacacgaggtaccagattgctcttggaatcgcgaggggattagactacctccacgagaaatgcagggattgcatcatacactgcgacatcaagccagagaacatactgctcgatggctcgtttgcacccaaggtcgccgacttcgggctcgccaagctcatgggccgcgacatcagccgcgtgctgaccacggcgaggggcacggtggggtacatcgcgccggagtggatcgccggcacggccgtcacggcgaaggcggacgtgttcagctacggcatgacgctgctcgagatcgtgtcggggaggcggaacgtgcagggacgacggaggaggcaggagcagcaggacgacggcggcgcggcggcggaccgcccattcccgttggtggcggcgggcaggctcgtcggcggcggcggaggccggcgggaggagctggtcagcgccgtggtggacggccggctcggcggcgacgccgacatgggcgaggcggagagagcatgcagggtggcgttctggtgcatccaggacgacgagaacgcgaggccggccatggcgacggtggtgcaggtgctcgaagggctcgtggagatcggcgtcccgccgattccgagatcacttcagttcctcgcggagttggccgatcaatcaaattacttgcagttcttctccgatttattaccgtcgaattgaggtccttgcaggtgcaggcttgagg

SEQ ID NO: 865 - DNA, 2601 bp, Oryza sativa
  CDS (67)..(2562)
ctcttctcccgcgtgcacctcactatacgtacgttggcacgtaccacgtacgcacatccgatccacatgcctcctcttctgtataacctcttcgtgctcatcgtcgtcttcctcggcggcggtgctccggcgtgttcagccgcgacggacaccgtcaagcctggccatgtcgtcggcggcaaggacaaggtcgtctccaacaacggcaagttcgcgctcggcttcttcaaagccccggctccaaaccaagagaaatggttcctgggcatatggttcaacacggtgcccaaccgcaccacggtatgggtagccaacggcggagagccaatcatggacgccgccgacgccggctcgccggagctcaccatctccggcgacgacggcgacctggttgccttacacccaaccaccaagtcaatagcctggtcaaccaacgtttcagccaagaactccaccagcaacagcaacaacactgcagccgtccttctgaacagtggaaacctcgtactgcaagacacctcgaacatgtcccaacctcgtacgctgtggcagagcgtcgaccacccgaccgacacgctcctccccggcgcgaagctcggccgcgacaagctcaccggcctgaaccgccgtctcgtctccaagaagagcatggccggcccgtcccccggagcctactgcttcgaggtagacgaagacacgcctcagctcgtgctcaagctctgcaattcgtctgtcacctactggtccagtggaccatggaatggtcagtacttcactggcatccctgagctgatcggcaattcacctggctttcaccttgggttcttcgacaacagcagagaggaatatctccagttcaatgtgtcaaatgaagctgtggtgacacgcaacttcatcgacgtcgatggccggaacaagcagcaggtttggctggacagctcgcagtcttggctgacgctgtactccaatccgaaggttcagtgtgatgtgtacggtgtatgtggggctttctcggtctgcagtttcagtttgcttccactctgcagctgcatgaagggattcactgttggatcagtgaaggattgggagcaaggcgatcaaactggtggatgtgtgagaaagaatcagttggattgtgtaggtagcaacacgagttcatcagattcaactgataagttctactccatgtctgatatcatcttgcctgacaaagctgaaagcatgcaggatgttgacagttcagatgaatgcatgaaggtttgtctgaataattgctcttgcactgcttattcatatggcagtaaaggttgccttgtttggcacactgaattgctcaatgcaaaactgcagcagcagaattccaatggagaaatcatgtatctccgtctctcagcaagagatatgcagagaagcaagaaacgtagagtgataatcggtgtcgtcgttggtgcatgcgctgctggtttggctgtgctgatgttcattttgatgttcatcatcaggaggaacaaagacaagaacaggagtgaaaattatggtagcctcgtggctttcaggtacaaagatttgcgttctgcaaccaaaaacttttctgaaaagattggcgaaggcggattcggctccgtcttcaggggacaactgcgtgattctaccggcatagctgtgaaaagactcgacggtagatcacaaggagataagcaattcagagctgaagtgagatcgatcggaaccattcaacacatcaacttggttaatctgattggcttctgcagtgacggcgacagtaggtttcttgtctacgaacacatgccaaatcgatctcttgacacacatctgtttcaaagcaatggcaagttcttggactggaacactcgctaccagatagctcttggagttgccagaggcttgtgctacttgcacgagagctgccatgatcgaatcatccactgcgacatcaaaccgcaaaacatactactcgacgcatcgtttcttcccaaggtcgcggattttgggatggcaaagtttgtagggagagatttcagcagagcactcaccaccatgagaggaaccataggttatcttgcgcctgaatggattagtggaacagcaattacaccgaaagtagatgtttacagctatggaatggtgctgcttgagctagtgtcaggcaggaggaactcagccagatcagaagaagaatgcactactactaccactacttctacatccactgacactgatggcaactattctgtctacttccctgtgcaagcttcaaggaagcttctagatggagatgtgatgagcttgctggaccagaagctgtgtggtgaagcggacttgaaggaggttgagagagtgtgcaagatcggttgctggtgcattcaagaggatgaggttgatcggccgacgatgggtcaagtggtccagattcttgagggtgtcttggactgcgacatgcctccgttgccgaggttgcttcagagaatctttgagaggccgtcttcagttagcaccagcacaccagttttcctttttgtcggtagccctgaacgccaatgagaatacagtatcagtttggaatgtacagtatatctgaat

SEQ ID NO: 866 - DNA, 2808 bp, Oryza sativa
  CDS (1)..(2475)
atggaagctcatggcaatcgtcgcagcagtccaacataccttgttatgctgtggatgatttcggtagctagcctattgataacatgtcgtggcagtatccagaagcaagttctctttccagggttcactgccgcgcaaatggattacattgataacgatgggatatttctgctttctaatggctctgtctttggctttggttttgtcacgagcaatgtctcagacaacacgttctacattcttgcagtggttcacatggccactactaccacagtctggtctgccaatcctaactctcctgtcacccattcagatgacttttttttcgacaaggatggcaatgccttcctgcagtcaggaggaggctccaagtatgggctgccaatatctccgggaagggactgccacctctatgcaactactggactctggcaatctgtagtgcttgggaaagatgcctcttctcctctctggcaaagtttcagccatccaacagacactcttctgtctggtcagaatttcatcgaagggatgacgctgatgagcaagtccaacacagtacagaacatgacctatacacttcagatcaaatctgggaacatgattttatacgccggcttcgagacacctcaaccatactggtctgcacagcaggatagcaggataattgtcaacaagaacggtgacagaatctaccctgcaaacctcagttcagcttcttggtccttctatgatcaatcagggtcccttctatcacaacttgtcatcgcgcaagaaaatgccaatgccacattgtctgctgtccttggtagtgatggattgatagctttctatatgctgcagggtggaaatggcaagagtaaattctcgatcacagttccggcagactcttgtgacatgccagcctactgcagtccttacaccatttgcagtagtgggacaggttgccaatgcccttcggccctcggctcgtttgcaaactgcaatcctggtgttacatcagcatgcaaatcgaacgaggagtttccgctggttcaactggatagtggagttggatatgtaggcactaacttcttccctcctgcggctaagacgaaccttacgggttgtaagagtgcctgtacaggcaactgctcttgtgttgctgtgttctttgatcaatcttcaggcaattgtttccttttcaaccagatcggaagcttgcagcacaaaggtgggaatacaactcgtttcgcatcttttatcaaggtatcaagcagaggaaaaggtgggagtgatagtggcagtgggaagcacaataccattattattgtcattatgctcggaactttggctatcataggcgtccttatttatattggtttctggatctacaagaggaagaggcatcctccaccatcacaagacgacgctggttcatcggaagatgatggatttctgcaaacaatatccggagcaccagtgcggttcacttacagggagctccaggatgcgacaagcaacttctgtaacaagcttggtcagggagggtttggatctgtgtatcttggtacactcccagacggcagtcgtattgctgtgaagaagctggagggcataggccaaggaaagaaagagttccgctctgaggtaacgatcattggtagtatccaccacatccatcttgtcaaactccgaggcttttgtactgagggaccacacaggcttcttgcctacgagtacatggcgaatgggtcgctggataagtggattttccattctaaagaagatgatcacctgctcgactgggatacaaggtttaacattgcgcttggaacggcaaagggattggcatacctccatcaggactgcgattcgaagattgtacactgtgacattaagcctgagaatgttctacttgacgacaacttcatcgcaaaggtatctgattttggccttgccaagttgatgaccagggagcagagccatgttttcactacgctcagaggcacgcgcgggtaccttgcacctgagtggctcaccaactatgccatctcagagaagagtgatgtgtacagctacggcatggttttgcttgagataatcggtgggaggaagagctacgatccctcggagatctccgagaaggctcacttcccttcctttgcattcaagaagctggaggaaggcgatcttcaggacatcttcgacgccaagctgaagtacaatgacaaggatgggcgggtcgagaccgcgatcaaggtcgcgctctggtgcatccaggatgatttctaccagagaccatccatgtcaaaggttgtgcagatgctcgaaggcgtctgcgaggtgctccagccaccggtgtcgtcgcagatcgggtacaggctctacgcaaacgccttcaaatcgagcagcgaggaggggacttcatcagggatgtcggactacaacagtgatgctctgctttcagctgtgaggctttctggtcccagatgatgtgaagaatcccatgtacagtgccttgtctagttaggttgcaaagtgtgcaaattttgctgtagtttccagtgttttggtgatcatttgcttcacactattgtacatatcttcttggtcatttctggtggtagtttatacatatcttgctgattatttatggtggtagtttatcggtgccattctttttttgttgcccttttggttatacataaggtctccaaaacctttgacaattaccttttgtagttatgtcttggtaaaaataataggaaatgcaatgatacaaaaggctttttcatgaaaaaaaaaaaaaaaaaaaaaaaaaaaaaa

SEQ ID NO: 867 - DNA, 822 bp, Zea mays
  CDS (70)..(540)
ctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacggcggtcggcgcgagggtggtggcggcggctacggaggcggtggcggctacggcggtcggcgcgagggtggtggtggcggctacggcggcggcggcggcggctggagggactgatgtgtgggcccatcctggcttcggccgagttatcttatctatctatagtatcgtgttaccgttcgcttctgtcaccgtgttagtgtccgttctacctttggattaggtgttggtacccctgttgttccctttgtttgctcccgctatgaaacgagacgagagaagaatgagcaaggtttttgttcgcagctatttttgtccaatgatattgatatgttgttcccctgtctgttgctggattgttgtgtggctatacaaatatcaacaaactgttaaaaa

SEQ ID NO: 868 - DNA, 824 bp, Zea mays
  CDS (82)..(546)
gttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttttgattgcaaggtcgctctgtgtcagttgttagtgctgtgttcatcctcggtttcagcagacccatgcatcaaacagcatggactgcggatcgatggatgctgttacccccgtcaggctttattctaagttaatcttaaggaaaaaatggtgcttcttggtgctgc

SEQ ID NO: 869 - DNA, 1685 bp, Zea mays
  CDS (161)..(775)
gcccgggccgactccactccaatccaatcctggggcgggcgactgcctccttccctcgatctattctccatcttgtcctccctttgctaaaaataacgaggcagaggcatcttcgatttgacgtgcgcttcctcttcctcgctcgctctcggtcgcagtgatggctgatgtcgacgagtaccgttgcttcattgggaacctgtcctggtcaacgactgatgaaagcctcaaggatgcgttcagcaaattcggcaacctcactgaggcaaaggtggttcttgacaaattttcaggacgttctcgtggtttcggctttgtaacttttgatgagaagcaagccatggaggatgctattgagggaatgaatggactggacttggacgggaggaacatcactgttgataaagctcagccacaaggacctggtagagaccgtaatggtgaccgtgattatgaccgcgagcgtggatctcgttatgaacgtggtcgtgactatggtggtgggcgtgcaccgcgaggtggtggtggtggtggtggtggtggtgactgcttcaagtgtgggaaacctggtcattttgctagagagtgcccatctggggatggtgggagaggggacagatatggtgggagagatgacaggtatggtggcggtggcggtggcggtggcggtcgttatggttctgaccgtggtggtgaccgatactctggccgtagccgagatggcggcagctatgggggtggcgatcgctacagccgtgaccgatcaggtccttactgatggccttagttcttgattgagaagtatgtgccatccaggcatatgacttggtcatagtgcttggcgcttggatcctgcatgtttgcttgatgtgctatttggctattaaaagatggattttgtcactgtgtttgatgaccctggtcctaattaagcttatgcctgtgatacgggggattggatggcaagttagtgtccgcatttgtgttcttttcggggaagcaaggggttgactactataatctacttgaacacacctacagctacaagaaaaaactatgttcttgttacctcttctgaaagcaagtgatgaatcgtccattagagaaaattaactggcttctttttggttatttgttcttgttgtggattggttgatactgtggttctggatttggttacttgcgtcctaagatcattttagtctggccagttgatccacgaatgcaaagagattatcctttggttccattctatgtgcctttagcattggagggcctctatttatggttgcttgatgaactggttatgtttgcttcgccatgttggtggggtgttccttgagctgtcccgtgttccttgtgacttgtgagaacaccagaggttatgcttgcctgagtggatgtgatgctacctggttgctgttcctttgacaatgcaccaatgtcctatcgcagcttatatactctggttccagattaattactggtgcccctttgagaggagttatgatgatgttattattcatcagcagcattctaattgcccttgatttagtgtagcctttttttcttagttcaccgaatctcaggatgcaaacgttaggttacttttactgttcgtactaaccaattgagcttttgtactaaaaaaagtatgttacattaagctgctccaggttccgttt

SEQ ID NO: 870 - DNA, 835 bp, Zea mays
  CDS (192)..(659)
agctggcaggcacatgacacatcgccccagccccaagtccaaagccgcgagaggcaggggcgcagcaaaaccctagccgccttcccgtccttttcctttcataaaccccaagccgcgccgcaatagctcgccccctcgttcgccgcctctcctgctcctaccgcagctctccctcaggtttagtgttcgcaatggcggccttcaacaagcttggtggccttctaaggcacagtgctctggtgagcggtatcactggtggctcttctcctgcagtgttcaatgctgcacggctcatgtctaccaagctatttattggtggtcttgactggggtgttgatgacgtgaaactaagagaagcatttagcagctttggagaggttactgaagcgagggtgatcacagacagggagactgggaggtcaagaggctttggctttgtgaactactccgacagtgatgctgccaaggaagctatttctgcaatggatggcaaggaaattgatgggcggcaggtacgtgtcaacatggctaatgagagacctgctgggaaccgtggtggtggcggctatggtggcggcggctatggaggtggtggctacggaggtggtggcggctacggaggtggtggctatggtggtggcagccaaagctatgatgcttgaggggggcaggatcctattaagtgcattatcaaccaagatatttgaaataatgaactttaggacttggtatgacgttttatgttaagcattgtcaggttttgctattcgtgttatgctgaattgttggaactcctagatgcagaatattacgtattggttttggttcaaaaaaa

SEQ ID NO: 871 - DNA, 717 bp, Zea mays
  CDS (86)..(484)
cccacgcgtccgcaccgccgccgcctttcgtaccgcggcccctaaacccctttcctcgttcccctccgtctctcagttaggcacaatgatgctagctaataagcttggtggtctgctcaagaatgctacgagttcaaatatgtctgtctaccaagcaatcagatgcatgtcatcatccaagctttttgttggagggctttcttatggaaccgatgatcacagtctcagagacgagtttgccaaatatggacaagttattgaagctaagattatccttgatcgtgagtctgggaggtccagaggttttggctttataacttacacgtcttctgaggaggcttcggctgccatcactgccatggatggaaagactctggatggacggaacatacgggttaatcatgctaacgagaggacaggtggcttccgcagcagcggtggttatggcggtgggctgtttaagatggcccagggcttcctcaagtagatatattgtctggccaacgtacgtgtactcttgtagtatctgttacgtaattagcttcaaaataatgttcccctcgcctttatttgctgttcaagtccctgtaataaccgagaacgttaattgtagcagtgtgttttttatatgattaaataagtactatgttgtataaaaaaaaaaaaaaaaaaaaaaaaaaaaaaaaaaaaaaaaaaaaaaaaaaaaaaaaaaaaaaa

SEQ ID NO: 872 - DNA, 1201 bp, Saccharomyces cerevisiae
  CDS (76)..(1122)
gagatgagctgcctactgctcaccttgccgtttccaaaaaagagttagaaccgacaaattcatccaaagaaaataatgagcaagacagccgtgaaagattctgctacagaaaaaaccaagctaagtgaaagcgaacagcactacttcaattcgtacgatcactatggtattcacgaagagatgcttcaagatactgttcgtaccttatcttacagaaacgcaattatccaaaataaggatctttttaaggacaagattgttttagacgtcggttgcggtaccggtattttatccatgtttgccgctaaacacggtgcgaagcatgttatcggtgttgatatgtcaagcattattgagatggcgaaggaattggtagagttgaacggattcagcgacaagatcaccttgctaagaggcaagttggaggacgttcatttaccctttcctaaagttgacatcataatttctgaatggatgggttactttctactatacgagtccatgatggacaccgttctttacgctagagaccactatttggtagaaggcggtctgatctttcccgacaagtgctccattcatttggccggtttggaagactctcagtataaagacgagaagttgaactactggcaagacgtttacgggtttgattattcgccatttgttccgttggtcttacacgagcccatcgtcgacaccgtggaaagaaacaatgtcaacaccacctcagacaaattgatcgaatttgatttaaatacagtaaaaatatcagatctagcgtttaagagtaactttaaattgacggccaagagacaagatatgattaatggtatagtcacctggttcgacattgttttccctgcaccaaagggtaagagacctgttgagttctccactggtcctcatgctccatacactcactggaagcaaacaatattttatttccctgatgatctagatgctgaaactggtgacaccattgaaggtgaattggtttgctctccaaacgagaagaataacagagatctaaatatcaaaatttcttacaagttcgaatcgaatggcatcgacggtaattcaagaagcagaaaaaacgaaggttcttatttaatgcattaagacttttgtttgctggagaaagaaaaaaatttgaaaagcaaataaacaaacttgttcatattattgacgcgaatatgtg

SEQ ID NO: 873 - DNA, 1765 bp, Zea mays
  CDS (44)..(1318)
cccacgcgtccgctgtcctctcctcccttctcatcatttcgccatgctgccatcgcacctcaacggccactccgccctcgggcgccgtcgcccgcgcctctccgccgccgccggggagtctccggcggcagcgggggtagaggcggcggctccgctggaggagcacgaccgcatctacttccaggcctactcccatctcggcatccacgagactatgatcaaggaccgcgtaaggaccgatgcttaccatgcagcgatcatgcgccaccagaaatttatcgaggggaaggttgtgctggatgtggggtgtggtactggaatactctctgtgttctgtgctcgtgctggcgcaaagcgagtgtatgctgtcgaagcctgtgaaattgttgtccaggctcgtgaaattgtaaaagcaaacaacctaactgatcagattgtggtcatccatggacgtgttgaggatgttgaccttgaggaaaaggttgatgttataatatcagaatggatgggctatatgcttctctatgagagtatgctgccaagcgtcctatttgcaagagataaatggcttaagcccgggggtcttattcttccttctcatgctacgctcttcatggcccccgtaacaaatcgtgagagatatgaagacagcgtcgatttctggcgtgacgtctatggcataaacatgtctgctcttgtgccacttgccaaaaagtttacatctgaggaaccctccattgaaacaattggtggagagaatgttataagttggccatctgtgttcaagcgcttcgattgctataattttacagctgaggaattcaaatctatcacttcaaaatacaaagtttcatcaatgatgttagctcccattcatggctttggtttctggtttgaggtggagttcaacgagcctatagagtcctctcataattttccttccagtttggatccacttgagattatacagaagaaaaggagacgatcctcagaagatatagttctgtccacagccccagaggatgagccaacccactggcaacagaccattttgtatttcccggatcctatagaggtgaagcaggaccaaattatagaaggttctgtaacagtgtcccaaagcgaggagaatccacgttttctgaatattcatctagagtgcttcacaggaggacagacattggttaaggactgcgccatgccgatgaactggtgtttttatgcttctagtggcttgatttcaggcgcgcaatggggtgttggcagggaggagctgacaatatttcagatttctttaatggaagtggagaatttgtactaaaaaaaaaaaaaaaaaaaaaaaaaaaaaaaaaaaaaaaaaaaaaaaaaaaaaaaaaaaaaaaaaaaaaaaaaaaaaaaataaaagaaacagggtggccggcttaaagatgccaagttaaagttcttgtgtaggggaagctaaattttttttatagggccgcctaatacaaattcacgggccgggaaaatcacagcggtagcccaaggtaaaaccctggggttacaaaactaattcgcctggcggacattcccttttaggacctgccgtattacctaaaaaaccgaaccgatcctctttccaaaatgggacccccctgatgcggaatgtaaacccccctggaaggggcaattacgcgcagggggacggggagattcgccaaggggtaccgtcacttgtcagggccttatcccccttttttgcatttttcccttcttcctagacaaa

SEQ ID NO: 874 - DNA, 1474 bp, Zea mays
  CDS (102)..(1232)
ccctttaaaacgcacaactccataaaccctagcggacaaagccacttgctcacaccagaaccctctccgcaatctccccgcctcgctcccgcctccacccaatggcgtctctccctaacggtggcggcgccgccgcctctggctcatgcggcgcgcgccctgtggacaaggaggtggacttcgccaactacttctgcacgtacgcctacctttaccaccagaaggagatgctctgcgaccgcgtccgcatggacgcgtaccactccgccgtcttccgcaacgcgccccacttccagggcaaggtggtccttgacgtgggcaccgggagcggcatccttgctatctggagcgcgcaggccggggccaggaaggtgtacgccgtcgaggcgactaacatggcggagcacgcgcgcgagcttgctcgcgccaacggcgtcacggatatcgttgaggtgatacagggcaccgtggaagacgttgaccttccggagaaagttgatgtcattatatcagagtggatgggctactttcttttgagagagtccatgtttgattccgtcatttgcgcacgtgaccgctggttgaagccagatggtgtgatgtatcctagccatgctcggatgtggctagcacccataagaactggtttgggtgacaagaagagggaagattttgatattgctatggatgactggagcctgtttgttcaggacactcaaacttattatggtgtcaacatgaatgctttgacaaaggcatatcgtgcagaacatgaaaaatactatttgaagtcttcaatatggaacaatcttcatccaaaccaagttatcggtcaacctgcagctatcaaggaaattgattgcttgacagccactgtcgatgagatccgagaagtcagagcacaagtcacattgccaatcagaatggaagctagattatcagcactggctggatggtttgatgttcattttcgaggtagtgctcaaaaccctggggtggaggaagttgaattaactacagcgccagatgagcatggtggaactcattggggtcagcaggtattcttgctgactccacctctgagtgtgactaaaggagacaacgttaacgtttccttctcgatggttcgctcgaaggaaaatcatcggcttatggatatggagttcacatatgaattgcacgagttatctggcaggaagcacccagcagtcaaaaccaagatgtacttagagtagaacaagatggaaagacggaacctcacgacgccgttgctgaaacctttgctcagaagctgagcatgtagtgtgcttgttacacccatgatgggtacattgagaccatttatgttgtattagtaatatattgtttgattgcccaattaacggggtgagccattgtttcatcacaacatcgatgtgttagcagataaccacatcgccgttttaagcaaacattgagtgcggaaaaaaaaaaa

SEQ ID NO: 875 - DNA, 728 bp, Zea mays
  CDS (68)..(538)
gttctcctcccccttcttaccaagtcctcctcggggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacggcggtcggcgcgagggtggtggcggcggctacggaggcggtggcggctacggcggtcggcgcgagggtggtggtggcggctacggcggcggcggcggcggctggagggactgatgtgtgggcccatcctggcttcggccgagttatcttatctatctatagtatcgtgttaccgttcgcttctgtcaccgtgttagtgtccgttctacctttggattaggtgttggtacccctgttgttccctttgtttgctcccgctatgaaacgagacgagagaagaatgagcaaggtttttgttcgc

SEQ ID NO: 876 - DNA, 1527 bp, Zea mays
  CDS (157)..(1278)
ccacgcgtccgcggacgcgtgggggagaaagataggagtcaattaatttgcctgttctgcttgctgctgaccttgtgagtgagccgccggtcttccccttcctcgccgaggggaaataataaggcagccacagccagggccgccccgaggaagaagatgagcggaggaggcgtggacggagctccggtcgccgagttccggcagacggtgacgcacggcggccggttcctgcagtacaacatcttcggcaacctgttcgagatcacgcacaagtaccagccccccatcatgcccatcggccgcggcgcctacgggatcgtctgctcggtgatgaactccgagacgaaggagatggtggccatcaagaagatcgccaacgccttcgacaaccacatggacgccaagcgcacgctccgggagatcaagctgctgaggcacctcgaccacgagaacatcatcggcatcagggacgtgatcccgccgcccgtcccgcaggcgttcaacgacgtgtacatcgggacggagctgatggacacggacctgcaccacatcatccggtccaaccaggagctctcggaggagcactcccagtacttcatgtaccagatcctccgcgggctcaagtacatccactccgccaacgtgatccaccgcgacctcaagcccagcaacctgctggtgaacgccaactgcgacctcaagatctgcgacttcgggctggcgcgcccgtcctccgagagcgacatgatgacggagtacgtggtcacgcgctggtaccgcgcgcccgagctgctgctcaactccaccgactactcggcggccatcgacgtctggtccgtcggctgcatcttcatggagctcatcaaccgccagccgctcttccccggacgcgaccacatgcaccagatgcgcctcataaccgaggtgatcgggacgcccacggacgatgagctcgggttcatccggaacgaggacgcgcggaagtacatgcgccacctcccgcagttcccgcgccggccgttcgtcagcctgttcccgcggatgcagcccgtcgcgctggacctcatcgagcggatgctcaccttcaacccgctgcagaggatcacagtggaagaggcgctggagcacccgtacctggaacggctacacgacgtcgccgacgagcccatctgcacggacccgttctcgttcgacttcgagcagcaggctctgacggaagaccaaatgaagcagctgatattcaacgaggccatcgaactcaaccccaacttccgatactagctagctagctagttcggacacacatcttaattatacgtatgtatgattcctcgtacgtggtttgtaaatagaagatcgagccggccgccggtgttattagactgaacgttgcatttgtttgttcgttgacgttcgcgctcgcaggtttcaggctgtgtagtctgctgcaggtttcaggtgttcgtgtaatgagctgtaccaagaataaaatgctttggactaaaaaaaaaaaaaaaaaaaaaaaag

SEQ ID NO: 877 - DNA, 1687 bp, Zea mays
  CDS (110)..(1300)
caaaactcgcagcaacgaattgggcatattccccccacctgcaccccccacttttggcactttcccttccggccccctctcctcggcgcgatctaaatccggtccggcgatggacggcggggggcagcccccggacacggagatgacagacgccggcgcgggcggcggggggcagccttcgccaccgcagcagccggcgggcggggccgggatgatggagaacatccacgcgacgctcagccacggtggccgcttcatccagtacaacatcttcggcaacgtgttcgaggtcacctccaagtacaagccccccatcctccccatcggcaagggcgcctacggcatcgtctgctcggcgctcaactccgagacggcagagcaggtggccatcaagaagatcgccaacgccttcgacaacaagatcgatgccaagcgcacgctccgcgagatcaaactgctccgccacatggaccacgagaatattgttgcaataagagatatcatacctcctccattgagggaggcattcaatgatgtgtatattgcctatgaattgatggatactgatctgcatcaaattattcgttcaaatcaagctttgtcagaggagcactgtcagtattttctttatcaaattcttcgtggcttgaagtatatacattcagcaaatgttcttcaccgtgatttgaagcctagcaatcttcttttgaatgcaaactgtgacctcaagatatgtgattttgggcttgctcgcaccacctcagaaactgattttatgactgaatatgttgtcacaagatggtatagagcaccagagcttttattgaactcctctgaatatactgctgccattgatgtgtggtctgtgggctgtatatttatggaactgatggaccgaaaacccttgtttcctggaagagaccatgtccatcagctacgtctactaatggagctcattggaacaccgaatgaggctgatcttgattttgtaaatgaaaatgcaagaagatatatccgccaacttccctgtcatgctagacagtccttccctgaaaaatttccacatgtacaacctttagcaattgacctagtggaaaagatgctaacttttgatcctagacagagaataactgttgaaggcgcacttgcacacccttacttggcatcacttcatgacataagtgatgagccagtctgctcaatgcccttcagcttcgacttcgagcagcatgcattatctgaagaacagatgaaggatctgatctaccaagaggctcttgcattcaacccagattaccagtagccaaagttcggttccagccggtgattgcgttcattgacatggagatttttatcccacctgatgtcactgcaaaaagtcgccaactccgattgctagctgtaaataattgccttccccgaagacccccccattccttccttgattaaaaaaagcaggagacggtggccattcaagggtagaaaagagcgagcttgtgaaggtcaaatttctgcgcagctatggattcttgtgcttacaatatgttgtttttaatcaggttttcctttctttttcttcttaagtacttctcggtgttgtctgtaagagaggtagctcatgaacgatggctgcctgaattcagtggctgtcgtcaaagtgaacagttctagtcgacttaaaaaaaaa

SEQ ID NO: 878 - DNA, 1390 bp, Zea mays
  CDS (76)..(1185)
ccgacggccgtgggggcatcgacggccgggcgacgcgacgcgatgtgaccatgacccgtcagtcagcagtacaaaatggcgatgatggtggatcctccgaatggaatcgggaaccaaggaaagcattactactctatgtggcagaccttatttgagatagacaccaaatatgtgccgatcaagcccattggtcgaggagcttatgggatagtttgttcatccattaatcgtgaaacaaatgagaaagtagcaataaagaagatacacaacgttttcgacaaccgtgtggatgcactacggaccttgcgggagctgaaactccttcgccatctccggcatgagaatgtcattgctttgaaggatataatgatgccaatacacaggagaagctttaaggatgtgtacttggtatacgaactcatggatactgatttgcaccagataatcaaatcacctcagggcctttccaatgaccactgccagtattttctttttcagttgctccgaggactcaaatatctccattcagcagaaatactccacagagacctaaaacctggaaacctgctggtgaatgcaaattgtgatctgaagatatgtgattttggtctcgcacgtacaaacagtagcaaaggccagttcatgactgaatacgtcgtcacccgctggtacagagctcctgagctgctcctctgctgcgacaactacggcacatccatagacgtctggtctgttgggtgcatctttgctgagctccttggccgcaagccaatatttccaggaactgaatgcctgaatcaactcaagctcatagtgaacgtcctcggcaccatgagtgaggctgacctagagttcatcgacaacccaaaggctcggagatacatcaagtcccttccctatacccctggtgttcctctcgtaagtatgtacccacatgcgcaccctcttgccattgatctgttgcagaagatgctcatcttcgaccccaccaaaaggatcagtgtcaccgaagctctcgagcacccttacatgtcccctctgtatgatccaagcgcaaatcccccagcccaagtgcccatcgatctggatatagacgaaaacatcagctcagagatgatccgggaaatgatgtggcaggagatgcttcactaccaccctgaagttgccacagcaataagcatgtcatgagagattccacagcccccaggacatcagcgggggctcacctcttctttttttgtctttgataaaagcctactgcgagtagccgattattgcggcacctagctgttatagtacacttaatgtctgcttggaaccaattatggcgcctagctgttgtagtacccttaatgtctgcttggacaaaaaaaaaaaaaaaaaaaaaaaa

SEQ ID NO: 879 - DNA, 2708 bp, Zea mays
  CDS (411)..(2174)
ccacgcgtccgcggacgcgtgggttttaacgccacctcgcgacgcggcccccaacccccaccgctgcggtgctactgctaccgtgctacaccatcaggaatcggacgcgggacgctacaccaccaccacagctccccacctccaccctcgccgcgagttgctcagtcgcagactcgcagcgagcgaggcgggggcctcactcagcgcggggcgaggcgagcgtcccgggtgggcagcgtcgcggtcgcgggctcgatcgggttgggacggggaggtagggaggaggggccagggatctccactctcgtccgtgcgggagcgcgggcgtcgcatgcggcggcgcgccggggcaaatgctggtagcctcacgggcggaggagcgctcacgctgaggcggcggccggggagcgatgcaggcgccggagcagcagccgcagcagcagcagcagcggaggaagggttcgtcagagatggacttcttcagtgaatacggcgatgcgaacagatacaaaatccaagaggtcattggcaaaggaagttatggcgttgtttgctcagctgttgaccaacatactggtgacaaggtggcaatcaagaaaatacacaatatctttgagcacttatctgatgctgcccggatcctacgtgagatcaaactgcttcggctattacgccatcctgatatagttgagatcaagcatataatgctgcctccatcaaggagggacttcaaagatatctatgttgtatttgagctgatggatacagacctccaccaagtcatcaaggcaaatgatgatttaacccgagagcatcatcaattctttctctatcagatgctccgtgcactgaaatacattcataccgctaatgtttatcatcgtgatttgaagccaaagaatatattggctaatgctaactgtaaacttaaaatatgtgattttggattggcaagagtggcattcaatgacactcctacaacagtattctggacggattatgttgctacaagatggtatagggcccctgaactgtgtgggtctttcttttccaagtattcgccagctattgacatatggagtatcggttgcatttttgcggagatcttaactgggaagcctttatttcctggaaaaaatgtggtccaccagttagatttgatgactgatctcttgggtactccatcacttgatacagtttccaggattcggaatgagaaggcaaggaggtacttgagtagcatgaggaaaaaacagccagtaccatttactgaaaagtttcctaaagcagatcctgctgcactcaaacttttgcagaggcttttggcatttgatcccaaggataggccaactgctgaagaggcattggctgatccgtattttaaaggcctcgcaaaagtagagagagaaccatcatgccagccaataacaaaaatggagttcgagtttgagcgaaaaaaggcgaccaaagaggatgtcaaggaacttatattcagggagatattggagtatcatcctcaacttctcaaggattacatgaatgggactgagaaaacaaactttctatatcctagtgctgttgaccatttcaggaggcaatttgcaaacttggaggaaaatggaggaaagagtggggcacacgccgcttcatcagacaggaagcatgtttcgctcccaaggacaaccacagttcattctaatccaatccctccaaatggaacctcccaggttcctcaaaagattcccacaggtagaccaggaagagtggttggtccagtaataccatttgagaacgcagctgcagttgatccatacagccaacgtagggtctcaaggaatccagtacttcctccaaccacgtcgaacatgtcagcctatgcctaccaccggaagtcagacaactcagacagagagctccaacaggagctggaaaaggaccgcatgcagtaccagccagcacagcggttcatggacgccaaggtagtatcacagatgtcccctgacttgaggtcttcctactacataccaaaaggtgtcccaaaggctgatcccgcagatagaaccgctctgcattctagcatgattcatgggatcgcccctttcagtggcattgcagctgttggaggtggctacaacaaggtcaatgcagttcagtatggagtttctaggatgtactagttctagttgcattggccatctccgaattcctcagctgatgagttgaagtaataacatggcgaagaccagatgtaggtaccgaagaactgccataccggctctgagccaaagatagaaaacatggaatacggatctcggatcgaggacgtgtccgtcagattgaaaacagatactgggcagcagtcatggttctgtccattggacctagcttttcgggaagcaatgccatcgccccgcggaaacggtaaaataaaaggagaaaaaaaaatgcagtactgtcagttgattgctgcttataaagaagcaaagggggcagagacgacgatttttacaggtaaaattatgtactttgcaaggagggaaacatgtgggaataagtagtgagcctacgtttagctctgtatataaagtgacttgattttatatgtactattacggctggtgaaacacgcttctttaattcaaagctatggagttttggcctaaataccataggcagctcagattgataaaaaaaaaaaaaaaaaaaag

SEQ ID NO: 880 - DNA, 2170 bp, Zea mays
  CDS (382)..(1854)
ccacgcgtccggagtagcccattttcctggaggcggcgacggcagcggcccagcccacctctgccgctgtgcttcgcgtgggccgtgcaactcgccggagacggaagcgacgtcggcgagaaccgcgctgccgttgccgtcgaggcgatatggccctaccctcgtcgacggagacacggagtccgcatccgcctccgcctccggggcgctcgtcgtggtcggcgccgcgtgatcccacgggggtctagaatccgggcctcgtcttcatcacccgccacccaccggcgtccgcaagatgcgcgagatggcaccgccgccacaagcctctcatccggattggattggttccggctgttgcttgctccaggaagaacactggacatggacttcttcacggaatatggggaggcgagtcagtatcaaatccaagaggtcattggtaagggaagttatggagtagttgctgctgcaattgatagtcacactggggagcgggttgcgatcaagaagataaatgatatttttggtaatgtctcggatgctgctcgcattttgcgggaaatcaagcttcttcgtctgcttcgtcacccaaacatagtccagattaagcacattatgttgccccctacccgaagggagttcaaagatatctatgttgtttttgagctcatggagtctgacctgcatcaagtgatcaaagcaaatgataacctgactccagagcatcaccgctttttcctgtatcaacttatttgtgctctcaagtacatgcattcagcccatgtatttcatcgtgatttaaagcccaggaacatactggccaattcagacagcaaactaaagatctgcgactttggacttgcacgtgcatcatttaacgactctctttcagctatctattggacagattatgtcgcaacaaggtggtaccgggctcctgaattatgtggctcctttttctccagttacacccctgcaattgatatttggagtatagggtgcatttttgctgaagttctcaccggaacaccattgtttcctgggaggaatgttgtgcaccaattagacttaataacagatctccttggaacaccatcgtttagatccttatcccagattcacagtgataaggccagggaatatttgcttggcatgccgaggaagcgccctattccattttctcataagttccataatgccgatcctctggctctacggttgctagagcgtttacttgcatttgacccgaaagatcgacctactgctgaagaggctttagctgatccatacttcagtggcctttctaaattggaacttgagccttcagcacaaccaatttcgaaggttgactttgaattcgagggaaggaaactaacaaaggctggtgtgagagaaatgatatatcgggagattttggagtaccacccccagatgcttcaggagtacatcgaaggtggagatcagattcacttcctatacccaagtggggtcgatcgcttccagcgacagtttgctcatctcgaggagaactacaggagaggagtagcaagcaccccgccgcgaaggcagcccacatctctgccgagagagcgagtctgctcatcagaagatggccacagtcaggactctgacagcgaagagcaaagagcagcatcctacgttgcccgaacaaccataagccctccaagatcacaagaggagggcggcaagctccagcctgcctaccagagcgccgccgccgccgcagactcctgcgccaagagctatctgaagggtgccgctagtatcagtagtgcttccaggcgtaccatcaagggggataatggccgaaaggagaaggaatctccgaggctgtgaaagaggtggcgcaggctcgtgacctgttaggcaaaagaggtagcaatggcgccaatgcgactgcaacgtgggatgtcttagtcatcatgcatccaacaacgcaggggggcagtacaagtatgcaggtcatcctagctaggtcgcccaaattaaagcagcctgcttggaggaattagatttgtgtactgttgttaagtttttttttttttgaattcaactgctagattctggcagatctgtcaaccgcactctccttggtttcccaaaatttactggtttgaacaagtttattaaaaaaaaaaaaaaaaaaaag

SEQ ID NO: 881 - DNA, 1555 bp, Zea mays
  CDS (217)..(1098)
ggggcggcgtggggcgaggagtggaggacaccgatccccgccggagagcgcgtccatcccaaatggcgactgcagcttcgcccgccgctgcctttccccacatcctctccctctcctcctaatcccctcccaatcccccccccccctctctctctcttcctcgccagctggttcgttccgcacccgccgccgcattgggtgccgaggagggacgcaatggagcagtacgagaaggtggagaagatcggggagggcacgtacggggtggtgtacaaggcgctggacaaggccaccaacgagacgatcgcgctcaagaagatccgcctcgagcaggaggacgagggcgtcccgtccaccgccatccgcgagatctctctcctcaaggagatgaaccacggcaacatcgtcaggttacatgatgttgtccacagcgagaagcggatatacctcgtcttcgagtacctggatctggacctcaagaagttcatggactcttgcccggagtttgctaagaatcccactttgattaagtcatacctctaccagatactccgtggcgttgcgtactgccattctcatagagttcttcaccgagatttgaaacctcagaacttgttgatagatcggcgtaataatgcactgaagcttgcagactttggtttagccagggcatttggaattcctgtccgtacatttactcatgaggtagtgacattatggtacagagctccagaaattcttcttggagcgagacagtattccacaccagttgacgtgtggtctgtgggctgtatctttgcggaaatggtgaaccaaaagccactattccctggtgattctgagatcgacgaactgttcaagatattcagggtgctaggtacaccgaatgaacaaagttggcctggagtcagttgtttgcctgacttcaagactgctttccccaggtggcaatctcaggacctggcaataatagtcccaaatcttgaacctgctggcttggaccttctctctaagatgcttcggtatgagccaagcaaaagaatcacagctaggcaagcacttgagcacgagtacttcaaggaccttgagatggtacagtgacctgctaaatgtgcttcgcgttgctttggcatttgtaattgtctgagctgagtcgctcattcctttttatgggcgtctgtactctctcattctctctgcatttttgtcgttcagctggatattttgaatctggtgtgttttgagatgtattaaggaatatcaaatagattaccgccttggtctctatttactgaaagtaaatatcctccatgtttatttcccccgaagcagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggcccgctttaagggaccaaattttacgtccccgggaatgcaaggtaatagttttttttttgggcccccaaatttaatttaatgggcggggttttaaaaacgggggga

SEQ ID NO: 882 - DNA, 1721 bp, Glycine max
  CDS (175)..(1293)
cactttgtcctccaaactcaagtgtcggaaagtttgcttcttttccactctgaatcaccctatttattttgggtctctcatctttcttcttccttccaagttgtttttggtgttggtgttggtgttgaattgagttgagaagaaaagaagaggtcatagacacacacacaagacatgtctgctgttgagtcagctgaacacaacaacatcagaggagtaccaactcatggtggacgctatgttcagtacaatatctatggcaatctcttcgaagtttccagaaagtatgtccctcctattcgccctgtcggtagaggtgcttatggtattgtttgcgctgctgtaaatgcagagacaggcgaggaagttgccattaagaagattggcaatgcattcgacaacagaatagatgccaaaaggaccttacgggaaattaaacttcttcggcacatggatcatgcaaatattatgtccattaaagatattatacgtcctccacagaaggaaaacttcaatgatgtgtaccttgtttctgagttaatggacacagatctgcatcaaataattcgttccaatcagcaattgactgatgatcattgtcggtattttctgtatcaattgttacgagggctcaaatatgtacattcagcaaatgttttgcaccgagatctaaagcctagtaatttgctattgaatgccaattgtgaccttaagattgcggactttggtcttgctagaaccacatctgaaactgactttatgactgagtatgtggtcactagatggtaccgagctcccgaattgcttcttaattgttcagaatatacagcagccattgatatatggtctgttggttgcatacttggtgaaatcataacaagacaaccgctctttcctggcaaagattatgttcatcagctgagacttatcacagagctgataggttcgccggatgatgccagccttggatttctacgaagtgataatgctcgtagatacgtaaaacagcttccgcagtatccaaaacaaaacttttctgctagatttcccaccatgtctcctggtgcggttgacttgctagagaagatgctcatctttgatccaaacaggcgtattacagttgacgaggcgttgagccacccatacatgtcacctctccatgacatcaatgaggaacctgtttgcaccagacctttcagttttgactttgagcaaccatcattcactgaagaagacatcaaggaactcatctggagagaatctgtgaagttcaatcctgcaaccatatatgtttagtgaaatatctgatgactaatatatacattttatgaccactacttggcaagttgcagcgcacagaagatatgaaaacgtattggagatactgagattcactgagtttgttgaaggtttctttcgttttagtctcatctcagatacttggataatcatattgttgagatgtactgaggaaagaaaggatcaaaatatgtttcagcagaatatcctaaagctccaactccttgttgtacttctatccttctttttagattcaaggtccatagtttagtgcattgaactgttcttgccagtttttcctatcctttacatcaagaaaaattcacaagaaaacttttaatttgtggggacagacagtatctcatattcccattgtatgacatttaaattaaattaaatgtaatggtttgttagagtaaaaa

SEQ ID NO: 883 - DNA, 1929 bp, Glycine max
  CDS (334)..(1446)
tgatgatgcaagaaagaaacaaagagaagggaaatatcaggagctagtgctaggtgcgagtactggagcaaaacgcgggtgtgtgtgactttcgttggagagagatgcagttccattcagaaactccaaacaaacatccctcgcgacaaccttaggaatctcgatcgccgaaaaaacctatgcagccccgaacacacacactctgcattccaacttgtttaaatcatgcctctcgattcacccttctctctcaataaatcttttggcctatgaaatcagattcttcgccaccgccacagtcataataaagttttatttttccaaataaagggaatggcgactcctgttgagcctcctaacgggatcagaactgaagggaagcattattattccatgtggcaaaccctgtttgagtttgattcaaaatacgtgcccatcaagccaattggccgcggagcatatgggattgtgtgctcttctgtgaatagagagacaaatgagaaggttgccatcaagaagatacagaatgcctttgaaaaccgggttgatgcactgaggactttgcgcgaactcaagcttcttcgccaccttcaccatgagaatgtgattgctttgaaggatatcatgatgcctgttcataggaatagtttcaaggatgtctatctagtttatgaactcatggacacggatttgcatcagattattaagtcttctcaagctttgtctaatgatcactgccagtatttcctctttcagttgctccgtggcttgaaatatcttcactcagctaacatccttcatcgtgacttgaaacctgggaatcttctaattaatgcaaattgtgacctaaaaatatgcgattttgggttagcacgtactaactgcagcaagaaccagttcatgaccgagtatgttgtcactcggtggtatagggcaccagagctcctactctgctgtgacaactatgggacatctattgatgtttggtcagttggatgcatctttgcagagcttcttggccgaaaaccgattttccctggttcagagtgtctcaaccagctgaagttgattatcaatatccttggtagtcagagggaggaggatattgaattcattgataatccaaaggcaaagaagtatatcaaatcacttccttattctcctggaagccccttttcgcgactttatcctaatgcgcatccattagcaattgatcttcttgcaaagatgcttgtttttgatccaaccaagaggattagtgtcactgaagcacttcaacacccttacatggcccctctgtatgatcctaactgtgaccctccagctgtcattccaattgatcttgacattgatgaggatctaggggaagagatgataagggagatgatgtggaaagaaatgcttcattaccatcccgaatctgcgatggagaatgcagggttgtgctaatgatatttacttcttttcacggttatgttcccttttgttggtgccaggatagttctaatatcataacttgcttcaaataattaggagggctttgtcatcagtgagctcattatatgttcctgttttctatttattgaaagcagagagaaacagcaaaatattatcttaaaaaaaattgtgttattgctgatgatgcattatagtctttaactgccatgttgagagattgattttttactgaactctgtattgtagttgcctcgttttgctgtacataaacatgttcctgtgtctttcataaaccattttgtaaattaagtctaatgtttatcaatagtgtgttaatgtttgaactttgaagttattttattttatttttttcctgcaagcggaacataaaaaaaaaaaaaaaaaaaaaaaaaaaaaaaaaaaaaaaaaaaaaaaaaaaaaaaaaaaaaaaaaaaaaaaaaaaaagggggg

SEQ ID NO: 884 - DNA, 1754 bp, Zea mays
  CDS (141)..(350), (440)..(1315)
gaattcccgggtcgacccacgcgtccggtctctactcctcttcctcctctctctactctccaagttctcttctccgtcgaccgctctacacgtctcttgtcgacctggacaccgaggtggaagaaggaagcagtcagcagatggatccatggatcagcagccagccttctctgagccttgacctgcgcgtcggcctgccgccgctcagcctccaccaccaggcgccggtggccgtcgccttgcccaggcccaagctgctcgtcgaggagaacttcctcctgccgcctccaaagaaagaaccagaggtacgcatatatacactacactccgatcctatgtgcgacgcaagcatgcacccaccccacctggactggacggagacggcgggcgtgacgacgagcaaagactctaacggactgtccccttgatttgatcccaggtcgcggctctcgagacggagctgcagcggatgggcgaggagaaccggcgcctggcggaggcgctggccgaggtggcctccaagtacgaggcgctgcgggggcagtacacggagatggtggccgcggcggccacggcctgcgggaaccacccgtcgtccacgtcggagggcgggtccgtgtcgccgtcgcggaagcgcaagagcgagagcacggacaccgcgccgcccgcgcagcagctactgcaccagcactacccggcggtggcgccggaccagacggagtgcacctcgggcgagccgtgcaagcgcatccgggaggcggagtgcaagcccagggtgtcgaagctgcacgtgcacgccgacccggccgacctcagcctggtggtcaaggacgggtaccagtggcgcaagtacgggcagaaggttaccaaggacaacccctgcccgcgggcctacttccgctgctccttcgccccggcctgcccagtcaagaagaaggtgcagcgcagcgccgacgaccccaccatcctggtcgccacgtacgagggcgaccacaaccacggccagcccccgccacaggcgcaggcgccgcacgacggctccagccctggcgccagcaagaagccgccgtcgccgccgaggccggtcgccgccgctccggcgccgctccaccaccagcaggtccagcagcaccagcagcagcaggcggttggcgcggtgaaatgcgagccgcccgtggccgcggcggcgtcggagctcatccggcggaacctcgcggagcagatggccatgacgctgacgcgggaccccagcttcaaggcggcgttcgtcaccgcgctgtccggccggctcttcgagatgtcgccgaccaaggactgacggaacggatcggatggattgggagattggcatcgcaggagattctggatcagattgtcttcgagcgcacgccgcaatggtcaactgcgcagcgctggcttggctgtcagagcgaaacagcggtaacagagcaagacacgaggggtctgcactctgcagttgtgcaggaggaggaacagacacaaggggaggacggcgcgcggccggacatggcgtggaacagagatcgtcgtcaccgccggcgggggtgtggtcgacgacgcgacatgcgaaacactacgtgctagctagcataggaaaaaacaacatgaaatcgtacaaccaaccaatccctcgcactgttttagttgttagctgtaggcgaaactgttcatccaattgatcaaatgaaacttattttttccctaaaaaaaaaaaaaaaaaaaagggcggccgc

SEQ ID NO: 885 - DNA, 1561 bp, Glycine max
  CDS (114)..(1046)
gaattcccgggtcgacccacgcgtccgcaattgcaacatactaagtgggttggctggtttagatctgagcaacagcttttaattttctacttgcttgaattttattggaagccatggattgttcatcatggattaacacttccttggatctcaacattaatccccgcagagttcatgaagaagttcccaaggaggtagaaagcgagcttttctctttgggaatgaccaagtttaacgtggaagaagagtctactagtgacttggaggaggaactgaagcgggtgactgcagaaaacaagaagttggccgaaatgctctcagtggtgtgtgagaactacaacactttgagaaaccatttgatggaatgcatgaggaaaaatggtgaaaaggaggtcagcccaacatcaaagaaaagaaagtctgaaagcagcaacaacaatagtaatttgatgggaactaacaatggaaactcagagagcagttctactgatgaagaatcttgcaagaaaccaagggaagaaatcatcaaagcaaaaatttcaagagtttatgtcaggactgaagcatctgatactagccttattgttaaagatggataccaatggaggaaatatgggcaaaaggtgaccagagataacccttgtcctagagcatatttcaagtgctcttttgctcctagctgccctgtcaaaaagaaggtgcaaagaagtgtggatgatcaatctgttctggttgctacttatgaaggggagcacaatcatcctcagttttcttcccagatggaagcaacatcaggttctggccgtagtgtgacccttggttcagtgccctgtaccgcatctctcagcacttcaacaccaacacttgttacccttgacttgacaaaatctcagggaagcaacgattccaagagcacaaagcctaaaggagattcacctaaagtacctcaggttttggtggaacagatggctacttctttgaccacggatcctaattttagagcagcacttgttgctgccatctcaggaagattgttgcacaataattaaatggaattttggtgaagtgttgctaatttagtgtcaattgtttaagtattccataaaatagagatcattctttagagcaaggggtctctctatgtaaatacaacatggaaggctgggacatatttgatcctttaaagtggaaataaagttccactaaggatgacatgttgagctgattaaacaacagaaaatcaagctctgcaccaccctctgcctcatcatgatggtaaagatttagcaagtcttttttggctaatatatctaggatacctcaaattaaatttcatagtaggttgtagcacacattctcggaaagatctttcataaagtgcatctctacggcaatttaatttctcccttttcttctctcactactctctctggcaagccaactctatatctagtcctagttttagaatttcatttcagaaattatattatacattgatcaagtattataagtgatggaatgtaactcaaaacatggaaaaaaaaaaaaaaagggcggccgc

SEQ ID NO: 886 - DNA, 1719 bp, Saccharomyces cerevisiae
  CDS (1)..(1716)
atgctatcaaaatcagaaaaaaatgtcgactacatggcaggcaatatgagcaatttgagtttcgatgggcatgggactcctgggggcactggactatttcctaaccaaaatataacaaagaggaggacaaggcctgcgggtatcaatgattcaccttcgccggtaaaaccatccttttttccttacgaagatacttccaacatggacatagacgaagtatctcaacctgatatggatgtctcgaactctcccaagaagcttccaccaaagttttacgaaagagcaacttcaaataaaacacagagagttgttagtgtttgcaaaatgtactttctagaatattactgtgatatgtttgactatgtaattagtagaagacaacgcacgaagcaagttctagaatatctgcaacagcaaagccaacttccgaattctgaccagattaaactcaacgaagagtggtcctcttacttacaaagggaacatcaggttttgagaaaaagaaggttgaaaccaaaaaatagggattttgaaatgatcacacaagtaggtcaaggtggttatgggcaagtttatttagccagaaagaaagacacaaaagaggtgtgcgctttgaaaattttaaacaaaaaactattgtttaagctcaacgagacaaaacacgttttaactgaaagagatatcctaaccacgacaaggtctgaatggttagtaaaacttctgtatgcattccaagaactacaaagtttatacctggctatggaatttgtaccaggcggtgattttcgtacattattaataaatactagatgcttgaaaagtggccatgcgagattttacatcagtgaaatgttttgcgctgttaatgcgttacatgatttaggctatacacatagagatttaaagccggaaaacttcttaatcgatgccaagggacatataaaattaacagattttggtttggctgctggtacgatttctaatgaaagaattgaaagtatgaagataaggttagaaaaaatcaaggacctggaatttccagcgtttacagagaaatctatagaagatagaagaaaaatgtacaaccagttgagggagaaggaaattaattatgcgaactccatggttgggtctccggattatatggctttggaggttttagaaggaaagaaatatgactttactgtggattactggtcgttgggttgtatgctgttcgaaagtttagttggttatacaccatttagtggatcatcgactaatgagacctatgacaacttaaggcgctggaaacaaactttaagaagaccgagacaatctgatgggagggcagcattctccgatagaacttgggatttaataacaagattgattgccgatccaatcaatcgattaagatccttcgaacatgttaaacgcatgtcttattttgcagatataaactttagtactttgaggtcaatgatcccgccttttacaccccaactagacagcgaaactgatgccggttattttgatgacttcaccagtgaggctgacatggccaaatatgccgatgttttcaaaagacaagacaaattaacggctatggtagatgactcggcagtatcatcaaaacttgttgggttcactttccgacatagaaatggtaaacagggttccagtggcatcttattcaacgggctggaacactcagaccccttctcaaccttttactag

SEQ ID NO: 887 - DNA, 1695 bp, Saccharomyces cerevisiae
  CDS (1)..(1692)
atgttttcacgaagtgatcgagaggtagatgatttggctggtaatatgagtcatttagggttctatgatttgaatattcctaaacctacttctccacaggcgcaatataggcctgctagaaagagcgaaaatggaagattaactcccggacttccaagatcatataagccgtgtgattcagatgatcaagataccttcaaaaatcgcatttcattgaatcactcaccgaagaagctacccaaggattttcacgagcgtgcttcccaaagtaaaacccagagagttgttaatgtatgccaactttactttctcgactattactgtgacatgtttgattatgttattagcagaagacaacgtacgaagcaggtgctaagatatcttgaacagcaaagaagtgtcaaaaacgtttctaataaggttttaaatgaagaatgggctttgtatttgcaaagagaacacgaagtactgagaaaaaggaggttgaaacctaagcacaaggattttcagatactgacacaagttggacagggtggttatgggcaagtttatcttgcaaaaaaaaaagacagtgatgaaatttgtgctttgaaaatattaaacaagaaacttttattcaaactaaacgagacgaatcacgtccttactgagagggacatactaaccacaactagatctgactggcttgtgaagttgctttatgcatttcaggatccagagagcctatatttagcaatggaatttgtacctggtggtgattttcgcacattgttaataaatacaaggatattgaagagcggtcacgcaaggttctatatcagcgaaatgttttgtgccgtgaacgcgttgcatgaacttggttacactcaccgggatttaaagccggagaatttcttgattgatgctacagggcatatcaagctgaccgattttggtctagcagcagggaccgtatcaaatgaaagaatcgaaagcatgaaaatacgcttagaagaagtaaagaatttgcaatttcctgctttcacagaaaggtctatcgaggatagaagcaaaatatatcataacatgaggaagacagaaattaattacgctaactctatggtcggttcgcctgattatatggccctagaagttctggaaggtaaaaaatacgattttacagtggattattggtcattaggctgtatgctttttgaaagtttggttggatatacaccttttagtggttcttctactaatgaaacttacgagaatttaagatattggaaaaaaactttaagaaggccccgtactgaggatagaagagcagcattctcagatagaacctgggatttaattacaagactaatagctgaccccatcaacagagtacgatcttttgagcaagttcgcaaaatgtcttatttcgcagagatcaattttgaaaccctaagaacaagttctccaccatttattcctcaattagatgatgaaacggatgcaggttatttcgatgacttcacaaatgaagaagatatggctaaatatgcagatgtcttcaaaagacagaacaaattatctgcaatggtcgatgactctgccgttgattccaagcttgttggatttacttttaggcatagagatggaaaacaaggttcaagcgggatactttacaatggttcagaacattcagaccctttttcaactttttattaa

SEQ ID NO: 888 - DNA, 1001 bp, Saccharomyces cerevisiae
  CDS (16)..(675)
gaacaagcaaaaaacatgaaccaagcaatagacttcgcacaagcaagcattgactcctacaagaagcacggcattctggaggatgtaattcatgacacaagctttcaaccctccgggatacttgccgtagagtactcatcaagtgcacctgttgccatgggtaacacgctgcccactgagaaggcacgttccaagccccaattccagttcacgttcaataagcaaatgcaaaaaagcgtaccacaggcgaatgcgtacgttccccaagacgacgatttgttcacactggtaatgaccgatccggatgctccctctaagacagatcacaagtggtctgaattctgccacttggtagaatgcgacttaaagctgttgaatgaggctactcacgagacctccggagcaaccgaattttttgcatcagagttcaatacgaagggctcgaacacactaatagaatatatgggaccagctccacccaagggatccggtccccacagatatgttttcttgttatataagcagcctaagggcgtggactcatctaagttctcgaaaattaaggatagaccgaactggggttacggcacccctgccaccggtgttggcaaatgggctaaggaaaacaacctgcaactagttgcctccaatttcttctatgcggaaacgaaataggtatatatatatatatatgtatatgtatttattttttagatttcagtgcttttcacttgactttttattatttttgttttatttatgtttttgtcacaaacgcgcacatgtttgtagggagtaatgtcattgtcaaacaaaacacataagaaaaacatggtgagattattaaaaaagtgtataagtttataaaatgtttataatgattatataagtttgggttagccgaacaaaaccttcaccaattccatataaacaccgatctggaagtcgtccagtttcaagcgattcagttcaggggccacgacaattccagtgttgtccat

SEQ ID NO: 889 - DNA, 1001 bp, Saccharomyces cerevisiae
  CDS (124)..(729)
tgctcattattggaagtgcgcaccaggtgaggaattgaatgttgccatcaattgtttgagtaaacactgcccatctgccactttcggtacccatccgagtacttagtaatagaaatatatattatgtctagtgccatcgttgctaaactgaacaaagaggacatcattaaggacaccgtcaaggacttggcgttcgagattcttggtgagttgtcggtttcgtacgttgattctgacgacatcaaattgggcaatcccatgccaatggaagctacgcaagccgctcctaccatcaagttcacgcccttcgataaaagccaattgtcagccgaggataaactcgctttgttgatgactgacccggacgcgccctctagaacagaacataagtggtcggaggtttgtcactacatcatcactgatattcctgtcgagtacggacctgggggagatattgccatttcggggaagggtgtcgtgagaaataactatattgggcctggtccaccaaagaactccggttatcacagatacgtgttcttcctgtgcaagcaacccaagggagcggattcgtccacttttaccaaggttgagaacattatctcctgggggtacggtactcctggtgcgggtgcctatgactatatcaaggagaacaatctgcaactggtcggtgccaattattacatggtcgaaaacacgaccgttgatttcaactatgacatgtaaggtgcagcaaccggctcgtatagatacggataagatagagtatattgtgcaaacgcgtatatgaaatagtgaatatatacatgccgaacggttccgttttttttttttttggctcgttgatttttcctatccctttgaacttttctatcttttaagggatagaggggctgttcagggaaggaaagatctcaattggtatataaaaagggggcagcaagaaacgaattgcagtgctccttttccctaccagtgcatcaatacaagaacaagag

SEQ ID NO: 890 - DNA, 1081 bp, Oryza sativa
  CDS (93)..(458)
caccgatcgatcccggccattccacggtcgatcgatcgtctccggccggccggtcgccggtgggaattgaagcagctagctgacatacatacatggcgggcgtgtgggtgttcaaggacggcatcgtgcggcgcgtggagaaccccggcagcgaggaatcgtcgtcggcgggggacggcggcggaggcgggcggcggaaggtgctggtgcacgtgccgagcggggaggtggtggcgtcatacgaggtgctggagcggcggctgcgggagctcgggtgggagaggtacctcaccgacccgtgcctcctgcagttccaccagcgctccaccgtgcacctcatctctgtcccccgcgacttctccaagttcaagctcgtccacatgtacgacatcgtcgtcaagacccgcaacgtcttcgaggtccgcgacgccgctgcccccgccgtctcaccggcgacctagctgctgatccgagatccatccatccatcgatcagacgacagcttatagctacagcagtccacatgagcttgcctgcctgctattataagagtgtaagtatgtatatatatactggtatgcgtgtgatcgatcaaggatcgatgtacacacaaatgatcagcatgcacagatcactagatcgagatctatagctcgatcgatttggggtttctcctgccggcgttgcagcttttggattagatgttgcgccggtgaggacattgctataggttaattggcttttgggtatatttctgcataaataatgcatcaatagagagcacaacatgtgtatgcatacttatatttatatgtacacatgcatacatatataagtacatacataggggccgggggcaacatgcaggttgcagagattctgccagagatcaagcagaaaggggatcgccgatgccctactctcaaccgtacctttttactgtttaatttggaataatttggattgtctcaatacaaattatgtaccagttttttcacatatgatttgcacgacattttaaatattgtaatctgtacacataatattgatcggtctctctttccctgtggccaaaaaaaaa

SEQ ID NO: 891 - DNA, 826 bp, Oryza sativa
  CDS (60)..(413)
agcttctagctgtgatcaagcaaagaagaattgaaaaaaaacatatatatattatatatatggcaggggtgtgggtgtttgaggatgggatggtgaggagggcagatagcgaggcgccgtcgagagggcgcggtgtcggtggtggaggtgggggagggaaggtgcttgtgcacgtgccgagcagcgaggtggtgacgagctacgaggttctggagaggcggctgcgggagctcgggtgggagaggtacctcaacgacccgtgcctcctccagttccaccagcgctccaccgtccacctcatctccgtgccccgcgacttctcccgcctcaagctcgtccacatgtacgacgtcgtcgtcaagacccgcaacgtcttcgaggtccgtgacgccgccaccactgcttccccgccatgatcgcatcgatgtctatgctttgatcatcatcgatatgaccttcctcgactccgggctcaggccagacacgccgccatggcgcctacaatcgtatgtgtgtattgtatgaatctcaattcaggtaatgaatgattgtatatcatatgatttgtaattctgtacaggtataacgtatgcgtatatacgtacgtgtgcgatcgatcgggtgtgtgtgatatatattaaaataagcgtggctggtttaattgcaagtgagtgtttagttatttaattatacgagagccatgagcacgtgtgtagctagctttggagtcttgtactttgtggtttggagccattgcttgactgattccgtggcacgaatcaaaaaaaaaaaaaaaaaaaaaaaaaaaaaaaaaaaaaaaaaaaaa

SEQ ID NO: 892 - DNA, 766 bp, Zea mays
  CDS (132)..(473)
ctcgagccgattcggctcgagatcgatccccacagagccagggcgtgcaggcgggcgggcgggcgagcgagcgagaggaaaagccaaggcggcagcagtaggcagccaccatcaataaagaaggtccaagcatgtcgggggtgtgggtgttccggaacggcgtggtgaggctggtggagaacccgacgtcggggaacgcggcggcggcgccgggcaagcgcaaggcgctgctgcacacgccgtccggggaggtggtcacgtcctacgcctcgctggagcgcaagctggcggcgctcggctgggagcgctactacgccggcggcggagacggcggcggcgccggcctgctgcagtaccacaagcgcacctccgtcgacctcatctcgctgcccaaggacttcgcccacttcggctccgtccacatgtacgacatcgtcatcaagaaccgcgacgccttccgcgtcatcgacgcctaattataagctagcggatgcagcagatgacagatactcacctctcctcgctcgctcctcgctccggccagtgcatcatctacctcgctgtagctacctacctaccctaatataatagcagctatagccttcgtcacccattgctcgatcgatttagttgccgtgtcgatctcagtgccgcgttggtctaaattaatatatatagatcatgtactgatgatttggtttgttcatgcatgttttctctattttacatcttgtgttgctgggtcaaaaaaaaaaaaaaaaaaaaa

SEQ ID NO: 893 - DNA, 540 bp, Zea mays
  CDS (31)..(345)
cagaccgccgatatataggatcatcgatcaatgtctgggtcgggcgccggcgtttgggtgttcaagaacggcgtgatgcagctggagcagccggcggcggcgagccggaaggcgctggtgtacgtgccgacgaacgaggtggtgcggtcggtggaggcgctggagcggcggctggggacgctggggtgggagcgctactacgagaaccgaagcatcgtgcagctccacaagcgcgacggcggcgccgacctcatcaccatcccgcgcgacttcgccaacctccgctccacccacatgtacgacgtcgtcgtcaagaaccgcgaccacttcaaggtcgtcgacgcctaataagctctaccagctagcagctagctgcacccatccatcgtccacgatcgatcttcttatctcgccaattcggcatgcatgcgttgcgtgtgccagcagtgtacagctgctgatcgatatgcctgcagcagttatatagcaagtctagctatatatactgaatatatacgaacaaacatatgcatataaaaa

SEQ ID NO: 894 - DNA, 1218 bp, Zea mays
  CDS (210)..(905)
cggctcgagccgtccccgttttccacttttgcctccgccccaattcggataacaaacccctccgcctcgtcgcgtctcctcccagccgagccgatccggtagagagagggagagggagggactgagggaggaggagctgggttccggtcccggccgcccggccggctgcgcgattcgattgcagctctcgtccccgggcggcgtccaggatggtgcggggcaagacgcagatgaagcggatagagaacccgaccagccgccaggtcaccttctccaagcgccgcaacggcctgctcaagaaggcgttcgagctctccgtcctctgcgacgccgaggtcgccctcgtcgtcttctccccgcgcggcaagctctacgaattcgccagcggaagtgcgcagaaaacgattgaacgttatagaacatacacaaaggataatgtcagcaacaagacagtgcagcaggatattgagcgagtaaaagctgatgcggatggcctgtcaaagagactcgaagcacttgaagcttacaaaaggaaacttttgggtgagaggttggaagactgctccattgaagagctgcacagtttggaagtcaagcttgagaagagcctgcattgcatcaggggaagaaagactgagctgctggaggagcaagtccgtaagctgaagcagaaggagatgagtctgcgcaagagcaacgaagatttgcgtgaaaagtgcaagaagcagccgcctgtgccgatggcttcggcgccgcctcgtgcgccggcagtcgacaacgtggaggacggtcaccgggagccgaaggacgacgggatggacgtggagacggagctgtacataggattgcccggcagagactaccgctcaagcaaagacaaggctgcagtggcggtcaggtcaggctagcagctacctcagccacgcacaggcccaatcaacgcaagctagctagctgagaataatcttttagatctctggtagtgtggagatcgagatgcaagccaagcaatgtgatatcgcgttgtgtgttaccaacctgtcagtctgtgtatcatcccgtcccgtccgtcagagtctcagagaacgaacacttcttctccctgtagctagctgctcctgcttgtgtccagatcttctgttcgatcgggtttgggactaaaaaaaaaaaaaaaaaaaaaaaaaaaaaaaaaaaaaaaaaaaaaaaaaaaaaaaaaaa

SEQ ID NO: 895 - DNA, 1221 bp, Zea mays
  CDS (305)..(976)
ccacgcgtccgcgtcctcctccggtcacgcacgcagctagcttacccgccccgccactataaaaatccacctccaccccaccgcgcgtctacagttccacacacgcgtgcacgggcgggcaagcaccagaaaggaaaggcggaggccgcgcggcgggcgccagctgcagccaagagcccactagtagtagtagtagctagttcaccaccgcctgcttgcctcctttactttgccatatttgctagcgtttcctggattggggacgcttccgtttcgggaagccgtgaagggatcggccacgacgatggtgcgggggaagacggagctgaagcggatagagaacgcgacgagccggcaggtgaccttctcgaagcgccgcaacgggctgctcaagaaggccttcgagctctccgtgctctgcgatgctgaggtcgggctcgtcgtcttctccccgcgcggcaagctctacgagttcgccagcgccgccagcctccagaaaacaattgaccgctacaggacatacacaagggaaaatgtcaataacaagactgttcaacaagatatacagcaagtcaaagcagatgccgtaagcttggcaagtagactcgaagccctagaaaagaccaaacgaatgtttctgggtgaaaatttagaagaatgctccattgaagaactgcataatctggaggttaaactggcgaagagccttcacgtcatcagagggaagaagacacaactgctggagcagcagatatccaagctgaaggagaaggagaggaccctgctccaagacaacaaagagttgcgggataagcagcgcaacctccagtctccaccggaggcgccaccggacctgaaccgctgtgtccctccttggccgcgtagcctgccggcaccgagcaatgacatggacgtggagacggagctgtacataggattacccggcagggagcgctcctccaaccgggactctgattgaaccacggattttcagttcgatcggctaaaaggaataagctccctgaaattaaagcatcgaagggcacacgtcaatggttttatttgcaacttttgtatgcaaacttgtacttgaaaagtaaaaaaaataaaaataaatctgtagtatgtggatgcaagaaacggctggttagctagctgcaagccttctggggcctgaaaatgaaatccacccatggatacacccaaaaaaaaaaaaaaaag

SEQ ID NO: 896 - DNA, 883 bp, Arabidopsis thaliana
  CDS (31)..(618)
gggcataacccttatcggagatttgaagccatgggaagaagaaaaatcgagatcaagcgaatcgagaacaaaagcagtcgacaagtcactttctccaaacgacgcaatggtctcatcgacaaagctcgacaactttcgattctctgtgaatcctccgtcgctgttgtcgtcgtatctgcctccggaaaactctatgactcttcctccggtgacgacatttccaagatcattgatcgttatgaaatacaacatgctgatgaacttagagccttagatcttgaagaaaaaattcagaattatcttccacacaaggagttactagaaacagtccaaagcaagcttgaagaaccaaatgtcgataatgtaagtgtagattctctaatttctctggaggaacaacttgagactgctctgtccgtaagtagagctaggaaggcagaactgatgatggagtatatcgagtcccttaaagaaaaggagaaattgctgagagaagagaaccaggttctggctagccagatgggaaagaatacgttgctggcaacagatgatgagagaggaatgtttccgggaagtagctccggcaacaaaataccggagactctcccgctgctcaattagccaccatcatcaacggctgagttttcaccttaaactcaaagcctgattcataattaagagaataaatttgtatattataaaaagctgtgtaatctcaaaccttttatcttcctctagtgtggaatttaaggtcaaaaagaaaacgagaaagtatggatcagtgttgtacctccttcggagacaagatcagagtttgtgtgtttgtgtctgaatgtacggattggatttttaaagttgtgctttctttcttcaaaaaaaaaaa

SEQ ID NO: 897 - DNA, 1038 bp, Arabidopsis thaliana
  CDS (50)..(733)
ccctaaaaaagagaagaaccagaggagattcaattagaggataaaattgatgggaagagggaagattgtgatccaaaggatcgatgattcaacgagtagacaagtcactttctccaaacgaagaaagggccttatcaagaaagccaaagagctagctattctctgtgatgccgaggtcggtctcatcatcttctctagcaccggaaagctctatgactttgcaagctccagcatgaagtcggttattgatagatacaacaagagcaagatcgagcaacaacaactattgaaccccgcatcagaagtcaagttttggcagagagaagctgctgttctaagacaagaactgcatgctttgcaagaaaatcatcggcaaatgatgggagaacagctaaatggtttaagtgttaacgagctaaacagtcttgagaatcaaattgagataagtttgcgtggaattcgtatgagaaaggaacaactgttgactcaagaaatccaagaactaagccaaaagaggaatcttattcatcaggaaaacctcgatttatctaggaaagtacaacggattcatcaagaaaatgtggagctctacaagaaggcttatatggcaaacacaaacgggtttacacaccgtgaagtagctgttgcggatgatgaatcacacactcagattcggctgcaactaagccagcctgaacattccgattatgacactccaccaagagcaaacgaataacagagagattgaagttggaagataccatgatgttgaagaacactccaaaggccttggtttgaataaggttcttgaactggaaacctctatacaccaagccacgtacgataagcagcatggttcttctaacatagtcatattttcaatcctaaatataattaaagcatatataattaaaatccggtgttgttatactcatcttgagtattaatattgtacttgtttataaccatagattcgtcaattaatagagaaaaatcatatgaattattatccaaaaaaaaaaaaaaaaaaaaaaaaaa

SEQ ID NO: 898 - DNA, 525 bp, Arabidopsis thaliana
  CDS (1)..(522)
atggagggtaagagatcacaaggacaaggttacatgaaaaagaagtcttaccttgtggaagaagatatggagactgatacggatgaagaagaggaagtaggtagggatagagttagagggtctagaggtagcatcaatcgtggtggctcgttgcggctttgccaagtagatagatgcacagctgatatgaaagaggcaaaactgtatcaccggagacacaaagtgtgtgaagttcatgcaaaggcatcttctgtctttctctcaggacttaaccaacgcttttgtcaacaatgcagtaggtttcatgacctccaagagtttgatgaagctaagagaagttgcaggaggcgcttagctggacacaatgagcgaagaaggaagagctctggtgagagtacttatggagaaggatcaggtcggagaggaatcaatggtcaggtggtgatgcagaatcaagaaagatcaagggtagagatgacacttcctatgccaaactcatcattcaagcgaccacagattagatag

SEQ ID NO: 899 - DNA, 1128 bp, Zea mays
  CDS (317)..(835)
cgccccgcgcgccggccggccggtcgattcccccactccactcgccgcccgcggctgggctgcgctgcgcatcgacgacggacgacgacacaatcacccccaccccccgtccaatcagcagcggacgagggacgaccacggccccccgtctgccgcacgcgcgcccgctctgccagctgctgctactactgctaaacctcgcccaccagtcgcgtgaggaaatagcaacctgctgagctcgctcgttcgctcgctcgcctgccttcttccctgggcaagctagctagctaggatcgaggaggagctctgcccggccatgcagcgtggggatccgctggtggtgggccgcatcatcggcgacgtggtggaccccttcgtgcgccgggttccgctccgcgtcgcctacgccgcgcgcgaggtctccaacggctgcgagctcaggccctccgccatcgccgaccagccgcgcgtcgaggtcggcggacccgacatgcgcaccttctacaccctcgtgatggtagatcctgatgcgccgagccccagcgatcccaacctcagggagtacctgcactggctggtcactgatattccggcgacgactggagtatcttttgggaccgaggtcgtgtgctacgagagcccacggccggtgctggggatccaccgggtcgtgtttctgctcttccagcagctcggccggcagacggtgtacgccccggggtggcggcagaacttcagcacccgcgacttcgccgagctctacaacctcggcttgccggtcgccgccgtctacttcaactgccagagggagtccggaaccggtgggagaagaatgtgatctcgacccggccgggtggaaattaataagatgacgggtaatcgggtatatgtatatatttatatatatatgtatatgtacgtgtatttgatctggtggcctttggttatatttgggtggggtgtatttgatatattatctgtggcagattggcgcattctctggcgcatatttgatagctacatgtatctatttatacagatataaagcgagcaataatatgcatatgagagggttcagccacatcagtcattactctctccttttaaaaaaaaaaaaaaaaaaaaaaa

SEQ ID NO: 900 - DNA, 844 bp, Zea mays
  CDS (65)..(595)
ctcatatcctaaccaggctcactaatccttaccaatcctttcacccaaatcatacataagatagatgttcaatatgtctagggacccattggtcgtcggcaatgttgtgggagatattgtggatcccttcatcacaactgcgtcactgagagtgttctacaacaataaggagatgacaaatggttctgagcttaagccatctcaagtgatgaatgagccaagggtccacgtcggtgggcgtgacatgaggactctttacacacttgtcatggtggacccagatgcaccaagccccagtaaccctacaaaaagagagaaccttcactggttggtgacagacattccagagacaactgatgccagtttcgggaacgaaatagttccgtacgagagcccacgtccaatcgccggaatccatcgcttcgcattcgtcctgttcaggcagtcagtgaggcagaccacctatgcgccggggtggagatcaaacttcaacactagagacttcgcagccatctacggccttggctcccctgtcgctgcagtgtacttcaactgccagagagagaacggatgtggtggaagaaggtacataaggtgatatatcaaccaagctatgtgtgcttctctctctctcaagggagagaagcataacaacaaattggagtgaaaaaaatatatatcatgtgtgtggtgaacattgcaagtacgatgttcacaatcataagagccattattggatcacatattattctaatgtaatgtggctgggcgttctattggaaaaatagccacggtttgagatttatatataaatttgtgttgacgaaaattctgataaaaaaaa

SEQ ID NO: 901 - DNA, 1198 bp, Zea mays
  CDS (72)..(263), (626)..(994)
ctgatagctttcgtaggtgctagctactaccatataccatatactctcacacaaagattagtacagctagcatggctaatgactccttgacgaggggccacataatcggggatgtcttagacccgtttactagctcagtgtctctaagtgtcctgtatgatggcagaccagtgtttgatgggatggagtttcgggcgtcggcggtgtcggtgaaacctagagttgagattggaggtgatgattttcgagtggcctataccctagtaagccatcacgtactccgcagatcgagtccatttggcgcgcggtaggccatatctatggccaagatgtctcgactactctccaaactctcatgtccaagtgacatccatggcttttggctcactgtgtgtgacggctaaatcagtctcctcgatcgtgcccatagctcggttgactacaaagattggctcatgctaataaatatatagtagtattatacactgagagagacactaacacccccccccccaaaaaaaaagtgcagggatttctgatcagcccagccccgaaaaaatgctcaggtttacttttaattccctaacatgttgaccatgtgtttgtgttaatgtaaatatattaggttatggtggatcctgatgcgcctaatcccagcaaccctagcctgcgggaatacttgcattggatggttactgacatcccagcatcaacagatgatagcttcggccgagagctcataccatatgagagcccaagccccaccatgggcatccaccgtcttgtgttggtgctctaccagcaattggggcggggcacggtgtttgcgccgcaagttcgtcagaacttcaacttgcgtaatttcgcacgccgtttcaacctcggcaagcctgtggccgcgacgtacttcaactgtcagcggcaaacaggcacaggtgggagaaggttcacttgtgtttttgatcatgtcgttcaaggtgaaggccggcaagcttgaacctactactactagtaacgttcgcgtgtgcttatatggccgtatcggcgtacactacgtagcatgaaagctagctagaaataaataaagatgtatttctttcgcacatgtagctaggcttttataaaggcgtacctccaagggtattatgtccggcttttaattaataatcgcgtgataagggtggttagtataaaaaaa

SEQ ID NO: 902 - DNA, 1495 bp, Oryza sativa
  CDS (76)..(1245)
ctcgaaacacaagaaacaaccggagaaactgagcccggccgaccgcaaggacagcaagctattagccatcctcgcatggatcccaacgatgccttctcggccgcgcacccgttccggtgggacctcggcccgccggcgccggcgcccgtgccaccaccgccgccaccaccgccgccgccgccgccggctaacgtgcccagggagctggaggagctggtggcagggtacggcgtgcggatgtcgacggtggcgcggatctcggagctcgggttcacggcgagcacgctcctggccatgacggagcgcgagctcgacgacatgatggccgcgctcgccgggctgttccgctgggacctgctcctcggcgagcggttcggcctccgcgccgcgctgcgagccgagcgcggccgcctgatgtcgctcggcggccgccaccatgggcaccagtccgggagcaccgtggacggcgcctcccaggaagtgttgtccgacgagcatgacatggcggggagcggcggcatgggcgacgacgacaacggcaggaggatggtgaccggcaagaagcaggcgaagaagggatccgcggcgaggaagggcaagaaggcgaggaggaagaaggtggacgacctaaggctggacatgcaggaggacgagatggactgctgcgacgaggacggcggcggcgggtcggagtcgacggagtcgtcggccggcggcggcggcggggagcggcagagggagcatcctttcgtggtgacggagcccggcgaggtggcgagggccaagaagaacgggctggactacctgttccatctgtacgagcagtgccgcctcttcctgctgcaggtgcaatccatggctaagctgcatggacacaagtccccaaccaaggtgacgaaccaggtgttccggtacgcgaagaaggtcggggcgagctacatcaacaagcccaagatgcggcactacgtgcactgctacgcgctgcactgcctggacgaggaggcgtcggacgcgctgcggcgcgcctacaaggcccgcggcgagaacgtgggggcgtggaggcaggcctgctacgcgccgctcgtcgacatctccgcgcgccacggattcgacatcgacgccgtcttcgccgcgcacccgcgcctcgccatctggtacgtgcccaccagactccgccagctctgccaccaggcgcggagcagccacgccgccgccgccgccgcgctcccgccgcccttgttctaagctcgccggagactctgctgctgttcccgcgccgccacggcgcgtgggagtttcctgtggtgttgggccgtgttttcgttgtaaggcagttaggtcgttctaagctattcgatgggccgatcgaggatgcgtcgtcgtgtaggaactcgtcgtgtacccatgtttgcgatctggatggcccatttgtttagctgttaccatgttaaattcgtttcctttatttatgaaatggtaaatcctaaatgtcgtg

SEQ ID NO: 903 - DNA, 1535 bp, Zea mays
  CDS (93)..(926)
gtcgacccacgcgtccggcacaagcaaaacacaaagaagctcaagaaagctgaggcaagcccagaagaagaaaaaaaaaactagaaggagagatgggaagaagcgaaggcagcacaagcccagcggctgggggagccgcctgcgcgtgcgcggtctgcggcggcgccgcggtggtgtactgcgcggcggacgctgcggcgctctgcagcccctgcgacaccgctgtgcacgctgcgaacctgctggcgtcgcgccacgagcgcgtgcccctttccatggtgactgctgcatccggcgtgtacgacgacgacctcttcgcgcccgacgacatcgacgcggcgtcgtcgtgggcgtcggcgcctgcgcaggggcagggaagcccccagaacgggagctcgtcggcgagcttcaccaccggcgacagcggcgcggagggcaggggcctgttcgacctgctgtccgacgtcgacttcgctgcctgtgtcacgggcggcggcggctacctgccggacggcgtggcgcccgtcgtccatcacggcgctgcacctctgtgggcgcagcccggtctggccgccgccgcatggacggccacgtggtcgcccgctgtcgtcgtcccgggcgccgccgtggtcgccgcggcggcggcggagcgggaggcgagggtgcagaggtaccgcgagaagcgcgagaggcgcaagttccagaagaccatccgctacgcgtcccgcaaggcctatgccgaggcgcggcccaggatcaagggccgctttgtcaagcgcgccgccggcacctcctcctcctcctcctcgggtgccggcacatcggacagcatcgacgctgctgccaagttctggctctccttctccgacgacgccagggacggcttcttcgtggacgccggggcctacggggtcgtgccaagcttctagaaagtttgtgccttgaaaatttaggggtcacactcgcatcacagcgggcagcgcttctgggcttctggcggtggcgttcgcccagtttgaagcaagttaagcaaccgcccttctcgtttgtgtcgtgtcgtctcgtcattcatgtgagcagcatccgtggtgaaattccgccatcgctatttttaaatgatggcgcggaatttcgatgggtcatcaccagttggtgaacgaactaggggatttattgtgtcttgtaagatacaactttactgggttgtctatcaaattctgcgttggctcatcgtcatcgctttactggggctaacaatatagttgtggtggaaatctgccatccatgcttccatagcaagctcttagatgatcggaataaaaggggattttgatgggccaatcaggaagtgggtttggttaatctatatatggagcatatagcttatgcagctgttcatccacatggtttcagtgttttgactttctatccaagttgattaattccatatatggtggtcccaataatcttatgccactaaaaaaaaaaaaaaaaaaaaaaaaaaaaaaaaaaaaaaaaaaaaaaagggcggccgc

SEQ ID NO: 904 - DNA, 1314 bp, Arabidopsis thaliana
  CDS (40)..(1311)
atgccaactttgtacaaaaaagcaggctcctgcaggaccatggatcctgaaggtttcacgagtggcttattccggtggaacccaacgagagcattggttcaagcaccacctccggttccacctccgctgcagcaacagccggtgacaccgcagacggctgcttttgggatgcgacttggtggtttagagggactattcggtccatacggtatacgtttctacacggcggcgaagatagcggagttaggctttacggcgagcacgcttgtgggtatgaaggacgaggagcttgaagagatgatgaatagtctctctcatatctttcgttgggagcttcttgttggtgaacggtacggtatcaaagctgccgttagagctgaacggagacgattgcaagaagaggaggaagaggaatcttctagacgccgtcatttgctactctccgccgctggtgattccggtactcatcacgctcttgatgctctctcccaagaagatgattggacagggttatctgaggaaccggtgcagcaacaagaccagactgatgcggcggggaataacggcggaggaggaagtggttactgggacgcaggtcaaggaaagatgaagaagcaacagcagcagagacggagaaagaaaccaatgctgacgtcagtggaaaccgacgaagacgtcaacgaaggtgaggatgacgacgggatggataacggcaacggaggtagtggtttggggacagagagacagagggagcatccgtttatcgtaacggagcctggggaagtggcacgtggcaaaaagaacggcttagattatctgttccacttgtacgaacaatgccgtgagttccttcttcaggtccagacaattgctaaagaccgtggcgaaaaatgccccaccaaggtgacgaaccaagtattcaggtacgcgaagaaatcaggagcgagttacataaacaagcctaaaatgcgacactacgttcactgttacgctctccactgcctagacgaagaagcttcaaatgctctcagaagagcgtttaaagaacgcggtgagaacgttggctcatggcgtcaggcttgttacaagccacttgtgaacatcgcttgtcgtcatggctgggatatagacgccgtctttaacgctcatcctcgtctctctatttggtatgttccaacaaagctgcgtcagctttgccatttggagcggaacaatgcggttgctgcggctgcggctttagttggcggtattagctgtaccggatcgtcgacgtctggacgtggtggatgcggcggcgacgacttgcgtttctag

SEQ ID NO: 905 - DNA, 856 bp, Zea mays
  CDS (104)..(661)
tcgcactcgcccaacctcgaatgccaagctagcaagagaggcctcgatcgcagaacccagcggcaaagcaagcacgcccgtgtctacaggcagctctttccatatggcgcccaagaggagcagcgaggagcgcgcggcggcggagcaggagcagccgaggctccgcggcgtgcggaagcggccgtggggcaggtacgcggcggagatccgggaccccgtgaggaaggcgcgcgtgtggctcggcaccttcgacacgcccgagcaggccgctcgtgcctacgacgccgccgcgcgcaggctccgcgggccgcgcgccaccaccaactaccccggcgacgtcgtccgagaagcgccgtgcacggccccggctctggctgcgagcgcgagcggcagcaccgagtcgtcgtcgtcgtcgtcgtcaagggacgacggccacccgccaccgccgctgcctacggcgccgtcgtcgctcggcctgggcctcgggctcttcccggcgacggtggccacccagccgtgcctgttcctggacccggcgccggtggagagggaggaaggggagcgggagcggagctgctgctcccggtcgccgccgtcggtgctggcgggcctcgggttcgacttcgacctcaacctgcctccgcccgccgagatggtcatgtagcgttggagatagtaattctagcaaaaagggattgtgtagtaaataggaagggcaatcggtttgtgtagtagtagtgtagtactagctagccagtttgcctgtgcactagccactagccaatttgcgacttcgcaatgcaaatcaagaaatcgacgggcaaatatttttctcctgcaaaaaaattgcagtgcc

SEQ ID NO: 906 - DNA, 696 bp, Arabidopsis thaliana
  CDS (77)..(493)
aatccatagatctcttattaaataacagtgctgaccaagctcttacaaagcaaaccaatctagaacaccaaagttaatggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagaagttttcgagtttgagtatttggacgataaggttcttgaagaacttcttgattcagaagaaaggaagagataatcacgattagttttgttttgatattttatgtggcactgttgtggctacctacgtgcattatgtgcatgtataggtcgcttgattagtactttataacatgcatgccacgaccataaattgtaagagaagacgtactttgcgttttcatgaaatatgaatgttagatggtttgagtacaaaaaaaaaaaaaaaaaaaaaaa

SEQ ID NO: 907 - DNA, 491 bp, Glycine max
  CDS (20)..(391)
attcataagtgtgacagaaatggaggatttaaaggaaaaggtcaatgaaggggaaccaacgcaaattaagtatagaggagtacgtaggagaccatggggaaaatttgctgcagaaattagagattcagctagacatggtgctcgtgtgtggctcgggacatttaacactgctgaggaggccgcaagagcttatgatcgtgctgcctttgagatgagaggtgctacggccattctcaacttcccagatgaacaccctccttgcaatgtgacttctcttagcaagaagtcctcatcatctaacactgagattggtaaacaagttgtggtatttgagtgcttggatgacaaattgttagaggaactccttgattgcgatggggaaaaccatcaatgaaaacttggattattaggaagataaggttcaactttttaatcctaaattggtatgtagtgcctgtgtacaattaaatacagtaaagttgcttagtgac

SEQ ID NO: 908 - DNA, 596 bp, Glycine max
  CDS (18)..(431)
  unsure (1)..(596): unsure at all n locations
cgggattaaggcacacaatggaagaggagtcaaaggagaaaaagaaggacactaaggaggaaccacgttatagaggagtgcggcggcggccgtgggggaagttcgcggccgagattcgggacccggcccggcacggtgcccgagtgtggctggggacatttctcacggcggaggaggctgctagggcttatgaccgagctgcctatgagatgaggggcgctttagccgttctcaattttccaaatgagtatccttcatgctcttctatgaactcatcttcaacattagcaccttcatcttcttcttcaaattcaatgcttaaaagtgatcatggtaaacaagttattgagttcgagtgcttggatgacaaattgttagaggaccttcttgattgtgatgactatgcctacgagaaagacttgcctaagaactgaacggtttgatcaaatttgaatgttagattgatttcaaagcatacctatagtagggtgaatgtcttcatatatgatatgatttccttttaggcagcactttactttggtgagtatggtttataacttaagaatgactttgttgaaccatnttagtttgatcgt

SEQ ID NO: 909 - DNA, 806 bp, Zea mays
  CDS (247)..(639)
tgggacctcgagcggcggggccggtgcacaggaaatctctatccacagacacacaagcagccagtgcagtagtagcccggtatatagagagtgtagcacgattatacaatatatcacagagctagctagttagtatatacgtactatatatatagtctattgctcgctagcttgctgaatcaagctgaactatatagtaagagactaattaaagagctattagccacagcgcgtgatccacgattaatggaggacgacaagaaggagggcaagtaccgcggcgtgcggaagcggccgtggggcaagttcgccgcggagatccgggacccggagcgcggcggctcccgcgtctggctcggcaccttcgacaccgccgaggaggccgccagggcctacgaccgcgccgcattcaccatgaagggcgccacggccgtgctcaacttccccaccagcggaggatcagctgccgcggctcccggcggccggaccagcggcggcggctcctcctcgtccaccacgtcgtcggctccggccagcagggggagggcccgtgttcccgactcggagaaggtggagctggagtgcctcgacgacagggtcttggaggagctgctcgcggaggacaagtacaacaagaactaatgaaacgctagctgatgcacaacatacatatgttggtagtagccttattagccgccgcaacgcgctgctagctagagctagctcttcgctgccgcttccagtaaattatatttaagggagacagaactatattaactttaatatactatactcactacccaatt

SEQ ID NO: 910 - DNA, 2206 bp, Saccharomyces cerevisiae
  CDS (64)..(1752)
aatataaagaaatattagttaggaaaaaattaatagggaagaaagatctagaagcaaacagcaatgactgccgtcgcctctactagcgggaagcaagatgctgaccataaccagtctatagagtgtccaaggttttcgcgtggacagaaagagattttgttggaccatgaggatgcgaaggggaaggattcaataatcaactcccccgtgtcagggaggcaatcaataagccctactttgtcgaatgctactaccacgactacgaaatctattatgaatgccaccggcacctccggcgcagtagtaagtaatactccggagcctggtttgaagagagtccccgccgtcactttcagtgatctaaagcaacagcaaaagcaggatagtctgactcagctgaagaacgactcagaaaggaccaagtctccaaatagtaatcctgctcctgtctcaaattccattcctggcaatcatgcagttataccgaaccacaccaacacttcaagaacaacgcaattatctgggtctccactcgtcaacgaaatgaaagattatgatcctaagaaaaaagacagtgctcttaaaatagttgataccatgaagcctgacaaaatcatggccacttcaacgccaataagtagagaaaataataaggtaaccgccaaagcccccaccagtattacacttcgaaaggaagatgcacaagatcaagctaacaatgtttcaggccaaattaatgtgcgttctaccccggaagaaacgccagtgaagcagtccgtcattccttccatcatccccaaaagagagaactccaagaatttggatcccagactacctcaagatgatggaaaattgcacgtgttgtttggcgctacaggttcgttatcggtatttaagatcaagccaatgattaaaaaactagaagaaatatatggacgtgatagaataagcattcaagttatcctcactcaatcagcaacacagtttttcgaacaaagatataccaagaaaattatcaaatcttcagaaaaactaaataaaatgtcgcagtacgaatccactccggcaactccagtgacaccaacaccaggacaatgcaacatggctcaagtagtcgagttacccccacatattcaactatggaccgaccaagatgaatgggacgcatggaaacaacgaactgatcctgtacttcatatagaactacgtcgctgggcggatatactggtagtagctccattaactgcaaacacattatcaaaaattgctttgggcctgtgcgacaatcttctgacaagtgtcattagagcttggaatccgagttatcccattcttttggcaccttctatggtgagtagcacttttaattctatgatgacaaagaagcaactacaaacgataaaggaggaaatgtcctgggtcactgttttcaagccgtctgagaaagttatggatataaatggtgatattggtctcgggggtatgatggactggaatgagattgttaacaaaatcgttatgaaattgggtgggtacccaaaaaataacgaggaagaggacgatgatgaggatgaggaagaagacgacgacgaagaagaagatacagaagataagaacgaaaacaacaacgatgatgatgacgatgacgacgatgacgacgacgacgacgacgacgacgacgacgacgacgacgatgatgacgaggacgaggacgaagcagaaaccccaggtataatagataagcatcaataaatagtctatgaattacaaatacactaaacacattctacttatttgtgttttgtaatttctggaaaaatactcattaggcaaattcacgcagcatatttacaaaatgtcacaaatttttttccttttttacttgcagtaggtatgtaatgccatactagcgtacatagagctcttcatataaaccgctatttattactaattttaataattcagtaattcattaaatacattcattactttctgggtaaatatctattcgtttctcatttttctttttttgacatatcccggtaccggaataagtccgatactattcaaaagcttctggaaaaaaaaaataaaaaaaagaaatgattagtaatcatttaatttcatgacatattaaaaaggtattctaagcagaagtctttcatcacatttgatctaagcatatacactgtaagtgaaggtatcg

SEQ ID NO: 911 - DNA, 3339 bp, Saccharomyces cerevisiae
  CDS (2556)..(3245)
tgggtaatatattataatggtagctctatggggcatgcgttgcaagtttattcggttgcttgtccaatgagcaactaaagcaattattgaccgatgacaaccctgttgaatatgatcaagaatgatgtagatttattaaaaagctgtggatacggtaatttacacgagcacctaaaggtggggactttgattcagaacctaatacaccacggttattctcaagacgtttatctttttatccggtttgttatgaaatatattaaatttcttaccccagaaatgccaacaatccgagcataacggagagcccctatactaggttaacggaactatcatgtatactcatgtttctttggcgagaccatacttggcaccattggtggtaaatgatttgaagcatgaaataaaaacgtcaaaatattactattataagcattatccaaatatgcctcctataaacgcgaatcagtaagaaaaacacagagatcctcttcggaatttcgacataggatggaggtattggataatttaggcctgttgtgctcattaataaaaagactaataattgatgaaaagactcccagatcagctacggagattgctgtggtaccaaggatgaaaagtctatcattaacaaggattattgaaggtcaactaaacaacattccatactggataaaatctggtgaacgaagtacatggcccgcactagctttaattaagacaagatgtgcagtcgaatttaaattagacgacataataagagcaagacggagtaggtagtatcgtttccacttttttctgtcttattttttttattgatagagctcgattgcatatatttttcattgatattgtacttaaaaatatattcagttcatagaaaaaacaataatacgagaatcaatgtgcctcgtatataatcttatcattatttagcgataaaatagttttgttgactccttctcattcagatataggtattcattttcaacgacgtgtaggcttgtgtttgaagttgcaatgggtgcgccgcccctgcaaacgtgcaatgagccggttacgtcctttgcaaaaccggtcttcagaggattcaagttcaaataatcattgatttgataaaggaagatttgtagaaattttgcagattcgaggaatgaacagaagcatcgtattcatctatattaaatatgtccgaattggaaacaatgattagcactttgcattgcctcaaaagaggtgtgatgaacttattgtttaattctgaacagttaggcgcttactagcgacaacagtaattctggttgttcgatgataacaatggtgtcagttgggttattttgtatagcagcggagaactttgcgagtacgtcacttagtattttgtctcttggcttattatggatattattaacgatgaagtcggacaggaagtctaaaacattgtagttattagatgggatctttagcttgtttaatgaatttgtaaaatagttctgttcgtggataaacgacgcaaggactgcatgggagcgagttgacgaaggtagcatcgatgaagaagattcattaagggaacttggggaacctaacacgtgcgtttctactagtgcgtttatcatccatagtggttgagtacagattgatgggtgatgaagaataagttatgagagttgctgtcttggaaaaagtgggcaggaagcactgattggtcgctgaataggaccaaatcttgtcgttgaacactacccataaatgtgtatttagttatttttgtggaggttctggacggtttttgcctaacttctactagcctcaatttagtacttttatttttttttcatttttcattctgctcatcgcctatcaattcatgcctaagagatgcaaagatagcgtactatagatgtgaaaaggttggataaacaaagcccatgatataagccacggcttcagccttaaaattggggttaaaggctaagaacgaattgcaaattcttttgcttcagcaggaattttccaacagcaaagtataaaaaatctatctaagccgcttttaaattaaggagcgtatataaaattatataatcacactcgaaggaccaatctgtgctctacataccttacgcgctctaataatatgatctatgcttcatcagtcttgtttattcttaaagtatttttttttatgtttggttcttgttattgaacaaaaaaatgaattaacccgaacactaccaaatcaatagcagaagaaaagaagaaaatgataaaataaaggtgagaaccattttaaagcattattcattatgaaatcctcctatctagtataacttgattcgacaccttgctaatatttctctgaagcactgtctttagaggcaaaacggtactatcgcatattcttacccggtttcaagttttgccctcacgcttttttagggagaaatgacttccaccgaaaggataatttgagaacaccactacaacttaaagtccaagagcttcatcagtacaacgagttcgtatcatcaagaacgcacatcagcagaataatgggaggtatacttaaaaacccgctagccttatcgccggagcagctggcgcaacaggatccagaaacgcttgaagagtttagaagacaagtttacgaaaatacgcagaaaaatgccaaattgacatcacataaaaggaatataccgggactagataatacaaaagaggagggggagataattggaacatcgagtaccttccttccaaaggacacactgtcactgaaacatgagcaagacatgttggccaagatgacaccagaagagcgagttcaatggaaccaaagaaatttagcagaaaatgaaataacaaaaaagcagttccaagatattcacatagacgagcccaagaccccctaccaaggtgctgtggaccctcacggggaatactacagagtagatgatgatgaagatgaggataatagtgataaaaaaccatgccaggtggcaaacgatgacatcgacgatttgtccctgggcgaaccggaatttgaaatcaaagagaacaaacaaccggattttgagaccaacgacgagaatgatgaagactcaccggaggctagacataagaaatttgaagaaatgagaaagaagcattacgacgtaagggcaattttcaacaaaaagtcccgtgaagcgctaaaggacgaagacgaagacgaagatgatagtacgacaaaagaaccatgaaacatgacacctccataacgtttacctatactaaatatatcttattttttggattcttggtacataaatatgcactgtttgttatcacgcgaac

SEQ ID NO: 912 - DNA, 713 bp, Zea mays
  CDS (24)..(659)
cggagacacacattgccactgcgatggccgcccaccaggactcggcggcagcggggggcaggcctcctcgtcgtcctcgcgtcctcctggcagcctccggcagcgtggccgccatcaagttcgaggtcctctgccgcagcgtcgccgagtgggcggatgtccaggcggtggcgaccgcgtccgcgctggaattcatcgatgtggcctccttccccggcggcgtccctctctacaccgacgaccaggagtggtctagctggaagcgggtcggcgacaaggtcctgcacatcgagctgcgccggtgggccgacgtcctggtcatcgcgccgctatcggccaacaccctcgcaaaggtcgccggcgggctgtgcgacaacctcctcacctgcgtcgtgcgcgcctgggactacagcaagcccgtttacgtcgcgccggccatgaacaccttcatgtgggacaaccccttaccgcgcgccacctcgccgtcctgcgcgacctcggcatgtccgtcgtcccgccggtcaatggcgcgatggcggagccgtcggagatctgcaagaccctcatgctcttcttcggtccgcaacatctttagcagtcgccaagctcctcagttctttgctcctttatgtatgatgagatgtgtcccttgcttgacctagcatagcaatcttgccccaaaccacggggtaraattagatggcaattgttcc

SEQ ID NO: 913 - DNA, 1382 bp, Zea mays
  CDS (237)..(881)
ttttttttttttttttttttttttttttgatccaattgcttcattcggggtagtaattttacaaagcccagttatggggatacattggtttcaaaaaaaaaaactcgaaattctcccgcctatccaccttgaattggattggatttgcttcgagcagtcagtcttgccgaagtttttaggagttctccgacctcgtagtcaatcactcagtctcggagacacacattgccactgcgatggccgcccaccaggactcggcggcatcggggagcgggcctcctcgttgtcctcgcgtcctcctggcagcctccggcagcgtggccgccatcaagttcgaggtcctctgccgcagcgtcgccgagtgggcggatgtccacgcggtggcgaccgcgtccgcgctggaattcatcgacgtggcctccttccccggcggcgtccctctctacaccgacgaccaggagtggtctagctggaagcgggtcggcgacaaggtcctgcacatcgagctgcgccggtgggccgacgtcctggtcatcgcgccgctctcggccaacaccctcgcaaaggtacgccgtacgcacgccagctggtcatcgcgctcgccctcaccggtcgccgctgacaactctgcctgctgccaggtcgccggcgggctgtgcgacaacctcctcacctgcgtcgtgcgcgcctgggactacagcaagcccgtttacgtcgcgccggccatgaacaccttcatgtggggcaaccccttcacggcgcgccacctcgccgtcctgcgcgacctcggcatgtccgtcgtcccgccggtcaatggcgcgatggcggagccgtcggagatctgcaagaccctcatgctcttcttcggtccgcaacatctttagcagtcgccaagctcctcagttctttgctcctttatgtatgatgagatgtgtcccttgcttgacctagcatagcaatatggcagtggagcgcttctcgtctttcatttccccgtacagatcgtcaagcaccctgaaaacctcctcagcttcagacggcggcgcgctccaggccgtgaaggcgaacaccttgttcctcacttcaatccagctctgccccggattcttcctcaaccctgcctccttcatcgtcatcctcaccctcttggagtcgtcccacatcccacacgcggcgtacaggtttgtgatcagcgtgcggttgccggtggttgccgtctcagcctgcagaactttggccatggcagcttcggccagtgctgcatccccgtgaatcctgcaggagttgagcagcgctccccacacgcacaggtcaggcttcatcggcatcgtatcaatgagctcacacgcgcccctcagcaggccagcacgccccaggagccc

SEQ ID NO: 914 - DNA, 866 bp, Zea mays
  CDS (232)..(726)
gggcgttcctctcccgtgtggattctccccacctccgccgccgtttccccgcgtgctttctctctctctctcgatctcgagcgacgactcggttacagccgccgtcctacgccaggtcccaggtcttcgtcgggcccgtctccggcaacgagcaccaacaagatttttgtgtgtaaagatttgcgagcaccattcactttttcatcagtgtgaaattaaaacacttcaagcatgagctctcaccgtgtgaagtggaatgaggacaatttgtatgaaattgagtcaaacaaaccggtgaggcagaagataacagagccaaagacaccatatcacccaatgatagatgatgatggatcattgtcgccaacacgtcctttcgacaaatgtcttgatgagactgtccaggctgaagctatcttaacagccttaaatggtgtggcttcttcaagcattagcatttcaaaggatgatggttggggatcgtcagatgatgatacagatgccatagatcaagatgctgaccctgaagctgacacgacaaggttgagtttcaaggagcatcgccgtgcccactacgatgagtaccgcaaggttaaggagctgatgaggactggatcccttactgctgaggaggccgatgaggataacagagctgccaccagctccgaagacaaaggtgtggggaaaggagggccgaatgataacatgaagccctcgcctcaaacatgaggagttcatatgaaggttctgattcctctgttatttattgtatcattgtatgcaatacagttgttactcttgttttgttttgagatgctggtgtgccaaaatggatttgatgaccgataattttattggtgttggct

SEQ ID NO: 915 - DNA, 901 bp, Zea mays
  CDS (98)..(625)
attcggctcgagctgcaatttctttccaagttgatcgagcgacttcaggattgccttgcatacttttggtgtttgaagagctaatctgtctaccaaaatgaagggacgtgtaaggtgggatgaggctaatattggagaaattgaggcaaacaaacctgtgaggcagaaaattactgagcctaagactccatatcatcctatgattgatgatgacagttctctatctcctgtacgaggaagttttgatgcatgtattgataatgaaaatcgtgctgaagcaatatggagtgctctgaatgatgtagcctccagtagcagaagaggcactggacaatctggtggttggacatcatctgaggatgagccagaagcaatggagcaagatgatgatgattctgaaacagataggaacttgagttttaaagagcacagaaaggcccactatgatgaatttcttaaagtcaaagagctgcaagagacgggttctcttgaggatgaaagtgacgaggatcataattctcaacccagtaaggcggagaaatgtgagtcgtcttcactgagtcatagtgtaaaagagatggtcattgagggtaagaagtcttcaacgcctccagctaatggttcttagacagtgatcaacaaataaaatccactgtcttttcattagtttcattttgtgtattgaagaaaactaaatgattcactgtattgtatcatttgtatgtaaatagtttctttcttcatcatgcttattatgatccgttcacactttggttgtattctggcaaattggtttatgttcggcatcttcgaggagtttgcttgtggcttttataagtaattaaggttggatgcttaaagggagcaaatatatcccaaactggaaaaaaaaaaaaaaagg

SEQ ID NO: 916 - DNA, 1927 bp, Glycine max
  CDS (76)..(1500)
ctaagctccttgtgcggccaccattcttgttggagatttcaactctttctccttcagacttcttgggtttatgtgatgatggctctcaatatctcttctcctgctgaagtcaagtccatttttttcgctgattacttcaagtctaactgcatcactgcaaagttcacaggtggttttgcttttaagagaaaagagcgtggagctgcatctggagggcgagtttgttgctcagtgctggcaccaccaccaccaccggcctggccgggacgagcggttccagaacaaggtagcaagacttgggatggaccaaaacccatttcaattgttgggtgtactggttcaattggaactcagacactagatattgtggcagagaatccagataagtttaaagttgtggcacttgcagctggttcaaatgttactgttcttgcagaccaggtaaaaagatttaagcctcaacttgttgctgttagaaatgagtccctaattgctgaacttaaagaggccttgcatgacgttgaagaaaaacctgagatcatccctggagagcagggaatcattgaggttgctcgtcacccagatgcagtcagtgtagtcacaggaatagtaggctgtgcaggactgaagccaacagttgctgcgatagaagcagggaaatacatagctttagccaacaaagagacattgattgctggaggtccttttgttcttcctcttgctcagaagcataatgtaaaaatacttccagctgattcagaacattctgccatctttcagtgtatccaggggttgccagagggtgcacttaggagagttattttaactgcatctggaggtgctttcagggattggccagttgataaactgaaagatgttaaagttgctgatgcattaaaacatcctaactggaatatggggaaaaagataactgtggactctgctaccctttttaataagggtctagaagtaattgaagcacattacttgtttggagctgactatgatcatattgagattgtcattcatccacaatcaatcatacattcaatgattgaaacacaggattcatctgttcttgcacagttggggtggcctgatatgcgtttgccaatcctctatacattatcatggcctgacaggatttattgttctgaagacacttggccctgccttgatctttgcaagattggttcacttacatttaaaactccagataatgtaaagtatccatccatgaatcttgcctatgctgctggccgtgctggaggcacaatgacaggagttcttagtgcagcaaatgagaaagctgtagagatgtttattgatgaaaagattagctatttggatatattcaaagttgtggagctaacatgtgagaagcatcaaaatgaattgttatcctctccttcccttgaggaaatcattcactatgacctgtgggcgcgagaatttgctgctagtttgcaagactcttccagcttcactcctattcttgcatgaggatatgattaaactagggatgtggctgctggtgcttcccaattgcctgctttcaccataatttcttcaggcaattgaacaatttagaatgatgcattccctcagatgttgaaaaataaatagttttttttttttttgtttatggaatgttggtgttttaacacctttcaattgatcttataggtttgtcgtaatttcattgaaaacaatgtctttttaatagtgaataggagcctaggaggttggttgcctatgaatgtgtcaaagtcaagaaggggggtggatgttctcatgttcaaaatttacatgacgtggtcaactagaagttttgtatttcgctttttataataggattgaataagtgagtcttataaaacttaatagagatagataaaaaagttgaccaatcatcaaaaaaaaaaaa

SEQ ID NO: 917 - DNA, 1301 bp, Synechocystis sp. PCC 6803
  CDS (100)..(1284)
gctcctccttggttcaatcctgggggagttttttcttctcagatgggcggcaaccccgtaagattgggaagattagttttagcttaagcaacggcggtaatggtgaaacgcatttctatcctcggctccaccggttccattggtacccaaactctggacattgttacccatcatcctgatgcttttcaggtggtcggtttagcggctgggggaaatgttgcattactagcccaacaggtggcggagtttcgcccagagattgttgcgattcgtcaggcagaaaagttagaggacctaaaagcagcagtggccgaactaactgattaccaacccatgtacgtggtgggggaagaaggggtggtggaagtggcccgttatggtgatgcagaaagtgtggtcacaggtattgtcggttgtgcgggattattacccaccatggcggcgatcgccgccgggaaagatattgctttagccaataaggaaacgttaattgccggagctccggtggtgttacccctggtggaaaaaatgggggtgaagttattgccggcggattcagaacattcagccatttttcaatgtttacagggggttcccgaaggggggttacggcggatcattctcaccgcttccgggggagcattccgggacttgccggtggaaagattaccgtttgtaacagtacaggatgccctcaaacatcccaactggtctatgggacaaaaaatcaccattgattccgccacattgatgaacaagggtttggaggtgattgaagcccattatctatttggcttggactacgatcatatagacattgtcattcatccccaaagcattattcattctttaattgaggtgcaggatacttctgtgctagctcaactggggtggcctgatatgcgtttgccgttgctctatgccctatcttggccagaaagaatttacaccgactgggaacctttggatttagttaaagccggtagcttgagttttcgggagccagatcacgataaatatccctgcatgcaattggcctatggggccgggcgagctgggggagccatgccagcggtgttaaatgcggccaatgaacaggcggtggctttatttttgcaagaaaaaattagctttttggatattccccgtctgattgaaaagacctgtgacctctacgttggtcaaaatactgctagccctgatttagaaacaattttggcagcggatcaatgggcccggcggacggtgttggaaaatagcgcctgtgtggctactcggccataaagtctagttggcttcaa

SEQ ID NO: 918 - DNA, 1251 bp, Agrobacterium tumefaciens
  CDS (52)..(1245)
gggttttcgcgagtagagcctaattctgccaataaaaccgacgggctgaagatgacgaatgccagtgaaatgccacgcaagctgaccatattgggttcgacgggttccatcggcaccaatactctggatgtcgtgcgtcaactgggtggccgcgacgggttcgagatcatggcgctgaccggcgcgggaaacatcgcgcttctggccgaacaggcgcgggaatttggcgcgcagctcgcggtcactgcggacgatgataaatatgaagcgctgaaatcggcgctggcaggcaccggcatcaaagtcgccgcaggcatggccggccttgaagaggcagcctcgatggatgccggctgggtgatggccgcgattgccggcacccccggcctcgccccgacactgacggccgcccggcgtggtgccgatattgcacttgccaacaaggaatgcctcgtttcggcgggcgatgtttttctgcgcactgtcaaacagggcggcggccggctgatcccggtcgacagcgaacacagcgcaatcttccagtgcctgacgggtgaatacaaacaggcggtggaacgcatcgtgctgacggcttccggcgggccgttccgcacctggtcgcgggacgagatgtccaacgtcacggcggatatcgcccgcgcccatcccaactggtcgatggggctgaaggtctcgatcggcagtgcctccatgttcaacaagggcctggaaatgatcgaggcgaaatatctcttcgatctcaggcctgatcaggtggacgtgattgtccatccacaatcgatcatccattcgatggttggctacactgacggctcctatatcgcgcagctcggctctcccgacatgcgcaccgccatctcctatgccctcacctatcctgagcgcggcaatctaagcgtcgagcgcctggatttcgcgaaactggcacggctcgatttcgaagcaccggacgaagcccgcttcccggcgctgcggcttgcgcgcatggcgctggagcgtggcggtttgcagggcgcggccctgaacgcagccgaggagaccgcctttcacgcctttgtcgctggtggcatcggttttctcgacatggccgaaattgttgaaacggtgatggaccgtatgcatgacggccgcaccgccgagacgatggacgacgttttttcggcagacgaagaggcccgccgccatgcactggaactcatcgccacaaaagaaaaggccgcgtgaacgcgg

SEQ ID NO: 919 - DNA, 2589 bp, Zea mays
  CDS (289)..(2445)
cacccattgctctcactcgctcccgccggttgctcgtccccggacccgccgcactactgctataggcgcatccccggcgccttcgcacactctctccccggccacttcccaaatccgcccgccattcatgcacccttctgtgcactgtcagcgccaccattagctcgcagctcaagctcgccactaccattttggtcggttcttgaggaaatcgatcgaaccgttggagtgccaccactggcagaggctgttgcattcttgagttgagcaggaagaggagaggaagcaatggctctgtcgacgttctctgtcccaaggggattcctcggtgtgccggctcaggactcccatttcgcttcggcggtcgagctccatgtcaacaagctgctccaggccaggcctatcaatctcaagcctcggcggaggccggcatgcgtgtcggcgtcgctgtcgtcggagcgcgaggcggagtactactcgcagaggccgcccacgccgctgctggacaccatcaactaccccgtccacatgaagaacctgtctgtgaaggagctgcggcagctggccgacgagctccggtccgacgtcatcttccacgtctccaagaccggcggccacctcgggtccagcctcggcgtggtggagctcaccgtcgcgctgcactacgtcttcaacgcgccgcaggaccgcatcctctgggacgtcggccaccagtcgtacccgcacaagatcctgacggggcggcgcgacaagatgccgacgatgcggcagaccaacggcctggcgggcttcaccaagcgcgccgagagcgagtacgacagcttcggcacgggccacagctccaccaccatctccgcggcgctcgggatggcggtgggccgggacctcaagggcggcaagaacaacgtggtcgcggtgatcggcgacggcgccatgacggccgggcaggcgtacgaggccatgaacaacgccgggtacctggactccgacatgatcgtcatcctcaacgacaacaagcaggtgtccttgcccacggcgacgctcgacgggccggtgccgcccgtgggcgcgctcagcagcgccctcagcaagctgcagtcaagcaggccgctcagggagctcagggaggtggccaagggagtgacgaagcagatcggtggctcagtgcacgagctggcggcgaaggtggacgagtacgcccgcggcatgatcagcgggcccggctcctcgctcttcgaggagctcggtctctactacatcggccccgtcgacggccacaacatcgacgacctcatcaccatcctcaacgacgtcaagagcaccaagaccaccggccccgtcctcatccacgtcgtcaccgagaagggccgcggctacccctacgccgagcgagccgccgacaagtaccacggtgtcgccaagtttgatccggcgaccgggaagcagttcaagtcccccgccaagacgctgtcctacaccaactacttcgccgaggcgctcatcgccgaggcggagcaggacagcaagatcgtggccatccacgcggccatgggcggcggcacggggctcaactacttcctccgccgcttcccgagccggtgcttcgacgtcgggatcgcggagcagcacgccgtcacgttcgcggccggcctggcctgcgagggcctcaagcccttctgcgccatctactcgtctttcctgcagcgcggctacgaccaggtcgtgcacgacgtcgatctgcagaagctaccggtgcggttcgccatggacagggccgggctggtcggcgcggacgggccgacccactgcggtgcgttcgacgtcgcgtacatggcctgcctgcccaacatggtcgtcatggccccgtccgacgaggccgagctctgccacatggtcgccaccgccgcggccatcgacgaccgcccgtcctgcttccgctacccgagaggcaacggcgttggcgtcccgttgccgcccaactacaaaggcactcccctcgaggtcggcaaaggcaggatcctgcttgagggcgaccgggtggcgctgctggggtacgggtcggcagtgcagtactgcctgactgccgcgtccctggtgcagcgccacggcctcaaggtcaccgtcgccgacgcgaggttctgcaagccgctggaccacgccctgatcaggagcctggccaagtcccacgaggtgctcatcaccgtggaggaaggctccatcggcgggttcggctcgcacgtcgcccagttcatggccctggacggccttctcgacggcaaactcaagtggcgaccgctggtgcttcctgacaggtacatcgaccatggatcgccggccgatcagctggccgaggctgggctgacgccgtcacacatcgccgcgtcggtgttcaacatcctggggcagaacagggaggctcttgccatcatggcagtgccaaacgcgtagaacttgtgctgatctgggcctatagagatgattgtacattttgtcgttaactagagtgtctgaacttgggagattagtcttctttggatgaaagtgtcgccggaacaacagttaccgtttctttttttgaaagagaaaggc

SEQ ID NO: 920 - DNA, 2001 bp, Agrobacterium tumefaciens
  CDS (13)..(1932)
aaggccgaacgaatgaccggaatgccacagacaccattgctcgaccgggtgaattttccctccgatctcaaggagatcgatgatcgcgacctgccggaactggcacgggaactgcgcgacgagatgattgacgcggtgtcgaagaccggtggccatctgggtgccggcctcggtgtggtggaactgacgattgccattcacaaggtgttcaacacgccggaagaccggctgatcttcgatgtcggccaccaatgttatccgcacaaaatcctgaccggccggcgtgaccgcatccgcacgcttcgacaggaagacgggctttccggtttcacgcggcgggccgaaagcgaatatgacgattttggcgccggccattcctccacctccatttccgccggtctcggcatggcggtggcggcggggctcgatggcagcgaccgcaaggtcatcgccgtgatcggcgacggttcaatgtcggccggcatggcgttcgaagcgctcaacaatgccggtgcactcgatgcgcggctgatcgtcatcctcaacgataacgacatgtcgattgcgccgccgacgggtgcgatgagcgcctatctggcgcggctggcctccggccgcacctatatgggctttcgcgatttcggcaagaaactgaccgcctatctcggcaagaccatcgatcgcgccattacccgcgccgtgacccatgcccgcggttatgtgaccggcggcacgctgttcgaggagcttggtttctatcacatcggcccgatcgacggtcattccttcgatcaccttttgccggtgcttcgcaatgtgcgcgacaaccagaaaggccctgtcctgatccatgtggtgacgcagaagggcaagggttacgccccggcggaagcggcagcggacaaatatcacggcgtcaacaagttcgacgtcatcaccggcgcgcaggcgaaagccaagccaaatgcgccgagctataccagcgtgtttgccgaagcgctgatccaggaagcgaccctcgacgagaagatcatcggtgtcaccgctgccatgccgaatggtaccgggctggacaagatggccgagcttttcccgtcccgcaccttcgatgtcggcattgccgagcaacacgcagtcaccttcgcggcgggacttgcggccgatggttacaagccgttctgcgcgctttattccaccttcctgcaacgcggttacgaccagctggtgcatgatgtggcgatccagagcttgcccgtgcgtttccccatcgatcgcgccggcttcgtcggcgccgacggaccgacccatgccggctccttcgacacgacgttcctcgccaccctgcccggcatggtggtgatggcggcggccgacgaggcggagctaaaacatatggtccgcacggcggcggcttacgatgaaggcccgatttcattccgttatccgcgcggcgaaggtgtcggcgtcgaaatgccggcacgcggtgagattctccagatcggcaaaggccgcatcatcaaggaaggcaccaaggttgccctcctctccttcggaacgcggcttgcggaatgccttgcggccgccgaagatctcgatgccgcgggcctttcgactacggttgccgatgcgcgcttcgccaagccgctcgatctcgatctcatccgccagcttgccgcccatcacgaggttctggtaacgatcgaggaaggttctgtcggcggttttggtgcgcatgtgctgcatttcatggccagcgccggcctactcgaccatggcccgaaggttcggaccctgaccctgcccgaccagtgggtggagcaggccaagcctgagaccatgtatgccaatgccggcctcgaccgcgccggcatcgtttccaccgtgtttaatgcgctcggccagcgtcaggccggcgtcggtttcgccggctgacaagattgccgggacaggaggcgggactatcccgcctctttctcaggatacagcgccatcgagaaaacc

SEQ ID NO: 921 - DNA, 2101 bp, Xylella fastidiosa
  CDS (38)..(2050)
cattttctgaagtgttgttgtttttgaggttccggtgatgcgcattaggtcagtcatcaatgtcatctttatgcttcaccggattgcttgctcgggtccattatggggaggacaatggtgcttccgttgtaatgccaagacgatgattgattccacttgttatccacgcttgtcgcgtatccaaatcccagaggatctccgcacttttcaggagtcggagttgcgtgcggttgccgatgagttgcggaattatctgatcgaatcagtaggcctcagtggcggtcactttgctgctgggttgggtgtggtcgaattgacgatcgctttgcattatttgtactgcactcctatcgatcatcttgtctgggacgtgggtcatcaaacgtatccgcataagatattgaccggtcgccgtgacaagattagtacggttaagcatcaaggtggtttggcaccgtttccgaagcgtgaggagagtatctatgacacgttcggtgtcggtcattcttctacttctatttcagctgcgcttgggatggcgattgtggcgcagcgtcatggggatgagcgtaaggtggtggccatcatcggcgatggtgcgatgacggcagggatggcttatgaggcgctgaatcatgctggcgggatgagtcctgcaccgaatcttcttgtgattcttaacgacaatcgtatgtcgatttccgaagcggtcggtgggcttaccaagatgcttggtcgtgcgactggcagcaaagcattgaatgcgatccgtgagggtggcaagagaatttttggggataagaaaaccaatgcaaccgcgcgttttttacgtcgctgggaggagcattggaaggggatgtttgtgccgtcgacgttgttcgaagagatggggttccattataccggcccgatcgatggccatgatttgccggcccttcttggtgcgttgaagacgttgcgtacgttgaagggtccacagttgttgcatgtgatcacaaccaaagggaaggggtatgagctggctgagggagaccagattggttaccacgccgtcgccccgtttgatccgcaaaagggtctgattaaggcgggagcaaagaagcaaacatatacggacgtgtttagtgagtggttgtgtgatatggcagcggtggaaccacgtttgctggctattacaccggcgatgcgtgagggatcggggttggtgcgttttagtcaggagtatccgcagcgctattttgatgtggccattgctgagcagcacgcgataacgttggcggctggtatggcgactcaaggtgctaagcctgtggtggcgatttactcgacctttttgcagcgtggttacgatcaattggttcacgatgttgcgttgcagaagttggatgtgctttttgcagtagatcgcggtggtgtggttggtccagatggtgcgacgcatgcgggtaatttggatctcagtttcctgcgttgcgtgccaaacatgatgttgatggctcctgccgatgaggcagagtgccggaagatgttgagtaccggtttccactattctgggccagtagcggtgcgttatccgcgtggtacgggtcctggggtggtgccgtccgctgagttggatgtgttgccggttggtgtggcgcagttacgtcattctggtacacggatcgctctacttggttttggggtgtgtgttgctcctgctgaacaggtggggcgtaggcttggtttgactgtggtcaatatgcgttttatcaaaccgttggatcgaacgttgctgttggagttggcgcgtactcacgaagggtttgtcacgattgaagataatgtggttgctggcggagctggctcaggggttgcggaattacttaacgctgaaggcatcgttttgccgattgtgcatcttggtcttccagatgcgttccagcaacacgcttcccgtgaggatttactggctgaggcgggtattgatgcggctggtgtgtatgctgcgctgttaagtcgttggcctgatttggcggtacagaaccatccgctgagtgcggtgagttgagctcagtactgtttctgtttcatcttctgtaattgagctgtacgagatcat

SEQ ID NO: 922 - DNA, 2196 bp, Zea mays
  CDS (55)..(1911)
cggacgcgtgggctcccttttccagcacggggagcgacctgcgccgccgccacgatgccgaagcactaccgccctgcgggtaagaagaaggaagggaatgcggcaaagtacatcacgaggaccaaggcggtcaactacctgcaagttagcctcgcaatctttaggaagctatgcattctaaagggtgtctttccacgtcagccaaagaagaaggtggaagggaaccacaagacctactaccacacaaaggatattgcattcctcgctcatgaccctttgatcgagaagttcagggagattaaggtccatcgaaggaaggttaaaaaggctgttgctaagaaaaacagggatcttgcagacaggctgttgaatcggccaccaacttacaagcttgataggcttgtccttgaaaggtatccaacattcgttgatgctcttcgtgacttggatgactgccttacaatggtgcatctgtttgcggcattacctgctgttgacggtgaacgtgttgaggtcaaacgaatccataactgccgcaggttaagccatgaatggcaagcatacatatcccgaacccattctctgaggaagacatttatttccgtgaagggcatatattatcaggctgaagttcaaggacaaaagatcacctggctaactccgcatgctcttcagcaagtattaactgatgatgttgatttcaatgtgatgctttcttttctagaattctatgagactcttctaggatttgtgaacttcaaactctatcattcaataaatgtaaattatcctcctattctggatccacgtctggaagctttagctgctgagctctatgcattgtgccgatacatgtctgctggttccagaagaatgattgggaattcacaaactgacgaagtaatggaagataaggatgagaaaagtaaagctgaggaagtaattaaggaagagaaggttgtgaagaataaagcaagctcaaaagcagatgaatctgagctcagattagcacagcttcaacatcagctcccaaccaatgaacctggtgcactgatgaatcttgtagaagaatcaactgccgatgatgcagatgatgatgatactaaagattgtaaaggtttatttaagaacttaaagttctacttgagtcgagaggtgcctagggagtccctgttatttataattccagcgtttggagggactgtttcatgggaaggagaaggagctccatttaaagaaatagacgaagatatcactcaccagattgttgataggccgacacaaagccatgttttcctctccagggattatgttcaaccacagtgggtctttgattgtgtaaatgctcgtatcatattgccaacagaaggttatcttgttggaagagtacctccaccacatttgtctccttttgtggacaatgatgccgagggctacatgcctgagtatgcagagacaataaagaggctccaagctgctgctcgcaatgaggtgttgcctcttccaggtattggtgatgaagatctagacaattcactggtagcagcaatgatggatcgaacagcttctaacgaagctgctgaaaagaagaggaagctggagatgctagagaagcaatacatcgatgaactgaagaaggaaattgatggcgttgctttctctagtttgtcaaacaaggaagcagataaatcaccgaatgcaaaagatgatactcagtcagatcgtgaggaggatgccagtaaacaagaggaggatgatgatgatgatattggtactgctctcatgtctcgcaagcagagaggcctttataaggctatgaagatgggcaaagaaaagaaaaaggagaaagttgagctactcaagaagagaaaaaagaacgcggattctggcgcttcttccaagaagcggcactgatgtgtcacaaatcttcatcgcattggtgtgtcatctctagtagaaatgttaccatgatcagctctgcgtgccaatcccccatgatgggtgggttgccttttgatatctgctatgtatgcttaagatgagttcaaggatatgtaacatgaaacttgaatagaaaagttttgatctgtcttacgaagcatttagactcgttattattgtgaaacttgaatagaaaagttttgacctgtcttacgaagcatttatagttattattgagaagcctggataaaaaaa

SEQ ID NO: 923 - DNA, 2684 bp, Saccharomyces cerevisiae
  CDS (657)..(2474)
caaccgagcatcatattccttggtgtgcttttcaccttcgacaggtatgttatggagtttgttgatgaatgataattgcttggcaagtcgcatttgaatttctttaatatctgctccttccaagggaagacctgataaccgcaacaatttttttacagcttcagcagacggtggctctagtttttcctctttagtgtttatgcctaaatattcgtggacggaccatacaggtcttgataaataatcccttatttgattcatattttcaaattttttaccaatctttgcccctcccgtagatacgaaccgatgacttccatcatggcataacccacccactgtatgtgttctgcatagacgccatgttttgtacatcgttctagcactatgggtaagtgcaaatagttcgatctaaaagcctaaatgctagtcactattacctccttgatgttatatttacagaataatgtcatgtcgtctgtggtgactattattattgcctgaaaaaattaaagaaaattttttgcgatgagatgagatgagaaaaaatgaaaaattttggaaggttaattagagatgtgtagtaaatcctgctggtggaatacattttattcctgtagaaaatagtatagtaacagcggtatcctacttatacaatgagaatcaagaagaaaaacaccagaggtaacgcaagaaactttattaccagatctcaagctgtgagaaaattacaggtttctcttgctgatttcagaagattatgtatattcaaaggtatctatcctagagagccaagaaataaaaagaaggcaaacaagggctctactgcaccaactactttttactatgctaaggatattcaatatctaatgcatgagcccgttttggctaaatttagagaacacaagacttttgctaggaaactaacaagggctttgggtaggggagaagtctcttctgctaaaaggttagaggaaaacagagatagttatactttagaccatattatcaaggagcgttatccaagtttcccagatgctataagggatattgatgatgctttgaatatgttatttcttttctctaatttgccctctaccaaccaggtttcctcgaaaattatcaatgatgctcagaaaatctgtaatcaatggttagcctatgttgccaaggaacgcttggttcgtaaagtgtttgtatccattaaaggtgtttattatcaagccaatattaagggtgaagaagttagatggttagttccattcaagtttccagaaaacatccccagtgacgttgatttcagaattatgttgaccttcttagaattctactcgactctattgcatttcgtcctatataagttatacaccgatagtgggttgatttatccgccaaaattggatcttaaaaaggataaaatcataagtggtttgtcatcatatattctagaatccagacaagaagacagcctactaaaacttgacccaactgagattgaggaagacgtaaaagttgaaagtttggacgcatcgacattaaagtctgccttgaatgccgatgaggcaaatactgatgaaacagaaaaggaggaagaacaagaaaagaaacaagaaaaggaacaagaaaaggaacaaaatgaggaaacggaactagatactttcgaggataacaataagaacaagggtgacatcttaatacagccaagtaagtacgattctcctgttgcttctttgttttctgcatttgttttttacgttagcagagaagttccgatcgatattcttgagttcttgatcttatcttgtggtggtaatgtcatcagtgaagctgctatggaccaaattgaaaataagaaggatattgacatgtccaaggtcactcatcaaattgttgacaggccagttttgaaaaacaaggtagctggcagaacgtatattcagccacagtggatatttgattgtatcaataaaggcgaattggtacctgccaacaaatatcttccaggggaggctcttccacctcacttaagcccatggggtgatgctattggttacgatccaactgctcctgtcgaagaaggcgaagaagaagaaagtgaaagtgaaagtgaaagtgaagatcaagttgaggaggaagatcaagaagttgttgctggagaagaagatgatgacgatgacgaagagctacaagctcaaaaagagcttgaattggaagcacaaggtatcaaatattctgaaacttcagaagctgataaggatgtcaataagtcaaagaacaaaaagagaaaggtggatgaagaagaagaagaaaagaaattgaaaatgataatgatgagtaacaaacaaaagaaactttacaaaaaaatgaagtattctaatgctaaaaaggaggaacaagctgagaacttaaaaaagaaaaagaagcaaattgccaaacaaaaagctaaactgaataaactagattccaagaaatagttttctcttcttttccaatagcctctcaaaaattttgtcttttaatttaacatctttattactttataattcctcggtatagcaacattagatatataactacacatttttgtttgtagatatagaaatacctgtacattaaaagtggttactgttgttctgtataactatatgagtgaattttgtaaaaatatgcccaggtgccaatga

SEQ ID NO: 924 - DNA, 2311 bp, Zea mays
  CDS (228)..(1985)
ccacgcgtccgatttattaattaacaaagagaagacttcttccttcctcgtcgtctccagcccattccaattcttgattccatcgccccaccatccacaactcccctaatccttccaacctcctcgtcgtccagtccaccacctccacgcgcaatggccagcggctaggcggcaccaaccagatcacaaggattcgtttcatccggcagcgcagctctagagcctccatgggcagctacgcgtacaagtactgtatgtgcttcacgcgcaagttccgatccccggacgcccagccgccgccggacgtccgcgccgcccacctctccttcgcctctgacgcccatgccctccgccgcttcgtcgccggcgtccagggcgagtcccccgccgacgtcgaccgcatcctcgccatgctctccgggggccacagccatggaatcgcccgcctcgtcacaaggtcgccggcggcatccacgcccacgctcgaagacttcttcgccttcctcttctcccccgacctcaacccacccatcgcgcaccaggttcaccaggacatgtcagcgccgttctctcactatttcgtgttcaccgggcataattcctacctcactgggaaccagctcaatagtgactccagtgacgtcccaattgtaaaggcgttgcagagaggtgttagagtcattgaactcgatatgtggcccaatccttcaaaggacaatgtcgatattcttcatggagggacattgactgccccagtggaaatgatcaaatgtttgaagtccatcaaagaatacgccttctgtgcctcaaattatcctcttgttattactcttgaggatcacctcacatcagatctccaagctaaagttgctacgatgctcactgaaacatttggagatcttcttttcgtccctaatccagacccgatgaaagagtttccttctccagcatctctaatgaagagaataatcatatcaaccaaacctccacaagaatataaggagtttctcaaagccgagaataatcgcagtggcagcggaaacatagctgagttgccagaccaaggaagcctgagaagaatagattcaaatgccgatgaatctgatgggaaggatgaactggatgagcaagacgaggaagactccgacgaggacgatcccaaatttcagcaggatacagcctgtgagtataggaaactcatcaccatccaagctggcaaaccaaaaggccatttgcgggatgcgctaaaagtggatccagacaaagtcaggcggctttctttgagcgagacacagttagctaaagcgacaatctctcatggtgctgaagtcataaggttcacacagaagaatatactccgtgtgtatccaaagggcacgagggttaattcttcaaactacgatccaatgaacgcctggacccatggtgcgcagatggttgcgttcaacatgcagggccatgataaagcgctccggttgatgcaagggtttttcagagccaatgggggctgtggttatgttaaaaagcctgacttcttgctaagaacaggtccaaatggggaagtatttgaccccaaggctagtttgccagtgaagaaaaccctcaaggtgaaagtttatatgggagacgggtggcgcatggacttcagtaaaactcatttcgatgccttttcgcctccagatttctatactagggtagggatcgcaggtgtgaaggcagacagtgtgatgaagaagacaagggtgattgaggaccagtgggtgccgatgtgggatgaggagttcacgttccttctgacggttccggagctggccctcctgagggtagaggtccaggagtacgacatgtcggagaagcacgacttcggggggcagacagtcttgccggtatgggagctgaagcagggcatccgtgctgtgcccctgcacgatcgcaagggtgtcaggtacaagtccgtcaggctcctcatgcgatttgattttgtgtagccgagccgagccgccattcagattcagcttcttcttttttttcccttcttgtgtgaattgaatgtattactcccttccttccatcttcaacgtatatgtgtatgtatgtacttatttttgtcggaataaaagttgtatggaatggaatggaaggaaggagtagaactgtcttcaaactccagcttctagatctgtacgggtgattcagttttacttgctggcacattgtttgtttgtttactttactggagatagatttgcacattaaaaaaaaaaaaaaaaaaaaaaaaaaaaaaaaaaaaaaaaaaaaaaaaaaaaaaaag

SEQ ID NO: 925 - DNA, 2525 bp, Zea mays
  CDS (141)..(2282)
ccacgcgtccgggctccgtggcttttgcctgtcctgtggcagcgaatcggagagcggaggggaggggaaagcgcagcaacgccggcgagcgagcgggccgttcgaggatcgcaatgtgagcacgagcagggacacacaagatgcttcatcctagctgggtcggtgtctcggcacacgtctcggagtattggtctgtgataatcgccactgttgttttcgcatttgttggcgcggtgacaatttactatacagtcaatcagttgaacaagaacatcagcttgagcctgataagggctatcaaggccagggccaagaggtacaagaaatcgaaggacaaggtgcccgctgcatcccacatctggaggaaagaagttgtctcccgcagcaaaggcctgaaatgctgcgtgtgcttgaagtccgtttcacctcctcagtactctggggggaccatccatcagtgcgatatctgcggggccgctgcgcatccgagctgctcggggaatgcacacaaggattgcaagtgtgtatctatggctggtttgggccatgtgcttcaccagtgggctgtacaatggattgacagcgcggatcactctgaagaagactctttctgttgccactgtgatgaatcttgcaatggagctttccttgcaggctcaccagtttggtactgtatgtggtgtcagcgactggtgcatgttgattgtcacagcagcttggccaaggaaactggtgatatctgtgacttgggaccattgaaacgattgatattatcacctctttgtgttaaggagcttcattggacaggtgctgggattttgagttctatcacaaatggggctaatgaattggcttccagtgtccgagagacaattcggattcgtagtaaaaggtacaaaaggggtagcgcttctgctgattcagatagctctggggctattgagctaccatctgatgctgaaggagattcacaagaagtaaacagcaaagcaaaggtgagggatgatcatgccaattgcaaactcaatgaggtacaccaaagctctgaatcagagaaagataagcaacttgtaccagataacgcagcaacaaccaatatgtcagatgtacaacgtgaaaattctcatgtacagaacaatcagaagtacgaaattatcaatgtgccttctgattctaggccacttctagttttcattaacaagagaagtggggcacagagtggtgattcactgagacagcgtctgcaaattcttcttaatcctgtgcaggttttcgagttgagcaaacagcaaggtccagatgttggtttagctttatttcggaaggtaacccatttcagagttcttgtatgtggtggagatggcactgctggttgggttttggatgccattgagaaacagaagtttgaaaccccgcctcctgtagccatccttccagctggtactggtaatgatcttgcgagggttttatgttggggtggtggccttggtgttattgagaagcggggaggtctattctcagttttgcaagatgtagagcatgctgcagtcactgttcttgacagatggaagatcacaataaaggacaaccaagggaaacttatgagaccaccaaaatttatgaacaactactttggggttggctgtgatgcaaaggttgccttagatatacacaacctgagggaagagaaccctgaacggttttatagccagtttatgaacaaggtgctgtatgcaagagagggagcaaagaacataatggataacacatttgattgttttccttgggatgtcaagcttgagatagatggatccaaaattgatattcctcaggactccgaaggtatccttgttgccaatatcaggagttacatgggaggggttgacctttggaagaacgaggatgatgtctctgacacttacctccctcagtccatgcatgacaagaagctggaagttgttagcttcacaggaatgctgcatctcgggaaactgcaggttgggctttctcgtgcaaaaagattagcccaaggccatcatataaaggttgaagtcagtactacaatgccgatccaagttgatggagagccatggtcccaggagccgggaaccatagaggtttctcatcatagccaggccttcatgcttaagagagtctccgaagaaccgctgggtcatgccgcttcggtaatggccgacatcttggaaaacgctgagagcagtggcattatctcagccttgcagaagaggactttgctccaggagatagcgtctaggcttttgtaggacacagttctaacgccagtagttgtgtgtagctcaccctatagctctctcacgtcttcagcagccagaggcttgcttctgggctactagagaattgcgcctggtcgttgtacatacaccatcatggtattttaccctgattcggattgtgttgtgtatgattctgtaaaattttgtacaccctattgggtgagcacacactgacactgttgcggtcggaaaaaaaaaaaaaaaaaaaag

SEQ ID NO: 926 - DNA, 2025 bp, Zea mays
  CDS (116)..(1849)
ccacgcgtccgctttgccgggggaaaagaaaacaaccgccccgcccccgcccccgcccctacgagcacgacggcctccggatgagggtcctgccgcgtcttttaccgtcagctggatgtcaaatcacaacgcgccctgtgacatccccaagccggcctccgtcgacgagttcctcgccaagaatggcaagaagaagaagtccttcatgtcgggcctcttccgcaagaaagggaggggcgcggacaagaagctgctctcgcggcgggacatcgtcttcgatttggaaggcagaagcggcgacaggatggacctcttggagacgtccgccgctgtccgcaagagcttctcagatcggcactgcacgacgcggatcgagaacctgacgctgagctgcctggattctcccaggagacccaatgtcgacacccgggagtaccgggtgtttgtaggcacatggaacgtgggagggaagcctcctgacagcagcgttaacctccaagagtttctgcagatcgaaggcttgcccgatatatatgtcttggggtttcaggagatcgtgcctctgaacgcgggcaacgtgctggtcgtggaggacaacgagccggcgggcaagtggatggacctcatctaccaggccctgaacaggccgccgccccaccaggacggccagtcctccggcgacgagctctcgccgccgccgtccacctcctcctcccactaccccagccggccgcaaggtgccgcccgcgaccccagcaacgccgccgccatccccaagacctccagcggcggcatgctctgcgcgcagaagccgccgccgccgctcaagatggtcagcaagtgctaccgcgtcgacaacgcgctggtgaagacgtgcacctgcatgtccgacccgtccaccatgcagctccgggcgcgtgagatgcgcgagttcctctgccgcgtcgaggccgccgccgcctcgccgggccgcggcgccgacgacgacgcgctggcctccatcgaaggcggcgaccagaggggcggcggcggcggcatgaactactgcctcgtcgcgaggaagcagatggtcgggatcttcctgtcagtgtgggtgcgccgggagctagtgcagtacgtcggccacctccgggtcgactgcatcggccggggcatcatgggccgcctcgggaacaagggatgcatcgccatgagcatgacgctgcaccacacgagcatctgcttcgtgtgctgccacctggcgtccggcgagaaggaaggcgacgaggtgcggaggaactccgacgtcgccgagatcctcaagaacgcgcagttcccgcgcatctgcaaggtgcccggccagcgcgtccccgagaagatcattgaccacgaccggatcatctggcttggggatttgaattaccgagtctcgttgagctacgaggaaactaagacgctcctggaggataatgagtgggacatcttattggagaaagatcagctcgcgatggagagacaagccgggagagtgttcaaagggtggaaggagggcaagatctacttcgcccctacatacaagtacaagcagaactccgactcgtatctatgggagaccgccaaatcgaagaagaaacgacgaacgcccgcatggtgtgaccggatactgtggcacggccaaggcatcgagcagctgcagtacatcaggggcgagttcaggctctccgaccacaggccggtctgcagcgtgttcgtgatcgaagccgatgtagatagcgggagcaagatcaggaagggctactcaacgctggacgctaggatccactgcgagtcccccgagatacccaagagacacagcttctacgatgacttctgaaattttggcccgtgatgctagttttgtctataacatagcagcttacaaagatcaggcacgtttgtagcgaaaaggctcaggtttctcaagcctaacacctgtcttaatttgtaccaagcggtatactaactgaaagtcaatggtggttactgcacagaaaaaaaaaaaaaaag

SEQ ID NO: 927 - DNA, 1226 bp, Glycine max
  CDS (66)..(920)
tctcactcttcttgcagcatctctctccattaccttcataactcaatctcccattattattagagatgacggttgaaaaggaagatttgggtttgagtctaagcttgagcttccctcagaaccccccaactcatcttcatctcaatctcgtttcctcttctccttccagccacaaccctcagaaaccctcttggaacgaccctttcacttcttcagctggatcatcattccttcgaggaatcgatgtgaaccgtttaccttctgtggtcgattgcgaagaggaagcaggtgtgtcatctccaaacagcacggtttctagtgtcagtggaaaacgtagcgagagggaagaagccaatggtgaagaaaacgacacagacagagcttgttccagaggcatcatcagcgacgaagaagatgccgaaacctctagaaagaaacttagactctccaaagaccaatcaattatcctcgaagagagcttcaaagaacacaacactctcaaccccaaacaaaagttggcgctggcgaaacagctgggtcttcgagcgagacaagtggaggtgtggttccagaacagaagggcaaggaccaagctgaagcaaacggaagttgactgtgagtttttgaaaaggtgctgcgagaatctgaccgtggagaacaggaggttgcagaaggaagtgcaagagcttagagcactgaaactttccccgcagttctacatgcacatgaccccacccaccactctcaccatgtgcccctcgtgtgagcgtgtcgcggttcccccctcctccgccgttgatcctgccatgcgtcaccatcacgtgcctcctacacaacctcgggccttccccattggcccatgggccaccgctgccgccactatcccgcacaggcccttcgatgccctccgtcgcagatcttgactcgtcgaaacaaaatgacaaaatttgaaaaaaagaaaacggttgtaatagtaggaagccatgaattatgtgttcaaagtgtggtctaagatatggtggttaggaaaactgattttgtgggtctctaatgttttgtactagtttgacccttcgtctttgttttgggtttcggagcatgacctggtttagttagttagaggtttttttagtttgtaatacttactgcgttactctcatttctcatgattaaatcggagattctgtaaagttcagtagtcttaataaatattatatattacatat

SEQ ID NO: 928 - DNA, 795 bp, Glycine max
  CDS (98)..(622)
atcactttgtcccttttcatacattcacatattcattttgccacaccttaaaaccaagcacccggccatatttcaatttttgttttggttagttgtcatgaagagagaaagagaggttgatagcttaaccatggcgaattgtttgatgttgctttctcgtggaagtgaatttgaggccacctactcaagcacttctatgagcaatcgtgtctttgagtgcaagacatgtaataggcaattcccttcatttcaagcacttggtggccacagggctagccacaaaaagcctaggttgatggcaggagatatcgaaggccaattgcttcatgattcacccccaaagcctaagactcatgagtgttccatttgtgggttggagtttgctatagggcaagccttgggaggtcacatgaggaggcacagagcggcgaatttgaatggaaacgtgcacaattctacggctacgagtagtagtagtgggggtagcagttttgattcatcgccaaagaagaaagctgacaacaagagagttttggttttggatttgaatctgacaccctttgagaatgatttggagtttttgaagattggaaaaccaaccacttttgttgattatttgtattgattgatctgttgagtgtactgttaattaaacttaggaaggtatagtttgtgtatcatagataggtgaatgctttgtttttttaatctaccgtctatatttgtttatcatactgtatgaaaaattgctcatttcttgggcaaaattagaacttcatcatgatattctgagtc

SEQ ID NO: 929 - DNA, 1329 bp, Glycine max
  CDS (82)..(1053)
gcgggaacaacaacaactgaagaaagagagagagagagagagagagaggtgtgaagttggtgaaggtttttgagaagaaagatggaacgaagtggcggaatggtaactgggtcgcatgaaaggaacgaacttgttagagttagacacggctctgatagtaggtctaaacccttgaagaatttgaatggtcagagttgtcaaatatgtggtgataccattggattaacggctactggtgatgtctttgtcgcttgtcatgagtgtggcttcccactttgtcattcttgttacgagtatgagctgaaacatatgagccagtcttgtccccagtgcaagactgcattcacaagtcaccaagagggtgctgaagtggagggagatgatgatgatgaagacgatgctgatgatctagataatgagatcaactatggccaaggaaacagttccaaggcggggatgctatgggaagaagatgctgacctctcttcatcttctggacatgattctcaaataccaaacccccatctagcaaacgggcaaccgatgtctggtgagtttccatgtgctacttctgatgctcaatctatgcaaactacatctataggtcaatccgaaaaggttcactcactttcatatgctgatccaaagcaaccaggtcctgagagtgatgaagagataagaagagtgccagagattggaggtgaaagtgccggaacttcggcctctcagccagatgccggttcaaatgctggtacagagcgtgttcaggggacaggggagggtcagaagaagagagggagaagcccagctgataaagaaagtaaacggctaaagaggctactgaggaaccgagtttcagctcagcaagcaagggagaggaagaaggcatacttgattgatttggaaacaagagtcaaagacttagagaagaagaactcagagctcaaagaaagactttccactttgcagaatgagaaccaaatgcttagacaaatattgaagaacacaacagcaagcaggagagggagcaataatggtaccaataatgctgagtgaacataatgtcaaaagatggcagagaaaacttatagatggaatagatttagaaagagagaatacattagccagaaagagaaaaaaaaattggacattagttgatgattctttctaggtgtgcgtttggaatacaatgaagtaaaggatgaaccttaagacatgctttatcctaaaatagtgtgatctgatattccattgttaatgagtaatgtaattatcatacaaacaatttgtagtctcattttaattaataattattaaactacttgatta

SEQ ID NO: 930 - DNA, 1198 bp, Zea mays
  CDS (225)..(842)
cgctgccacatctctcctcgtccaaagactccaagctcctgtgcggcctgtgttctgctgccgcctctggtccacatctccccgccgccgccccgtcgtctgccgacacctttagcgctgggaaggatcacaggggatcggcgcgaggcgggggacctgcggtttttgtcgcccggatggcggcggagcgatgacactggcgtcgggagcggcgcggcgttgggatgcggacgatctgcgatgtgtgcgagagcgcaccggcggtgctcttctgtgcggccgacgaggcagcgctttgccggccctgcgacgagaaggtacacatgtgtaacaagcttgctagtcggcatgtgagagttggacttgcagaccctaataaacttgtccggtgtgatatatgtgaaaattcacccgctttcttctactgtgagatagacggcacctcactttgcctgagctgtgatatgactgttcatgttggtggcaagcgaacccatggaagatacctgctcctaaggcaaagggttgaatttccaggagataaaccgggccatatggatgacgtgcctatggaaatccaagatcctgaaaaccagagagaccagaaaaagccacccaaggagcaaacggcaaaccaccataacggcgatgatccggccactgatggcaactgtgatgaccagggtaacattgattcaaaaatgatcgatcttaatatgcgcccggttcgtactcatgggcaagaatcaaattcccagactcagggggtaggtcttagtgtgaacaaccatgactctccaggggtggtgccaacaagcaattccgaaagagacaccagcaagtaaacgttggaagatcggaatatacatttcaactacatatactgttctatacgagttcattttgtggtgtgtgtgtgtgtcactaatttttactcaattctaaattataagtcattctaacttttttgaagaggtaaagtatctcaggtttgactaaaattgtagaggtaatcacagatttatgacatcaactaggtatattttaaaaatataattaattaaaacactaataatacttatttggtatcatgaatgtgattgttttattatataaatttgatcaaacttgagatgctttggctctcttaagaaaattagaatgtactagtaagtatatttttggcagagttgtagct

SEQ ID NO: 931 - DNA, 1178 bp, Glycine max
  CDS (227)..(928)
ggctcgagctcgagccgccaaaaccacccaacactcgaactcaatatccattattaccaaaaaaaaagaaaaaaggatatcaaacacccttttcatcattaaaactctcagttccctctttccctatcaaaaccctttcccacaacactactcactccagtacaagaaaccctttttcaatttggtttcaacagcacacacacacacacatatatatatatatagcatgtttaccttgaatcattcttctgatttgtaccatgtttcccctgagctctcatcttccttggacacatcctcgccggcttcggagggctctcgtggcgtggcattttccgacgaggaggtgcggctggcggtgaggcacccgaagaagcgggcaggtcggaagaagttccgggagacgcgccacccggtgtaccggggggtgaggaggaggaactcggataagtgggtgtgtgaggtgagggagcccaacaagaagaccaggatttggctggggactttccccacgccggagatggcggctcgggcgcacgacgtggcggcaatggccctgaggggccggtatgcctgtctaaactttgctgactcggcctggcggttacctgttcccgccacggccgaggcaaaggatatacagaaggcagcagcagaagctgcccaggctttcagaccagatcaaaccttaaaaaatgctaatacaaggcaggagtgtgtggaggcggtggcggtggcggtggcggagacaacaacggcgacggcacaaggggtgttttatatggaggaagaagagcaggtgttggatatgcctgagttgcttaggaatatggtgctcatgtccccaacacattgcttagggtatgagtatgaagatgctgacttggatgcccaagatgctgaggtgtcactatggaatttctcaatttaataatgtgttttggtttggtttttgttgttagttttttggagtgaacagtgtctgtactggttttttattagtagtacggatactagttataggtggaaagattgcgagggaccaaaaggaattttcttttgaacccttttttgtcaatgtaatcaatatcacgtatatcatgaagtgaatcccttcaaaaaaaaaaaaaaaaaaaaaaaaaaaaaaaaaaaaaaaaaaaaaaaaaaaaaaaaaaaaa

SEQ ID NO: 932 - DNA, 2439 bp, Glycine max
  CDS (27)..(2060)
gaattcggctcgaggtgccggctgtgatgcaggcgacgcagggggaacagagcaacaatgcctccgctgttcattgggagcgctttctgcctcggatggtgcttcgggtcttgcttgtcgaagctgatgattctactcgacagatcattgctgcacttctccgtaaatgcggttacaaagttgttgcattttgtgatggcttaaaggcatgggagacattgaagaacaaagcatttgacttagatctcatattaacagaagtggatttgccatcaatatctggattttcacttcttactttaatcatggagcatgacatttgcaaaaacattcctgtcataatgatgtcttctcatgattcagtaagcatggtgtttaaatgcatgttaaaaggtgcagctgattttcttataaaacctgttcgcaagaatgagctaagaaacttgtggcagcatgtatggagaaggcacgccataagcaggcctcctcaaaatttaacactgccggagattgaacttggttttgctgcagaaaaccatgctgcaagcaatgactctagtggttctgtggcttctacaccaaaagatgatgaatgcagtgagaaaacaagtgaggctcatagcacttgcccatcgccatttttggaagctgagagtacctacatggaaaatatgcaggatatattgcagctgaagagctcttcaaatttgagcaatattgacacagtgaagcatgaaaactctaccaaatgtgaaagggagtcagataagcataatgatgaagctggagagaaatcactgtttatattggaagatgcaaggtgcaacaaaacttttaaaccaacaggtttaaggctaggtcaaagctatgagtgccatgaaacgagaaatcaagatgaagttctaagaatagagttgataaaatccaatcctgaaattaatacagatattcatagatgcagtgatgaactggtagatccttctactggcgccattgacttgattgctacattcaagaatcttccaaagagcactgatgaaaaatgtagtttcagtagtggtaacactgccaagtttgattttgatacacaattggaactttctttaagaagagattttcctggaagctcatgtaaagctgcattcaaggaaaggcaaatattgaaccattcaaatgcttctgccttttctaggtatagtaatagtaagttgttgcagcccctttttccaacaccatcaactatctctgctaaattaaccaatgccagtcagaattctcatgaatcccttaaattatcaaaaaatacatctacttctcatcaatatagtgaaaaaagtcaaaatcaggaggagaaaatcatcacttcagtcattggtcagtctggacaagttgatccaaaattaccaaacagtcaacttggattgtttcctgctacaggggttacttctgatcacaagtctaaaggaaatggaaatgtcttcccttctaagctttatgcaaaatcaggtgtccatcccatatcgactccaaaatcagtgtgccagaaagagagttctccatttcccacaagcacttcctcccagtccaatcctcaaagtcacaactcagaacgtcatcactggttggaagatgcaacccatgcttctgatcaaaatgtaaatgatcaaagcaatttggaatgtgagacacatgactctcctgctgctagtcagagtgctggtcctagttttttccatgacacagcaaatcataatagtagtggtgtatacagaagtgatggaaatgctacttcagctaaggtagccaaggagagccatgaaatttttattgatagtggtcaacgcagttatgatggattcatagggacagattctcatcgcactagccaacgagaagcagctctaacaaagtttcgactgaagcggaaagacagatgctatgagaaaaaggtgcgatatcaaagccggaagagattggcagagcagcgccctcgcgtgaaagggcaatttgttcgccaagtacacgatgatcatccagtagcagatgtgggtggtggttcctgaaattgttttgttaccatcatcattgaattacagtctgacttccaaaactgatttgcctctcttgacaaggattaactgtaggatctagtttgtctggtgaaattatgtttcttcttagcattgttagtattttcttctggtttgttatattggctgtctcttagaatgtaggattgtaattatttagtaggattgatttgaagttttgattttacctagagtatttgttttcttgattgaatactaatatagggctatcgttgtataggcagtatgcgtctgtcttgaaagattcaaataccttttatatatatatatatatatctcggcaagcatctctggtttgcaatcaaaaaaaaaaaaaaagggcggccgc

SEQ ID NO: 933 - DNA, 1447 bp, Glycine max
  CDS (108)..(1229)
gaattcggctcgaggtcgctaatcctagttccttcaactcctcgctggcaacaacagcagtactaccattagccgcgtttttcaaaagtgattttcgagaattagcgatgggaattgaaagaggaggcttcaagggattcaggagcgcctggagcgtgccgcccaagccgtgcgattcctgcaagctggcctcggcggcgcttttctgccgccccgattccgcgtttctctgcatcgcctgcgattccaacattcactgctcgaacaaactcgcgtcgcgccacgagcgcgtgtggatgtgtgaggtgtgcgagcaggcacccgctgctgtcacgtgcaaggccgacgccgccgccctctgcgtcacgtgtgactccgacatccactccgcgaaccccctcgcgcaacgccacgagcgcgtccccgtggaacctttctttgactccgctgagtccatagtgaaagcctctgctgccgccaccttcgggttcattgtcccatccgacgacggcggcgcctccgacgctttcgcccccgatgactccgacgccgccgcgtggctcatcccgaaccctaatttcgggtccaagctcatggacgcccccgaaatcaagtccaaggagatattcttctctgaaatggaccccttcctcgattttgattactcaaactccttccaaaacaacaacagcgccggaaacgacagcgtcgttccagttcaaaaaccctctctcgcccctcccctaatcaataatcaccaccaccaccaatcagaaacttgcttcgacgtcgatttttgtcgctcgaagctctcctcctttaactacccttccaattctcttagccaaagcgtttcgtcgtcgtcgcttgatgttggagtggtgccggacgggaatacggtgtcagacatgtcgtattcttttggtcggaacagttcggattcgagtgggattgttgttgtgtcaggaaatagtgtggggcaaggtgcgacgcagttgtgtggaatggatcgggaagcgagggtactgcgatacagagagaaaaggaagaaccgaaaattcgagaagacaattcgatacgcatcgcgaaaagcatatgcggaaacccggcccaggataaaaggccgcttcgccaaacgaacagaaattgactcggatgtggagcgtctctatagccctggccctgcggtgctcatgctggacactccatacggcgtcgtaccatcgttttagttaatttcaaaatgaagaaacgatggagtgcatgaatcttagaataatgattagcgattctgtgggattgttaggggaaaaaggtgaagaatcgaatcggtacgaacgtgattcttagctggagcgcgatgggggaagattattgtgaagatttgtctcgatcgaccagaaaagcccgtttactttttataaaaaaaaaaaaaaagggcggccgc

SEQ ID NO: 934 - DNA, 2007 bp, Glycine max
  CDS (23)..(1762)
aaaaaaccaactacatcagctcatggcaacccccaaccccaccagattctcccttgccatggagagaaccgggcaatgggttttctccccagaaatccccaccgatgttattgttgcagttggacaaaccaatttttctctccacaagtttattctggcggcgaagagtaactacgtcagaaaagtgataatggaatcagaggagagtgacctaacaagaatagagatttccgacatacctggaggatcagaagcttttgagaaagcggcgaagttctgttacggcgttaacttcgagatcacggttcacaacgtggcggcgctgcactgcgccgctgtgttcctccagatgaccgacgagtattgcgacggaaacctcgccggaaggacggaggattttctctctcaggtcggcctctccacgctccacagcgccgtcgcggttctcaaatcctgccaaaagattctccccttcgccgccgaggtcaacgtcgttgaccgctgcgttgaggtcatcagctgcaaggcttgcaacgaggcgaattttccgagccagtcgccgccgaactggtggacggaagagctcgccgtgctcgacgtggattccttcgcgaaggtgatcgccgcgatgaagcagcgtggcgcgaagtacctaaccgtcgccggagctttgattacgtacaccgaacgcgcgctgagggagctcgtcagggatcactccggcggcggaagaggaatccggtcaccggaatccggagactccgattcggagtcgaaaagaagcgaacagcgcgagcttctgcaggctatcgttcctctctttccgacggagaaagccgcgtttccgatcaacttcctctgctgcctcttgcggtgtgcgatctacctccgcgcgtcgagcgcgtgcaagcgcgagctggagaagcgcgtgacggagattctcgagcacgtgaccgtcgacgacctcctcgtgctcacgttctcctacgacggcgagaggctcttggatctggacagcgtgaggagaattatctccggttttgtggagagggagaagggcacgacggtgttcaacgccggcgtcaacttcaacgaggacttctccgccgcgatgcagcgcgtggccaaaaccgtcgactcgtacctcgctgagatcgccgcgtacgccgaactctccatctcgaaattcaacggcatcgccatcctcattcccaaaggcgcgagaaaatccgacgacgatctataccgcgccgtcgatatctacctcaaggtgcacccgaacctggacgagatagagaaggagaaagtgtgcagtgtattggacacgttaaaactgtcctacgaggcgcgtgtgcacgcgtcgaagaacaagcgtttgccgctacagatcgtgcttcacgcgctgtactacgaccaactacaaataaggagcggtacggcggcggacaagcaagctgtggtggcggcggcggagaaaaaacagctgcaagctgacgtgtccttggtgagggagaacgaggagctgcggtcggagctgatgaagatgaaaatgttcatttccgatttgcagaagaatgttcacggaacgtcgtcgtctgggagggagaatattgggcccactaaaaagcccacgttcttctcgtccatgtccaagaaactgagcaagttgaacccgttcaagaatgggtctaaggacacgtcacacatcgacgatgcccctgtggacttgaccaagcccagaaagagaaggttctccatttcctagatttgctttccttagtcaattccaagctttgtcaaaaagaattttaaattttttgaagtaattacgttttctctcttgattgttaattttttttcatgaaagtgtcaatttgtaattaagaaaaaagtgagacgtgattggatttcttaaattagatttgttcatatctgtatgttaagatgtatttgatctggatatataggaacatcctagtttcaatatgaattaatgagaattataat

SEQ ID NO: 935 - DNA, 1318 bp, Zea mays
  CDS (34)..(1101)
ccagcgtccgaattaacaaatcacactgctttaatggggcgatcgccatgctgtgagaagattggactgaagaaaggcccgtggacaccggaggaggatcagaagctgcttgcctacattcaggagcacggacatgggagttggcgagcattgcctgtgaaggcgggcttgcagaggtgtgggaagagctgcagactgaggtggacaaactacctgagaccggacatcaagaggggcaagttcagcttgcaagaagagcagaccatcatccagcttcatgctcttttaggcaacaggtggtcggccattgcaacccatctaccaaatcgcacggacaatgagatcaagaactactggaacacacacctcaagaaaaggctggccaagatggggatcgatcctgtcacccacaaatctatcagtggcactcgcattggcaccacaaacgacaaatcaaccaaggccgccgcaagcctcagccacatggcacaatgggagagcgcccgcctcgaggctgaggcacggctggctcgagaatcgaagatacggacagcaacgccaacaccaactgctctccatgcgcagccaacgatactacctgcctctgctgcttctccatgccttgacgtgcttcatgcatggcagggtgcaaagatagacctggagtctccaacctccacgctgacgtttacagggagtaatagtggaacgctgccaacccccaggaccaatagactagacgtatcagaaagcaactgtgcagtgtggcatcagaggagtgatgacttggaggatgaagaaaacgattggcagatcttcagcaagcaccaattgctggaactcgacagcaaggagagggaagaggacttcattggttgtgaggagccgtggttctcagagatggctggggttggagctggcttcactggcatgctgcttggtgtatccaatgagcatgatgcatcagaatgctggggtgagtccaataatggccaaactgagcgcagcaaccaagcatcagatgaggaggacaagaattattggaatggtgtccttgacatggtaaactcagagctgacacccaagtcgcctccatttgtctagactctagaatacagtcccctccgttttatttcaagtactcctgagcaaaatctattggatcatctcaagtcaaaagagaaacagaacaagcactacaaataaatgctgcatgtgctacaacaatatgttttttttgtccatgcatgtgaaagtgaaataattaactattgtgtggatggagtaaaaaaaaaaaaaaaaaaaaaaaaaaaaaaag

SEQ ID NO: 936 - DNA, 1161 bp, Arabidopsis thaliana
  CDS (274)..(1017)
gtcgacccacgcgtccgaaacaaagcaacaagcaagattcatcaaatccttatcttctctctttcactcacaaccaattgctcatcccacctacttgttccccacaaaacactctctccctctttgttctttcatcttctctaagctctttctctgaacctacgcttctgctaagctattctaagagaagccagactagcaataaacccttcattttaagcattctgtttccttcttgagaaacctagatattttggtttcttgtatccggtgatgaagatacagtgtgatgtgtgtgagaaagctccggcgacggtgatttgttgcgccgacgaagctgctctctgtcctcaatgcgacatcgagattcacgccgctaacaaactcgctagcaagcaccaacgtcttcatcttaattccctctccaccaaattccctcgttgcgatatctgccaagagaaggcagctttcattttctgtgtagaggatagagctctgctttgcagggactgcgatgaatccatccacgtggctaattctcgatctgctaatcaccagaggttcttagccactgggatcaaagtagctctgacctcaactatatgtagtaaagaaattgagaagaatcaacctgagccttccaacaaccaacagaaggctaatcagattcctgctaaatccacaagccagcagcaacaacaaccttcttctgctactccacttccctgggctgttgacgatttctttcacttctctgatattgaatccaccgacaagaaaggacagcttgatcttggggcaggggagttggattggttttcagacatgggattcttcggtgatcagattaatgacaaggctcttcctgcagctgaagttcctgagctttctgtttcgcatttaggtcatgttcattcatacaaacctatgaagtcaaatgtttcacacaagaagccgaggtttgagaccagatatgatgatgatgatgaggaacacttcattgtccctgatcttggctaaaaagctatatgtaatctatgtgtagacattcttcaatgtaaaagaacaaacaagaaacctatctgcatgtgtggagttaatgtcatatacattttagttttgtcttaaaaaaaaaaaaaaaaaaaaaaaaagggcggccgc

SEQ ID NO: 937 - DNA, 1770 bp, Glycine max
  CDS (98)..(1555)
ccacgcgtccgagataatcggaatttagtagttagttcggtttttagttacttaaccgcttaacgatataaataaataaataaaaagaagcgcgacgatgttagatcttaatctcaatgcggagtggaccgattcgtttagtaacggtgagtcgccgttaccgttagagaagtttccagacggtttgaggaaccaaatggccgagtcagggacttcgaattcctccgtggtgaatgcggacgggtccagtaacggcggcggcgacgaggactcggactccacacgagctgctgatgacgtgtacaccactttcaatttcgatatccttaaagtcgaaggcgcgaacggcttcgtaacgaaggagctctttccggtgatgagtgaaggagctaaaggacacgctacgtcgtcgttttcagggacgaatggtttcgtggatctctcgttcgatggcgatggagggaacactagtgagatgaagatgcttcagcctcagaatcagaatcagactcaaacgcgaactcagacacagcaaccagcgaaaaagagtaggagaggaccgaggtctcgaagctcgcaatacagaggggttactttttacagaaggacgggaagatgggaatcgcatatctgggattgcgggaaacaagtctatttgggtggatttgacacggctcatgctgctgccagagcctatgatcgagccgctattaagttcaggggagttgatgctgatatcaatttcaatctgagtgattatgaggatgaccttaaacagatgcagaatttgtccaaggaggaattcgtacatatactgcgtcgccaaagtactggtttctcaagaggaagctctaaataccgaggagtaacactccacaagtgtggccggtgggaagctcgaatgggacaatttcttggcaaaaagtatatatatcttggactattcgacagcgaagtagaagctgcaagggcttatgacaaggcagctatcaaatgcaacggaagggaagcagtgaccaactttgagccaagtacttatgaaggagagctgaaatctgcagccattaatgaaggaggcagtcagaatcttgatctcaatttgggcatagcaaccccaggacctcccaaagaaaattgggggcaacttcagttcccctccttcccttacaatacacatggtggaagaagttcaatgatggaaaccaatgttagttctggaattggtaatccatctttgaaaaggatggttgcaactgaagatcgtccttcattatggaatggcatgtctcctaatttctttcccaatggggaaagagcagagagaatcggcgttgatccttcaaacggactccccaactgggcgtggcaaacacatggccaggtcaatgctaccccagtaccaacgttctctgctgcagcatcatcaggattctcaatttcagctacctttccatcggctgccatctttccaacaagttctatgaactcaattccccagagtctctgttttacttcatccagcatgcctacccgcaatgcatctgaatattattactaggttaagcccccacaggcaccaccatagctgattttgcagtacagattaaagacaaactaaaacaaaagtgttttcggtccaaattctttttataattcagccactgattggtgtatactgagattcgacaccttattgctgtctcttgcttaaactataatgccccatgtttggatacatcatctttgaagcaaacaaaaaaaaaaaaaaag

SEQ ID NO: 938 - DNA, 3159 bp, Glycine max
  CDS (626)..(2875)
cgtttcagcaaaacctctcttcttcttctgattgattccacctcgcgatttttcgattttcgtttgttttcttctttttcggtttctgatctgaactcgattcgattcgctattgccggaaaatgagtcctccggcaagtgtccggtgatgatcgctccctcgagaggttgttgaggttatcgttgttgttcttcgaagtcatggtttcgatctgaggtgctgtcagtgctcacagcgcgacgctgttgagttgaaatttcgctggttttgagttgctttgtgactaattttttttctcggcaaccaaacaggaggattcaaaatttgcactgattaattagtaaagttttggcgctctcgagttcgttttggtgaggattctgattaaggaaaattttcttttattcattcggaggagaagcgtctcaaactctctctctttctccctcgtagcatcatcatcatcaccataccttgttcagattctgctcactttcaccacaacggctttactatttaccgcgtttcgttttcgtgtcaccgcaaataatgaaaggaggtgttccctgtatccactcctcgtcagggaagatctgaagcagtgctagctgctcacgtcctgtaatggacgcatactcctccggcgaagaagtggttgttaagactagaaaaccatatacaatcactaagcaaagggaacgatggacagaggaggagcataataggtttctagaagctttgaaactacacgggcgagcatggcagcgcatagaagagcatataggaacaaagactgccgtgcaaataaggagtcatgcacagaagttctttacaaagctggagaaagaggcccttgtaaagggtgttccaattggacaggctcttgatatagacattccccctccacggcccaaaagaaagccaaacaatccttatcctcggaagaccaggattggtaccacatcattacatagtggagcaaaggatggaaaactcaatttagttgaatcttcacatgttaatcaagcactggacttgaaaaaagaaccacttccagagaaacatgatttagacgaagggctaacaactgtaaaagaaaataaggatgagaaccacgcaaaagtatttactcttctccaggaggtaccctgttcctctgtatcttcagcaaatgagagttcaataacaatgtctgtgccactgggaaatccatgtgccttcaaggagattacaccttccgtgaaagaggtaatagcacgagatgaaaaaactgaatcttttgtcactgttgaacctgaaaatgggaagttggagatcaatgatggaaaacagactaatggcactagtaaagactccaggttagaggattctgatgctttacatatgaaattggttcaaaatgagaaaccagatggtcttgattgtgaattaacaatagatgggatgcaaggcaatcagaattaccctaggcatgttactgtgcacgttgttgatgggaaccttggaacaaatactcaaaatccatcacaagatatgttgtttcgagattccatgtttcagccaataggaggggttaacgggcaacgaaatgtttttaccaatacagctccatcgaacacaagtgaaagtcaaaataacactgcacgatcttctgttcatcaatcatttcttccttatcctcccttcacacaacacaaccaagacgattaccaatcatttcttcacatgtcttcaacattttcaaatcttattgtctctaccttgatgcaaaacccagcagctcatgctgctgcaagtttcgctgctacattttggccgtatgcaaatccagaaacttcagcaaattctcctaggtgctcccaaggaggttttacaaatagacaaattggttcccctccaagcgttgcagctattgcagctgctactgtagcagctgcaactgcatggtgggcagctcatggattgcttcctttgtgtgctcctcttcatacttcttttgcctgtcctgcatcagtgactacagttccatcaatgaataccggtgaagcaccggctctgaaggcagagcaagaaaaaactactctacaaaatcctcctcttcaagatcagatgctggatccagaatactcggaagctcaacaagctcaacattcagcttcaaagtcaccagctgccattttatcagattctgagagtggagatgccaagttaaatacttcatcaaaggttactgatcatgagacgaacaaaacaatttctgagcaccttgattccaacaaaacaaagggaagaaaaccggttgaccgttcctcatgtggttccaacacggcctctagcagcgatgtggaaactgatgcactagagaagggtgagaaagggaaggaagagcctgaaatacctgatgctaaccaattagccattgagtttagtaatcgtcgtagaagcgttagcaaccttactgattcttggaaagaggtttctgaagaggggagactggcctttcaggctctgttctccagagaggtgttgcctcaaagcttttcacctcctcatgctttgaagaatacggatcatcaaatggacaacgccaatgataacaagcaaaacatagatgacaaagatgaagatcttgacggcagcaagaaatgcagttctaattatgaagcgatgcagaaaaacctgctatttgtagaaaataacgagggactgttaaccatagggcttggacaaggaaagcttaagactcatcgaacaggttttaaaccctacaaaagatgttccatggaggccaaggaaaatagggttggagcaagcagcaatcaaggtgaagagcaaggttgtaagagaatacgtttggaaggggagacttcgacttgaggttcgatatatgcagtaacataaaggcaacctttggtttttgcatatcatttctttatccctccaacggtgtacctatattgtatgtttatttctaattctgcagctcacgaaacttgtcgtgtagatgtgtgtaccgtattaaattactgtgtacgctcttttactatctttgtatgatgttaatgctgtttaaaactccgctaaatagacttagataagaaacattaagtattgtttgagccatgaacatcaagtaatttatgatccttcattcagcc

SEQ ID NO: 939 - DNA, 1716 bp, Glycine max
  CDS (139)..(1416)
aaaaaaaatttgattattattattgattttatttaactgttgttgttgttgttggagggtgatcgtagtttatgagtgagtgaggttaatggaatgtgaagagtgacgggacggtgatgatagtattgttacgcgtgtatggaattcgatgccgcgattcccgtttctcgagagcacctccctcaagatgcaatgtggcaaattaacttgaggtcaagtgaaacaatggaatcagaaccttatcctgagcatccaggagaaccagattgttcatactacattaggactggcctttgtagatttggagcaacatgtcgatttaatcatcctcctaacaggaagctggctattgccgctgcaaggatgaaaggtgaattcccagaaaggataggacagccagaatgccagtactatttgaagacaggaacttgcaaatttggagccacatgcaggtttcatcatcctagagacaaggctgggattgctggaagagttgccttgaatattttaggctatcctctccgcccaaatgaaccagaatgtggttattatttaagaactggacaatgtaaatttgggaacacttgcaaatttcaccatcctcaaccaaacaatatggtgctttccatgcgaagttctcctgtttatcctactgtccattctccaactacaccaggtcaccagtcatatgcgacaggaattacaaattggtctagttcatcgtatattcctagcccacgttggcaaggcccttcaagttatgcacctttaattctacctcagggaatggtttcagtgtctgggtggagtgcatacagtggtcaaatgggatcagacagtccacagcaaacaatggcaaatggccaaagctatggaacttctcgacaaagtgaaccagcaaattcaggatcccagggggcatattctcaatttcgttctggctctgttcctgtagggttctatgcgttgcagagggagaacatatttcctgagagacctgatcagcctgaatgtcaattctacatgaagactggagattgcaagtttggtgcagtctgtcgtttccatcatccacatgaaaggatgattcctgctcctgactgtgttttgagtcctataggtcttcctttacgtcctggagagcccctgtgtgtgttctattcacgttatggcatatgcaaatttggtccaagttgcaagtttgatcacccaatgggagtcttcacctataacatgtctgcatcacctttagctgatgccccaggacggcgtatgttaggttcttcatcaggaacttctgcattaaatttatcatcagaaggacttgttgagtcaggctcagaaaatccaaggaggctttcattatcagaaactcgacagataccttctggtgatgataacattgatgaagagggataatgatgtctcttggaaatgggtcatttgcttgttacaaatttttttcaggggagaaaaagggtaatctgtaaattgattttcccattgctgaagatgtacagactacagagttcatgtcaagctgattctgtcaaacctgctatttaatgcagttgagagattcagttgttctgaatttcatgctgtcacattgtataaattttacaaatatttgtcacatttggtgaaaacccaatgtgaacatttcttcagtctatctatttaatgttttcctaatatgtaaaaagtgtttttctg

SEQ ID NO: 940 - DNA, 1909 bp, Glycine max
  CDS (73)..(1764)
attcggctcgagctacactttcgagttcgaactaaagaaaaaacagtaaagaaagaagaagaaaaaaaaaagatggtttcgtcagtttcgtgggtgagaggcaagtgcgtcggtaagggcgcgtttggggttgtcaacgtggcggtttcgaaaagagataatcgcgttttcgcggtgaagtccgtggattgcggaagggggctttctggtcaggtggaggcgttggagaacgagattgggattctgaaacgagttacctcgccgcacgtggtggcttatatcggcgacgatgtcacgtgcgagggaacggcgtcgttcaggaaccttcatttggagtacatgccaggtggcaccgtcgctgatttggaccgcgctgacgtggacgagcggttagtgaggcgctacgcgtggtgcctcgcgaccgcgctgcgtgacgtccacgcgcaaggcttcgtccactgcgacgtgaaagggaggaacgtgcttctctccggcgacggcgaaatggcgaagctcgccgacttcggcgcggcggtggaaattgaatcctctccggcgatgttgctgttcccgcgggggagtccgatgtggatggcgcccgaggtggtgcgccgggagcggcaggggccggagtccgacgtgtggtcgctcggatgcacggtgatcgagattgccatcgggaaaccggcgtgggaggaccgcggcgtcgacacgctgagtcgaatcggttactcggacgagttgccggaatttccaatccagttgtcggagctagggaaggattttctcgagaagtgtcttagaagagaaccgagtgaacggtggagttgcgatcagttgcttcagcatccatatttgcttccctactacgcccttgttgaatcgtcgcctcggtgcgttctcgaccgggttgactcggagttgaattccgagtcagattataacgaccgtgatcatcaagaagaggtgttttcaatatttactaacatcgaagaaaattcagttattaaaaatagaataagtaaattagcgacagagtcgagggtaaattgggaaacacatggttgggtagtggtgagggaagttgagtccaacggagaaccaacgacaacgggaacagaggaagaaggagcgtgtacgtgtgagcgtgatggtgttggttccaacaaagaaggggtaaattgggaatttcacaatgtggcagagactggtatggtatattcggattctgtaggggcaaatcggagaataagaaagtttggtgggagtaacaccgctggagggggtgttggttgttgctgtcggtatgggtgtggatgggaaaagttgggtaggaatagaggaataatcagcatttacagcttgtattgtaaaaatttcatgtcgtataatttaatattcttaatgtatatcaatatattatgcttttcgattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggccccccccatttagggccttccccccccggaaattaatttgggcccggcccctggggggcacccattttttttttaaggagggccttaaaaaattgggggaaaaaagggaaaaaattttttcctggggaaaaattttttcggtaaaaaatccacaaaaaataaaaccccgaaaaataaaaggtaaaaacccggggggcctttaaggggggccccaccacaatttatggggtgggcccctctccccctttttaaaaggaaaaaattggtgccccctttttttaaaaataccaccccccccgggaaaggcttttttttatttggcccccggggttttttttttcacag

SEQ ID NO: 941 - DNA, 2016 bp, Glycine max; identical to SEQ ID NO: 277
  CDS (42)..(1820)

SEQ ID NO: 942 - DNA, 1038 bp, Zea mays
  CDS (131)..(775)
cccacgcgtccggaagcagccaccactctctccactgtgactccgtgacctgcctgccctgctgcacaagcacagcacacacaccccgcacaccgcaccagctcagcgcagctcaccaagacaatcaatcatggctcacccgcgcagtgtcgctgccgctgcccccctcctcctgctgctcgccgccgccgccgccgccgcagcggggctcgtgtccgccgcgtcgccggcagccagcgacttcgtccgcaagtcgtgccgcacgacgcagtacccgtcggtgtgcgagcagagcctggcgtcgtacggcgggtcgccgccgccgcggagcccgcgggagctggcgcgcgccgcgctgtcggtgagcgcggaccgcgcgcgcgccgcgtcggcgtacgtgggccgcctgtgcggcgccagcaacggcaaaggcgcgaagaaggggtcgggatcggcgtcggcgtcggcgtcggcaggtcccgtgcgcgactgcctggacaatctggcggacagcgtgggccacctccgcgacgcggcgcaggagatgggcggcgccgggatgggccgcgcggggacgccggcgttcaggtggcacctcagcaacgtgcagacctggtgcagcgccgcgctcaccgacgaggacacctgcctcgacggcctctcgtcccgcgccgtcgacgccggcacgcgcgccgccatccggggcaaggtcgtcgaggtcgcgcaggtcaccagcaacgcgctcgcgctcgtcaataaggtcgggcctgggtactaacacggggaggggacccaagatccaggcccaggcccagcccagataccacacccgctactagtatagtactaggcgcctccacggcgttgggtgtttctcgtccgttaatagctcggtttgctttgcttgtgtttgtgtaagatatacattagttaagggcaataagcttgtactattatgagtggcggccgaggagtacagtacgttctcctctgtccgatcatgccatcattaacattaattaatgtgggaaaaaaaaa

SEQ ID NO: 943 - DNA, 1140 bp, Zea mays
  CDS (97)..(1020)
gggaagaacaatcgagctactaataaggtcgtatacatatcttctatatactcctctgaaagttgtgaactccggtcgagcttaaaaacagcagcaatggcgaagctttggacattgctgctggctgcagtggtggtcctctcactcctagtgagccccattgcttgcacccgaaagctcaacaaacccaagccgaagccgggcagctacaggcggccggtcaagccgaagccaaaaccggtcacgggcagctacaagccggcgcctgtggccgccagaagaaaccacacagctacacccacgccatcgccgactgtctacggccccggtggctggctgtcaggcgccggcgccacgtactacggcgcgaccaacggcgacgggagcgacggcggcgcgtgcggctaccagacggccgtcggaaagaagccattcgactcgatgatcgccgccgggagcacgccactgtacaggggaggcgagggctgcggcgcctgctacgaggtgaaatgcacgaccaacgccgcgtgctccggccagcccgtgaccatcgtaatcaccgaccagtcccctggcgggctgttccccggcgaggtcgagcactttgacatgagcggcaccgccatgggcgccatggcccggcccggcatggccgacaagctccgcgctggcggcgtgctcaggatcctgtacaggagggtgccgtgcaagtacaccggcgtcaacatcgcgttcaaggtggatcagggcgcgaacccgtactacttcgacgtgctcatcgagttcgaggacgacgacggcgacctcagcgccgtggacctcatggaggccggcagcggcgtctggactcctatggcgcacaactggggcgccacgtggcgcctcaacaacggcaggaagctcaaagcgccgttcgggctccggctcacctccgactcccgcagggtgctcgtcgccaacaacgccatcccggccgcgtggaagcccggcaagacctaccgctccttggtcaactacccctgaaaagagaaataccgacaagtggatggcgtgtattgtgcgtccgggtgttgcgagtggcggcggtgtactactggtgtcggaaaacagaagagaatgaaagaggaggttgaagaagag

SEQ ID NO: 944 - DNA, 940 bp, Zea mays
  CDS (330)..(716)
ccctttcctcctcctcctcttcttcctcctcacctcacctcctatttagccgtccgaattgcttgtcagcatcttcccagcttcttcttcttcttccaaccgcgctacgctctcttgtccccggtgctcgcttggattcttctctcttcataggaaggaaggattggctaccgagatattcctactagtccagggctgtagtgcatcctgcgcgcttggtttattctgcagccagtaccagtaccagtaccccagctgagccggtgaggagaggagatagagagagcgagcgggagcgggagcgggagcgggagcagaggaggagggccatggaaggcgacagcttctccggcggcgccatggccaacggcggcggcggcggcggcggcggcagcgggcaggtggtggacgggaagctgatccacacgttccacaggagcttcgtgcaggtgcagagcctgctggaccagaaccggatgctcatcagcgagatcaaccagaaccacgagtcccgcgcgcccgacaacctcacccgcaacgtcggcctcatccgcgagctcaacaacaacatccgccgcgtcgtcggcctctacgccgacctctccgcctccttcgcgcgcaccatggaccacgcgtcctccgagggcgactcctccggcaccggcaataacggccgcgccggcgccggcgccggccacaagcgcgtccgccccgcctagagctagcttttagtttttttcttcttcttcttctgctgggtctagcttggcgtggcaatcctaggtgttgccattgccactaggaggcgtatttagtcttttctcttgcggttcttcttgttcgccttcttcctttgtgctcgctagctgcgacgaacgccggtgattagtgtatggtaatttagtgtcaaacagagagctgccatgtggatgttgctcct

SEQ ID NO: 945 - DNA, 1231 bp, Zea mays
  CDS (69)..(710)
caagagcaagagcaagagcaattactgcaaaaccctaaattagctacgtatagcttctcttctcacccatggccaagtcaagcagctacggccttgggcttgcttgcttcttcgccattgccgctgcggtcgccggcgggacgcagttcatggtcggcggcgccaatggctggagcgtgcccaccgccggcgccgagcccttcaacacttgggcggagaggacgaggtttcagatcggagactccctagtgttcgtgtaccccaaggaccaggactcggtgctgctggtggagccggcggactacaacgcctgcgacacgtcgtcgtacgtgaggaagttcgacgacggcgacaccgtggtcacgctcgaccgctccggcccgctcttcttcatcagcggcgtcgaggccaactgccgcgccaacgagaagctcatcgtcatggtcctcgccgcccgcagcaacggcaacggcaccggcggcggcgcgcgggctccgagcacggcgccgcagccggcgtcaccggcggcatcgccccctcccgccagctcgaccccgcccccgccgtcgtcgcccgctcccaagggcgcgtcgccgcccccggcctctgctcccacaacgtcaccgggtacgacgccgccccctgctccgagcgcgtcgtcgcctgctccggcggggagcgagacgcggacgaggagacgcggaaccagatgatgcagaacctattcggagaccagtcggaggacgaggacgatgcggacgacgacgacggccagcagcaacagctgcagtcacccccgcaccaccaccacgagatagaggacgacgccgatgaagacggcgacgacgcccgcagcgacgcgcctgcccgccacggcggataccactcggaagaagtggatggagaggcagagaatggaggagaaggtgaaggcgaaagtgaggggcaagttgaaatggaagaggaaagtgaaggcgaagctcatcgtgctgaccttgatcaaggagaaagtgatggggacaaagtccatagctccccagaaagagaactccatgaccagaggatggaatctgatgcaaaaggactggatagtgaagatgaaggctaccagcagaggacagtatctagcagaagaaggggagttgttgcctctgaatcagagggatctgaagataattactatgctgatggagctcaagaagatgaggaacctcgccaaacaaggaaacaa

SEQ ID NO: 946 - DNA, 818 bp, Zea mays
  CDS (234)..(563)
ggacggggcaccactgcctgtcgccctcaagaacccccaccatccccaccgccagcagatcgattcgcgaaagagacgaccgccgccgcatcggaccgtgcccgagccccccttctcctcgctgactcggctcccctcctccgccgtcgccggaggcgaagcaagtggggaccacagaagcattagctgggtgaacccactcaaagggggcagggaattgtgtgctagtttgaatggctgctacaaagcttcaggccctttggaaccacccggctggccccaaaaccattcatttctgggcgccaacattcaaatggggcatcagcattgccaacatagccgactttgctaaaccacctgaaaagatatcttaccctcagcaagttgctgttgcatgcactggactcatttggtcaaggtacagcttggttatcacaccgagaaactggaaccttttcagtgttaacgttgcaatggcgggtacaggcctgtatcagctttcacggaagatcaggcaagattacttatccgatgagaaagatgctgcttcacaactggaagcatagataatgacaacaggcaaagaataacggattggaaagcctgcatcctaggagtctactcttgattttttttttctgggcaagcaaagaataacggatgggtcatgtttgttttcctgttattctgaaatcgtgagcaggctaatgtgaaaatcttccgccaaaaaagaaaaccaatgaagtgatgttttgagcattttttttgtgggaacaagtcatgaaagtacatggtttatctgttaaaaaaaaaaaaaa

SEQ ID NO: 947 - DNA, 1904 bp, Zea mays
  CDS (169)..(1542)
attcggctcgagagctacctctccgatccgaggcctgagcgagcgagctgaggactgcagcctatataatatctagactatagtacaccacaacgacgaggcacatatatatacacgcggcggcggccagatccatcttggtatacacgtaatatatatacacgcacgatgggcagcgccggcggcggtggcgagagcaagctggagagcccgctgctgggcgcgtcgtcgacgggccacggcgaggcggtgatcttctcgggccacctcggcacgctcgagctcgccgccgcctcgctcggcaacaccggcatccaggtcttcgcctacggcctcatgctgggcatggggagcgcggtggagacgctgtgcgggcaggcgtacggggcgcacaagtacgacatgctgggcatctacctgcagcgctccaccgtcctgctgatggccacgggtgtgccgctggcggcgctgtacgccttctcccgccccgtcctgctcctgctgggggagtcccccgagatcgcgtcggccgccgccgtcttcgtgtacggcctggtcccgcagatcttcgcctacgccgccaacttccccatccagaagttcatgcaggcgcagagcatcatggggcccagcgcctacatctccgccgccgcgctcgcagcccacctcgccctcagctacctcgtcgtctaccgcctcggcctcggcctcctcggcgcctcgctcacgctcagcgccagctggtgggccatcgtcgccgcccagttcgcatacatcgtcaccagcagccgctgccgcctcacctggaggggcttctcgtggcaggccttctccggcctgcccagcttcttcaggctctccctcgcatccgccgtcatgctctgcctcgagacctggtacttccagatcctcgtgctcatcgcaggcctcctcaaggaccccgagcttgccttggcctcactctctgtctgcatgacaatttcagggtgggtgttcatgatctccgttgggttcaatgcagcagccagcgtaagagtgagcaacgagctcggcgccggcaacccaagggcggcggcgttctccgtggtggtagtgacgctgctctccttcgtcctgtcggtcctcgtctccgccgtcatcctgctgtgccgggactacatcagctacatcttcaccgagggtgaggacgtgtcgcaggcggtctcccggctcaccccgctgctggcgttcacgctcatcctcaacggcatccagcccgtcctctctggggtcgctgtggggtgtggatggcaggcgttcgtcgcgtacgtcaacgtcggctgctactacatcgtcggcatcccgctcgggtgcctcctaggcttctactttgacctcggagcagcgggtatttggagcggtatgatcggcggcaccttgatgcagaccttgatcttgatatgggttacattcaggaccaactggaacaaggaggttgaagaagcacagaagaggataaacaaatgggacgacggcaaggctcctctgctgtcagcgcaagaatgaaacaactcgtctctctggtgcccaaccaaagaacaacgagacgtggatatatatgacctgtagggcttgtttggaagaaagagtattggagaggattgaaggggttataatctcttgctattcaaaattgaataacaagggattatagtccccacaatctccttcaatactcttgtttccaaacatacccgtagggaactagggatgcccctcggcaggctcagcggagacgtcgacggagtttgatgtcaagtagcaattaattccaccatgtcctcaaatggacagaaccagatgcctgaaatagacagaaccagatgcctgatgaaattctacgtactcaaaaaaaaaaaaaaagg

SEQ ID NO: 948 - DNA, 2245 bp, Glycine max
  CDS (585)..(1889)
ctaaatctctcacatctcttatctttctctctctctcttataatacaagaccctagtcctctctcacgccccaaccaccgccatcaccaaaccttcctctctcgatttcccttcaattcccttctgggctttgcaattcggccaattgggtccccaaatctgcaaccttttcctctgtctaacgcgaaacggaagagaaacacccacatagagaaagagaaaaaaaaggagaggaagaaacaattttagggtgtggggttaaaacccggggttgaagcattgcagacatcacggctattcaaggagttcgccactctctttctcatgcccgttgtgtccgacgcaagggttgtgtgacggagagcaatccttcgccgcacggcgggcgtggcgctctgccttccgaaggtggcagcccctccgacctcctcttcctcgctggcggtggttcttcccattaacattctaaagtagtattagccattaacattacatcctacaccttcaaaagttctctctattagcggtttctggtttcttttgttcttcttctttggtagttgttaggtttggtgaggtctaagatgttgagcattaagagggttcccactgtggtttcaaattatcaaaaagaagagacaggggaggctgctgccggaggttgtggtcgtaactgcctcaaaagttgttgcattcaaggtgcgagactgcctttgtatgctttcaagaaggtggacaaggtttgtggaaatgaattgcctttgcttggatgcaaggagcagcaccctgtggcctttctggactcgcttgttcttggagagtgggaagatcgcatgcagagagggcttttccgctatgacgttacagcctgtgaaaccaaggtgattcctggggagtatggtttcattgctcagctgaatgagggtcgccacctcaagaagagaccaactgagtttcgtgttgataaggtcctccagccctttgatgaaaacaagtttaacttcactaaagttgggcaagaagaggtcctgtttcagcttgaggctagcaatgatggggaggctcaattctttccaaatgcacctattgatgttgagaattctcctagttttgttgccatcaatgtgagtcctattgaatatgggcatgtgctgctgattccacggatttttaagtgtttacctcaaaggattgaccatgcaagcttcttgcttgcacttcaaatggcagttgaagcaaggaatccatattttaggttgggttacaacagcttgggtgcatttgcaaccattaaccatctccactttcaggcatattacttggctcttccttttccaattgagaaggcccctactaagaaaattgccaagttaagcggtggtgtgataatatctaaactgttaaactatccagtcagaggccttgtctttgagggcggtcatacactagaggatttagcaaatgctgtttcagaagcctgcatctgccttcagcacaacaacataccttacaatgtacttatttcagattgtggaaggcaaatatttctcttaccacagtgctatgcagagaaacaagcccttggagaagtgagtcctgagcttctggagacccaagtgaatcctgctgtgtgggaaattagtgggcacatggtgctgaagaggaagaaggactatgaggaggcatctgaagccaatgcttggaggcttcttgctgaggtttccctctctgaagagaggcttctagaagtcactgctcttgtttttcaagccattacatcatcggttgagatgaatgtcaagcctcaacgtcttgaggaagttgatgccgttagcccaaacgcacagcatgccatggtggctggttcacatgaatgccttgttctccagtaacaaggctatgaacaaattcgtagtgattatgaactaaatattgcttgccatgttacgtttcagttctaataagtgtagtaccttatattatggtccagttactggagtctgaagtatttatgttttaaggacttgaataattgtggtttgtattttattatatggactcgctgtacggtgcttgattgtccttcgtggtctatgtaaaaatacaatgactgttcttctgagccttattcagtggttagtgtttctgtgtttgtggtttgattaatgtgacatactttcatatagtgaggcatgggaatgtgcaagtagcatttatataaatggtgcttgatctttttctattt

SEQ ID NO: 949 - DNA, 2724 bp, Zea mays
  CDS (211)..(2514)
gtaaattcatccgtccatccaccgacccagagccctcgatcccctaaaaaaaacccagagccctccattccacagccatcctcccctctgcagtgcactgctgcttgaccaagcaacaacaagaagctaccagcgcgctacctgcagattgcagcacacgcaagtgagagggcaggcaactccccggacgcaaggagttagagggcaagcatggcttcccttggtgacataggcctcgccgcgggtctcaacgtattgaccgccgttgccttcttgctcgcatttgcattccttcggctgcagccaatcaacgacagggtctactttcctaaatggtacctcaggggaatgagagacaatccaatcgtatctggtgcagctgtgcaaaagtttgttaacttagacgccagatcctacttgaagtttttaaactggatgccagctgctctcaagatgccccaggatgagctcattaaccatgcaggccttgattctgtggtctacctacggatatacgtaacagggctcaagatatttgttccaattacagttctggcttttcttgtactggtcccagtcaattggaccaatgacaccctaggacgcatcaacgtagtctacagtcctattgacaaactttcgatatctaatgtacctaatgggtcgaagaggtttatagctcacttgggcatggcttatgccatcacattttggacctgttatgtactgttgaaggagtatgaaattatttctaacatgaggctgcgctttctagcttcagagaaacgccgaccagatcagttcactgtccttgtgcggaatataccaccagatcctgatgaatcaatcagtgagcttgtggaacatttcttccttgtcaatcatcctgatcattatctacaacaccaggtggtttacaacgcaaataaacttgctgatctggttgaaaagaagaagaagatgcgaaattggcttgactattacctactaaagtatgagcgaaattcatcattgaggcctaccacaaagactggctttcttggatgttttggttccaaggtggatgctattgactattacaaatcagagatcgagaaaatcgggaaacaggaagctgaagagcgtaagaatgtcatgaaggatccaaaatcagttgtgccggcagcctttgtctcatttcgctcccgatggggtgcagcagtctgtgctcagacccagcaaacaagcaatccaacactctggttgacagaatgggctccggaacctcgtgatgtttattggaataatctgtccatcccatttgtgtcccttacaattaggagattgatagttgctgtggcattcttcttccttaacttcttttacgtcatcccaataacattcgtacagtctcttgcaaaccttgaaggaatagagaaggcacttccatttctaaaacccttgattgacttgccattcattaaatcattcatccaagggtttcttcctggaattgctttgaagatcttccttatagtgcttccaactatactgatgtttatgtctaaatttgaaggactgatatcgcagtcatctctggagaggcgatctgcatctaagtattacatattcttgttcttcaatgtatttttggggagcgtaattgcaggatctgctctggagcagcttaaaacttatctccatacatcagcaaacgacataccaaggatcattggtgactccatcccaatgaaggcgacttttttcataacatatgtgatggttgatggttggactggaatagctggtgaaatattgagactgaagccgcttatattcttccatctgaagaactttttcttggtcaaaaccgaaaaggacagagaagaagctatggaccctggcagtatctgctttgactcaactgaacctagaatacagttgtacttcttgcttggccttgtttatgctgcagtgacgccgttcttgcttcctttcatattggtgttctttgggttcgcatatgttgtcttccgccaccagataataaatgtctataatcagcaatatgagagcgccgcacagttctggcctagcgttcatgggcgtataatcacagcgttgattgtatcgcaactgctgctcctgggactgatgagcacgaacgactttgagcagacgacacctgtgctccttgttcttcctgtgctgacctttgggttttacaagtactgcaagaaccgctttgagccggcattcgtgaggaacccgctgcaggaggcgatgaagaaggacaccctagaacgcgcccgggagcccaacttggatctgaaggcgtacctggccaactcgtacctgcacccggtgttcaagggggacgaaggcgacgacaggtactcggtgatggacgacgatgggtggatggaggaggaggtgatcgtgccgacgaagcggcattcgaggaggacgacgcccgcgcagagcaagcatgaagggtcggactcgctctctgtgctcgagagttctctacagcggtagtcacagtaggagcttagcctgtacagaatggatgaaaatgatcacggccctgctccattgcttttgctttggttgttggttgttcatgtcacaggggacacacacacacagatagaattcaagagagctgtggggaggactgaggggagagatagtttactgtagcttggacaaagaatctgaatacagcagttacattatctgatg

SEQ ID NO: 950 - DNA, 510 bp, Arabidopsis thaliana
  CDS (1)..(507)
atggctcaggaacaagcgactagctctttagctgcaagctctttaccatcaagcagcgagaggtcatcaagctctgctccacatttggagatcaaagaaggaattgaaagcgatgaggagatacggcgagtgccggagtttggaggagaagctgtcggaaaagaaacttccggtagagaatctggatcggcgaccggtcaggagcggacacaggcgactgtcggagaaagtcaaaggaagcgagggaggacaccggcggagaaagagaacaagcggctgaagaggttgttgaggaacagagtttcagctcagcaagcaagagagaggaaaaaggcttacttgagcgagttggaaaacagagtgaaagacttggagaacaaaaactctgaacttgaagagcgactctctactcttcagaacgagaaccagatgcttagacatattctgaagaacacaacagggaacaagagaggaggtggtggtggttctaatgctgatgcaagcctttag

SEQ ID NO: 951 - DNA, 1583 bp, Zea mays; identical to SEQ ID NO: 710
  CDS (179)..(1291)

SEQ ID NO: 952 - DNA, 3498 bp, Saccharomyces cerevisiae
  CDS (345)..(3209)
tgttttatctactgctttctataattttctccgttccaatgcgatccaatgcctttcattcatacatagttatttatttcattaacgatccaaatctctttacttaacttcactagtcaacgcttctaacacatcacgcgatacgaagattaacagtttagtataatattgcaatacatacccatttcacacatcggtcaaggtcatcaagcacttttagttatagtgtgtcctatagttctttcagattgattgaggtttcatattagtgttgaaagcctagctaaagttctctgggcgtgcaacattcgaggacacatcggttgtttatacctcatgggattatggatggtcaaatagataaaatggagaagcgatatagcatgaccaaactggagaataggttaaggactttccaagatggtgttgcacttgaaaaaaaaaagttaaagtggagttttaaagttattccgtatcaggcaatggccaagcttggattttactttgatccagtgatcgatcctaagacatctaaactgaaaaaagactctgtaagatgttgctattgtcatcgtcaaacatacaatgtgagagactgcagatccaaaagaaaagatgttcttgagactctaagcaatataatgaggcaacatctgactgttactgataacaaacaagtttgcctccttatttacttgcgcaataagctattgacggactatagcttccatatgggggtttcggactggaaaaatgacaagtacttcagcaatccagatgatgaaaacgtgataaacctaagaaaatttacttttcaagataactggcctcacagtggttctcaaaatgaacatccgctgggtatagaaaagatggtgaatgcaggactcatgcgatacgactccagcatagaaggcttaggcgatccaagcatggataaaacacttatgaacgatacctgttattgtatttattgcaaacagttgttacaaggttggtcaataaatgacgatccgatgagccgacattataaggtttctcaaaatgggaactgttatttctttcagacacgtaatcgatttgagagaataaaaaatgacaatgacagtatcacgaaaaattgcgaagtctctccaactttaggcgaaaatgggaaaagagaagtgatcaacacgaaaaccgcttctcaaaggcagtgtcctttatttgagtcacctccatctagtactggtcctcaacttgacgattataatgagaagacagatatatctgttattcaacataatataagtgtgcttgatggagcacaaggcgaaaatgtaaaacgtaatagtgtggaagaaaaagaacaaatcaacatggaaaatggaagcactacattagaagagggcaatataaatcgtgatgttttagcagataagaaagaagttatttcgacaccaactgcaaaagaaatcaaacgtccaaatgtccagctaacccaatcatcgtcacctataaaaaagaaaagaaagtttaagagaatatcgcctagaaaaatctttgatgaggaagatagcgaacactcccttaataataattctgccaacggagacaacaaagataaggatttggttatagattttacaagccatatcataaaaaatagagatgtagggagaaagaatgctattttagatgacagcacagatgaattcagtttcagtaaccaaggacataacacatttgacatacctataccaacctcatcacatttgctcaaaggtatagattcagataatgacaatgttatacgagaagatgatactggcataaatacagacacaaaaggagcgtcttctaaacacgaaaaattttctgttaattctgaagaagatttaaatttcagtgaagtgaaactcacaggtagagacagtagtactaatattcttataagaacgcaaattgtagatcagaatttgggtgatatcgacagagataaggtccccaatggtggatccccagaagttccaaagacacatgagttaattagagataactctgaaaagagggaagcacaaaacggggaatttcgacatcaaaaagattcaactgtacggcaatctccagatatattacattctaataaaagtggtgataattccagtaatattaccgcaatacccaaagaggaacaaaggagaggcaatagcaaaacatccagcattcccgctgatattcatcctaaaccaaggaaaaacttgcaagaaccaagaagcctatcaataagtggaaaagttgttccaacagaaagaaaattagataacatcaatatagatctaaatttttcggcgtccgatttttcaccatcatcacaatctgagcaatcatcaaaaagctcaagcgttatttcaacgccggtagcgagccctaaaattaatctcacacgcagtttgcatgcagtcaaagagctttctggcctcaaaaaagaaactgacgatggtaagtattttactaataagcaggaaactataaaaatactggaagatgtgtctgtgaagaatgagaccccaaataatgaaatgttactttttgagactggaaccccgatcgcatctcaagaaaacaagtcaagaaaattatttgatgaagagttttctgggaaggaattggatatacctatagattcatcaactgtagaaataaaaaaggttattaaacccgaatttgagccagtcccatcagttgcaaggaatttggtgtctggaacctcttcatatccacggaattcacgtttagaagaacaaagaaaggaaacaagcacaagtttggctgataattctaagaaaggaagttcatttaatgagggcaacaacgaaaaagaaccgaatgcagcagaatggtttaaaattgatgaaaatagacaccttgtaaaaaattacttccatgatttgttaaaatatataaataataatgatgctacgctagctaatgacaaagacggtgatctggcttttttgattaagcaaatgcctgcagaagagttggacatgacattcaacaattgggtgaacctaaaagtgcaatctattaagcgcgaatttatagatgactgtgataagaaattggacatattgagaagggattactatactgccacaaattttattgaaactttggaagatgacaatcaattgatcgatattgctaagaaaatgggcattttatagctaactaatttgataaacaggctaaaggtttgtattttttgtagttttgaaactgtgtatagaatgtttcgccgcatcgcagatatctgcagggaactgttgacatagcatcttctgtggacgtgacaacgttacgtatattcgttgataccgcaagtctatagcgtatacatgctaaggcaaaaagtttcaaagtgaatgcattatgtatttatatgtaaataagtaagaaaagtgggattttgaaaataaaggtgtagtaggacagtaagtattcaatgaaatacaa

SEQ ID NO: 953 - DNA, 1082 bp, Zea mays
  CDS (157)..(906)
gcaaagagtgggccgggtggccaggaccaacgacttttccatagtcgtgctcgtcttcgtccacctcccgacccgactgagtagcaagcaattctccaaattagggtttctttccgcttgctttccagtttgcggcatcagtcggtggcgcctgcgatggagtctctgttcggccaatcgcagcggaggaggagggcgggcggcagcggcttcgaatcgctcaagcgtctgggtcacatctcacccgctgtgcagtcccacctcaaacatgtgtacctcaccctatgctccgcgctggccttctctgcactcggcgcgtacctccacatcctcctcaacgtcggaggcgccctcacgaccgtgggatgcgtggcctccatcgccttcctcatctccctgcccgcttcacgggaccaggagaggaaccgcttggcgctgctcatgtctgccgcgctccttcaaggcgcgtccgttggtccgctcgtcgaccttgttattgacttggattcgaggattctcgtcactgcgttcgtcgggaccgcagttgcttttgcatgcttctctggcgctgccatcatcgccaagcgcagggaatacctgtacctcggcggtctgctttcatctggcctctccattcttctctggctgcagtttgctacttcaatctttggccacaccagcgcgaccttcatgtttgagctctactttggcctcctggttttcctgggatatatggtgtttgacacccaggagatcatcgagagggcgcaccgtggggacatggactacatcaagcacgcgctgactctcttcaccgactttgttgcggttcttgttcgaatccttgtcatcatgatgaagaatgcacaggagaaatcccaagacgagaagaagaggaagaagcggtagctgctgaatgaattggatgacatatgttgttgtggtcactacttcatagtaccgtgtactcctatcctattgtactaataataataatagtaagacgaaagatgactgctgggaatgaatatttggttctgctaaaaaaaaaaaaaaaaaaaaaaaaaaaaaaaaaaaaaaaa

SEQ ID NO: 954 - DNA, 1031 bp, Zea mays
  CDS (113)..(697)
ccttgattgaagtattaaatattcctatataaatataaattgggggtcttgaaattcaaagccatatctgtgattcatcaaatttgtgtttccccgaccccgattgcaagcaatggacgccttcaattccttcttcgattcaagaaaccgatggaattacgatactctcaaaaacttccgtcagatttctccggtcgtgcagaatcacctgaagcaggtttattttactctgtgttttgccgtggttgctgcggctgtcggggcttaccttcatgtcctcttgaacattgggggttttcttactacagtggcatgcatgggaagcagcttttggttactctccacacctccttttgaagagaggaagagggtgactttgttgatggccgcatcactgtttcagggttcctctattggacccttgattgatttggctattcatatcgatccaagccttatctttagtgcatttgtgggaacagctttggcctttgcatgcttctcaggagcagctttggttgcaaggcgtagggagtacctgtaccttggtggcttggtttcttctggattgtccatccttctctggttgcactttgcttcttccatctttggaggctcaacagctctctttaagtttgagttgtactttgggctattggtgtttaggttacattgtagtagacacccaagaaatagttgagagggcacacttgggcgatctggactatgtaaagcatgccttgaccttgtttaccgatttggtcgcagtttttgtccggattcttgttattatgttgaagaattcgactgagaggaatgagaagaaaaagaagagaagagattgattttcttaccaatctgctcgattaacacttcacctcgcttggtctgtaatacataaaaacagccgtctatacagtgttttccactttttaagcttgctcctcctactgtgcagttaagtcgtttgtttaccaatagtacatgttgacatgttttgagctctctaataagagaaatgtttacattac

SEQ ID NO: 955 - DNA, 1129 bp, Zea mays
  CDS (144)..(890)
gcgcagcgcgcagcgcagcccacctatcaataaccgacgagcgaggcgcgagaaccgacttgccaccggctgctcgccgtctctctctctccctcggggcgcgcgcgcgggagacaggccaaccgatcgtcaggcggccagccatgggcaagcacgggcacggcaagtgccacgacgtggaggcgtgctacccgccgggggcagcgggcggcggcaagtacccgtacatgacggagaacccgcagctgcggtgggccttcatccgcaaggtgtacgtgatcgtgtgcctgcagctgctgctgacggtggccgtcgccgcgacggtgaacctggtgcgcgccatcggggacttcttcctctcccgcaccatgggcgccatgttcgccatcatcggcgtcatcgtcgcccccatcctcgtgatgatcccgatgatcatttaccggaagcggcacccggtgaacctcgcgctcctggcgctcttcaccgtctgcatcagcttcgccgtggggctgagctgcctgacggcgaacgggccagtgatactggaggcggtggtgatcacgatggtggtggtgctggggctcaccttctacaccttctgggcggccaagaggggctacgagttcgagttcctggggccgttcctggtgtccgcctgcctcatcctcatgctcttctccctcctgcggatcatcttcccgctgggcaggacggggaccatggtgtacggctgcatcgccgcgctcgtcttctccggcttcatcatctacgacaccgacaacctcatcagggtctactcctacgacgagtacgtcgccgccgccatcgagctctacctcgacatcatcaacctcttccaggccatcctagcggtgctcgaaggcgtcgactgatagggtcatatatataacacggccggctgaggctcatgggctgtgagcatatatacataggatcatatatatgcaatctatacatgagctaccactaccactaccgagagatgggttccaagcttgctgggcaatctgtaatccatagacgatagatagggtcgaacggcaccgccgtgattgaacattattgctacaacgaaacattgcaaatgcaattcattatcttctcttgc

SEQ ID NO: 956 - DNA, 1547 bp, Zea mays
  CDS (141)..(1193)
aggccagccacgcgcaaaccgaatccaccaacgtcaaacgaccgcaccaaccaatccacttcgccggcgatccgtctcatctcgtcgcgtctccggcgccggcagacacgggtaacgcggctccgagatcggcgggcaggatgatgatgctgatcgattgctcggggtgccgtaccccgttgcagctgccgcacggggcgccctgcatccgatgcgccatctgtggggccgtcacgcacatcgcccccgcccctcccgccgagcccaaccgcggcgccgtacaaccggcgccggggtgggcgccgccgccgccgccggtgcacggacggaagcgcgccgtggtgtgcgggatttcgtatcggtactcgcggcatgagctgaagggctgcatcaacgacgccaagtgcatgcgccacctgctcatgacgcgcttcaacttccccgacgactccatcatcatgctcaacgaagaacaaacggacccctacaaaatcccaacaaagcataacataaggatggctatgtattggcttgtgcaaggttgtcaacctggagattcattggtgttccattattctgggcatggatcacaacaaagaaattacagtggagatgaggttgatgggttcgatgaaaccctctgcccgttggattttgagacacaagggatgattttggatgatgagataaatacagcattagttcgaccacttcctcatggagttaaacttcatgcactcattgatgcttgtcatagtgggactgcacttgatttgccttatctctgcagaatgaacaggagtgggcaatatgtatgggaagatcaccgaccgcgatctggtgtctggaaaggcactagtggtggggaagctatttcctttagtggttgtgatgatgatcagacctctgcagatacctctgctttatcaaagatcacttcgactggtgcaatgacattctgcttcatccaagctattgaacgtggacagggcaccacctacggtagtatcctgaactctatgcgttccacaatacgcaacacaggtgactcagcgggtgtaggtggcggtgctgttacatcactaattacaatgcttcttactggagggagcctttctgctggtggtctgagacaggagccacaactgacggcgtgcgagccatttgatgtctatgcgaagcccttctccctatgacgtgttcatagtattgcccaatgtactatggggttgtttgtttcggcttctggcagcttctggccaccaaaagctgctgcggactgccaaactctcagcttttcagccagcttctataaaattcgttagggcaaaaaccatccaaaatcaacataaacacataatctgttgagtcgttgtaatagtaggaatctgtcactttctagatcgtaagccctatgaacaactttatcttcctccacatgtaatcataataatactcagattctccccacagccagattctcagaaaagctggttagaaaaaagctgaaccaaacagcccctatatatctcctcccatttcacgtt

SEQ ID NO: 957 - DNA, 1576 bp, Zea mays
  CDS (86)..(1018)
ccacgcgtccgggcaggcagaggcaagaggcccctcaccctcaggtgatcaggtcgctagctcccggcttaactagtaggcagccatgaatttcggtgggaatggcaacgcgacgatccggtgcaagtactgcagggcgagcctgagcgtgatccccggcgagcgcgccatccagtgcgcgcaatgcaactgcgtgacccgcatccggcgggccgaccgcatcccgctggcgcggccggcgcacgtgccgccggcgttccagcgcgcccggggcaagaagcgcgccgtcctggtcggcatcacgtacgccggcgcgcgccggggctgcggcgacctgagaggccccgtcaacgacgtcaagtgcatgaggaacctcctctgccagcgcttcggcttccccggcgagtgcatcatcatgctcactgacgaccagagggacccgttcaggctgcccacgaaggagaacatccggatggcgatgcactggctggtgcagggctgcagctacggcgactccctggtgttccacttctcgggcatcggcgcgcaggtggcggacgacgacggcgacgaggcggacgggtacgacgaggccatctgcccgctggacgcgttccagagcgggcccatcctggacgacgagatcaacgagaccatcgtgcgcccgctggtgcacggcgccaggctgcacgccgtggtggacgcctgctacagcgccacggtcctggacctcccctaccagtgccgcatgtccaggaacgggttctggcagtgggaggacgagagcccgccgtcgggcgcctggaagggcaccagcggaggccacgccgtgctcatcagcggatacagcgagggcaaaggcaacttcgccatggtcagggacatgatacatacatacatactgctgatcgagctctgctgccttgcatctatctatatacctaacatgcatatgctgctgcttggacgacgcgcggcgtgcagatgcccgacgcccacgcgtcggtcgtcggggccatgacgcacagcttcgtccggacgctggagtgccagccgcgcggggtcacctacggccacctgctcagctccatgagggccatcatgaagaaccgcggcgggggctgcgatctgcagggggccatcggcgcacccatccgcaccgtcgccaacttcagcggcgtgcaggagcctaacctgtcctcttcggagacgtttgacatttaccgcaagcagttcgtcctgtagacaccaccacaccagggtttgcccctgccggccggccgcttgtaatgaattgccgtcgtatcagaataagaaattatctatcgaccatgatatgatatgatatatcaggaaagaaggaactattacccctcaatgtaataactaagcatgttcaatgtcctctttttattagagagagagacagagagaaaacgcggaatttgagacgtgtgcatgcagtttacgtgatcaataaagttacatagaaattattttaaaaaaaaaaaaaaaaaaggggtccggtatagaagattcaagcttatgtatgcgacatgatagctttctatagtgc

SEQ ID NO: 958 - DNA, 1461 bp, Zea mays
  CDS (74)..(1141)
ggagctagctagccagcaacgcgtagcaagcagcgcaagcaaagctccgagcgcccggccggctagcttcgccatgaacatgggtggaaggtccccggcggcgacgacgatccggtgcaagtactgcagcgcgagcctgaccgtgtgcgccggcgagcgcgccatccagtgcgcgcaatgctgcggcgtgactcgcatccggcggtcgctgtcctcgcggctcccgctgccggcgctgacgaggccggcttccgtcgcgggcttcccgccgtgcggcggccgcggcaagaagcgcgccgtcctgatcggcatcacgtacggcggcgcgcgccggggctgcggcgagctgcggggccccatcaacgacgtcaagtgcatgaggcagctcctctgccagcgcttcgccttccccagcgacggcatcatcatgctcactgacgaccagaaggacccgttccgggtgcccaccaaggacaacatccggatggcgatgcagtggctggtgcaggggtgcagcagcggcgactccctggtgttccacttctctgggctgggcgcgcaggtcgccgacgcggactgcgacgagcaggacgggtacgacgaggccatctgcccggtggactcgttccagaagggccccatcctggacgacgagatcaacgagaccatcgtccggccgctggtgcccggcgccaagctccacgccgtcgtcgacgcgtgccacagcgattccgtcctcgacctccccttcctctgcaacatgtccaggaccgggaactggcagtgggaggatcaccgtccaccgtcgggcgtctgcaagggcacgagcggcggccaggcggtgcttatcagcggctacagcgacggcaaaagcaagttcagcatgacgccggaggcctgcgcggcggtgggggccatgacccacagcttcatcaaggcggtggaatgcgagccccagggggtcacctacggccgcctgctcacctccatgaaagccatcatgaccaacgccggcggctgcaaccagcagctgcagggcgcctgcgcacccgcccgcaaggtcgtcaacttcagcggcgtgcaggaacctaacctgtcttgctcggagatgttcgacgtctaccgcaagccctttgcgctgtgaacctcctctgcattgccattgcctttgcagactaccacagattcccgtctggactctatatataaattaccgtgacggaataataaaccagacggatttatattatatatgatgatatgtcataatgtgtgccttaattgtcttgcggccaataatgtgtgtccatgtgtcgatcggttaccggccctgagccaagcttatagcctgtggaccgacgactttgttgaccattataaatacaatgttgataatgttttaaaaaaaaaaaaaaaaaaaaaaaaaaaaaaaaaaaaaaaaaaaaaaaaaaaaaaaaaaaa

SEQ ID NO: 959 - DNA, 1815 bp, Saccharomyces cerevisiae
  CDS (186)..(1547)
tattgtggcttaacagttctccttaaaatccacataactgacaaaactggatacttaatgcccatcgagtcatatacatatatttgattactacaagtgcttttcaaataactgcttcgagaaaagcgtccgggtaataacaactattgaaaaagcatggcttcgcattaataggagccaaaaatatgaagatgagcctcgaagtttatctaaactaccaccaaagaagaccgactagatttacaatcatgtatccaggtagtggacgttacacctacaacaacgctggtggtaataatggctaccaacggcccatggctcctccacctaaccagcagtatggacagcaatatggtcagcaatatgaacagcagtatggacagcaatatgggcaacaaaatgatcagcaattcagtcagcaatatgctccaccaccaggtcctccccctatggcttataacaggcctgtgtatcccccccctcaattccagcaggaacaggcaaaggcacaattaagcaacggctacaacaatcctaatgtaaacgcatccaatatgtacggtccaccccagaatatgtcattacctccacctcaaacacaaactattcaaggtacagaccaaccttatcagtattctcaatgtactgggcgtagaaaggctttgattatcggtataaactacataggttcaaaaaatcaactgcgtggttgtatcaatgatgctcataacatcttcaactttttgactaatgggtacggttacagttcagatgacattgtcatattaactgatgatcagaacgatttggtcagggttcccactagggctaatatgattagggccatgcaatggttggtcaaggatgcgcaacccaatgattctttgttccttcattattctggacatggtggccaaactgaagatttggatggggacgaagaagatgggatggatgatgttatatatccggtcgatttcgaaactcaagggccaattatcgacgatgaaatgcacgatataatggtgaagcccttacaacaaggtgttagactaacagcattgtttgactcttgtcattcgggtacagtgttggatcttccatatacctattctactaagggtattattaaggagcccaatatttggaaggatgttggccaagatggcctgcaagcagctatttcatatgccacaggaaacagggctgctttgattggttctttaggttctatattcaagaccgttaagggaggtatgggcaataatgtggatagagaacgcgtgagacagatcaaattctcagcagcagatgttgttatgttatcaggttcgaaggataatcaaacttctgcagatgctgtcgaagatgggcaaaatacaggtgcaatgtcccacgccttcatcaaggttatgactttacaaccacagcaatcatatttatctcttttacagaacatgaggaaagaattggctggtaagtattctcaaaaaccacaattatcatcgtcacaccctattgacgtaaatctgcaatttattatgtagaaatatatgaatgtgtacgttggtagatgtattcagactggtgtagtatgtgattcaatttttatttttttagaaagcagaaacaatctaagctattaatactatatacatataggcaaagatatatagggaataggcattttggaaaataagaccatgtgtttttttaacgtagtgaatactaagtacagaaaaaaacatcacctcaaccaaagaaaaattaagtaatgaagaaagatcaggagaaaaatttttttctacttcaggt

SEQ ID NO: 960 - DNA, 1799 bp, Glycine max
  CDS (7)..(1695)
cttattatgaacctctctctatgcaattcttcaaaccttaacacctcaagaaaaccattgatggcactccctcactccatctctgccttagccaccacactcacactctcctcgccaacaaccaaaccccagaaagttaacccctttccctttttctcgaaccaaaagacacgatttttaacgaaacaaacgcgacccagaagcagaagaagcctctccctaacccctgcacgcgttgcggcgccaccctcaactgttgaagccgatcaatcatacccggagaccgaaaataacgaaactgaggaagagtttaacgatgaaagctcttattctaaattcacttggagggatcactggtaccctgtttcgttgatcgaagatctgaaccctctcttgcccacaccgtttcagcttctgggtcgtgaaatcgtgctctggtacgacaagtccatttcccaatgggttgcttttgatgacaaatgcccccatcgtcttgcccctttgtctgaagggaggattgatgaagatgggaagttgcagtgttcttatcatgggtggtcttttgatgggtgtggatcttgtgttaagatacctcaggctgcatctgaaggccccgaagcacgtgctattggatctcctaaagcgtgtgccactaggttccctaccatggtgtctcagggcttgctcttcgtttggcctgatgagaatggttgggagaaagcaaaggcctccaagcctccaatgttgcctgatgactttgacaaaccggagtttgccacggtcaacattcagcgtgatctgttctatggttacgatactctcatggagaatgtctctgatccttctcacattgagtttgctcatcacaaggtcacaggaaggagagacagagccaagcctctgccattcaagatggattctcgtggttcatggggcttctctggagctaatgaagggaacccacagatcagtgccaagtttgttgcaccatgttatatgatgaacaagattcagattgataccaaactccctgtagttggtgaccagaaatgggtagtatggatatgttccttcaatgtccccatggcacccggtaagactcgctccatagtttgcagtgctcgaaacttcttccagttctcagtgccagggccagcctggtggcaagtcgttcctagatggtatgagcattggacttcaaacaaggtatatgatggagacatgattgttcttcaaggccaagagaaaatcttcctttcagaaaccaaggaaggtggagacattaacaaacagtatacaaacatcaccttcacaccaacacaggcagatcgctttgtcttggcatttcgaaactggctaaggcggcatggcaatggccaaccagaatggtttggcaacagcagcgaccaaccattgccatcaactgttttatcaaaacgtcagatgttggatagatttgaacagcacactctcaagtgttcatcatgtaaagcagcatatgagggattccaaacatggcagaaagtcctaattggtacaacagttgtgttttgtgcaacatcagggatcccatcagatgtccagttgcgtgtacttttggctggactcgcaattgtcagtgcagccataacttttgccctaaatcaactccaaaagaattttgaattcgtggattacgtgcatgccgaaattgattaaacacttccctccaaaggaacttctactagttagttgtaaatagagttgaagacaaaaatacatgtatactagtattttgatgaaagagctcaaatcttcct

SEQ ID NO: 961 - DNA, 1701 bp, Synechocystis sp. PCC 6803
  CDS (38)..(1447)
tggctgtgccctgactgagaatccactaattcttcctatgaccagtttgttaacctcctctgcccaagctccagttgccaacgctccctttccagcagggggactagaccaaagcaaatttgattgtcgggccgtgtggtatcccctggcttacgaggaggatttggacaaacgcaaaccaactcgttttaccctgctgggagaagatttggtgatctggtgggaagcgaatagtcaacaatggcgggtttacgccgatcaatgtccccaccgtttggcccccctttcggaaggtaggattaacaaggctggccagttggaatgtccttaccacggttggacttttgcgggatcagggcaatgtcaagcgattcctcaacaacataccggaggccaagcccacaccagtaaacgggcctgtgtgcgttccctgccaacccaagtggctcaaggtttgctctttgcttttcctggggaaactgatcaagcagaaaaagttgccctccccttggtggatgtgttggatggggatcagtctgaatgggtttgtctcaatacttttcgggatttgccctacgacgcctttaccctgatggaaaatgtgttggattcgagccatattccctacacccaccataaaaccgttggtaaacgcagtaacgttagtccggtggatttggagattatccatggcgatcgtcagggatttaccggcatttgggaagagggaccaagaaaaggtacgttgggcaagcaaaccaccactttcattgcgccggggttgatgtggcatgatttaacttcaaagcaatttggtcgaactttaacggtggtttacgctactccgattcgcccaggggagtgtcgtttattcgcccgttttccttttaaatttcctagtaagtttccccggttagtaattggtttcacgccccgttggtattcccatttaggacaaaaccgggtgttggaagatgaccaaatttttctccatttccaagaaagatttgtgcagggcaaaggcggatcgcccaattatgaaaaagattgttacttacccactaaagcagatttgtttgtggcggaatttcaccgttggattgagcaatatcaagtcaaaccctttggggatagtccgttacctgatcgccaatcggtagagcaattaatggatcgttaccattcccacactgaacattgccacagttgccgcaatgcccttgctaacattgaaaaaattcaaaccgggagcctcgcgatcgccattatctgcttggtttgcttgccagtggctagtttaggcttagctcctaatttcgctctgggattgggcttgacagtgttgactggcttaggttttgcactctgggctggtttgggcaaatttaaacaatctttttaccaaggcaaccccattcccccaagaaatattcttgataaaggctaactgcttttttctgtgattaaaaacctttgcaatggagtattgagcataattttattgccgaaagtaagaccattaaactgaatctaagagcctgtttaaaagcccccttgacccccaaatttggggggacactgactgaaagtcccccagtattgccggagccttagtgagttaatttagaggatggaataaaactttccaaacacgttccaacgtcagggtttggccaagaataatcgatatctttgtaacaa

SEQ ID NO: 962 - DNA, 1162 bp, Arabidopsis thaliana
  CDS (80)..(892)
ccacgcgtccgatacattgaacctttcctcttcttcttcttccttctaccttcttctctctgttcaattttgggggaaaatgggtcgtggaaaaatcgagataaagaggatcgagaatgcgaatagcagacaagtcactttttccaagaggcgttctgggttacttaagaaagctcgtgagctctctgttctttgtgatgctgaagttgctgtcatcgtcttctctaagtctggcaagctcttcgagtactccagtactggaatgaagcaaacactttccagatacggtaatcaccagagttcttcagcttctaaagcagagaacctccaggaggattgtgcagaggtggatattttaaaggatcaactttcaaagcttcaagagaaacatttacaactgcagggcaagggcttgaatcctctgacctttaaagagctgcaaagccttgagcagcaactatatcatgcattgattactgtcagagagcgaaaggaacgattgctgactaaccaacttgaagaatcacgcctcaaggaacaacgagcagagttggaaaacgagaccttgcgtagacaggttcaagaactgaggagctttctcccgtcgttcacccactatgttccatcctacatcaaatgctttgctatagatccaaagaacgctctcataaaccacgacagtaaatgcagcctccagaacaccgattcagacacaactttgcaattagggttgccgggagaggcacatgatagaaggacgaatgaaggagaaagagagagcccgtcaagcgattcagtgacaacaaacacgagcagcgaaactgcagaaagaggggatcagtctagtttagcaaattctccacctgaagccaaaagacaaaggttctctgtttagtcctagaaaagtatgggagaaggctactaatgtttcctctttagcaagtatccgattgttttaaaagtaattttagagggatacttgcaaaaagaagagaagattcagttatctaatctctgcaccaactctctttgtccttcttcttttgattatttctcgactgtctctcctataaaaaagatatgcctagctgagagtttgaaatcaaaaaaaaaaaaaaaaaaaaaaaaaaaaaaaaaaaaaaaaaaaaaaaaaaaaaaaaag

SEQ ID NO: 963 - DNA, 451 bp, Saccharomyces cerevisiae
  CDS (24)..(425)
aaaagaattgtaacgaggaatacatgactaatatggcaaaagcaccaaaggcaaacacaccaaaagtaaccagcacgtcatctgcagtcttaacagattttcaagaaactttcaagacttctaagagggcatattttgcccaaattgaaaaatatcctaaactgaaactaattgatacattctgcttctttttggtattattaggggtgatccagtgtacattcattatcttgatccgtgataattttccattcaatgcgtttttagcgggattcattatttgtgtgggacaattcgtcctattgatgagtttgcggttacaattgtgtaatagttttccaggcatttctaaaaacagagcttttgccgagtttattgttgctagtttgattttacatttcgtttgtttacattttataaattgaggaagggtttgccggcgtgcttgcat

SEQ ID NO: 964 - DNA, 693 bp, Zea mays
  CDS (72)..(413)
ggctcgaggacgcctgctgcccaggtcttcgccggcgacgagcactccaccagacgagaggggattccaagatgccgagggccaccagcgacgcgaagctcctgatccagtccctcggcaaggcgtacgctgccacaccaacaaatctcaagattattgacctctacgtgggttttgcggttgccactgcccttattcaggttgcttacatgggattggttgggtcgtttcccttcaactccttcctctcaggagtcctttcatgcataggaactgcagttcttgctgtttgcctccgcattcaagtgaacaaagacaacaaagaattcaaggaccttcccccagaaagggcctttgctgatttcgtcctatgcaatctggtgctccacctggtgatcatgaatttcctcggataagcaactgctgcaccatgttggttaaaggttttgtagccccaggttgtggtcgctgattgttgcctttaaatgtttggaactgttgtgatcgtgatgtcgaatatccatatgatctgttgaaggattacttgtgtaagctgagtattcccggagggaactattagtcgaatggacagtttgcccagcgctgagaatgtgacctagcatgttctttatttgaagaagatataattcatttttcacaaaaaaaaaaaaaaaaaaaaaaaaaaaaagggcg

SEQ ID NO: 965 - DNA, 1334 bp, Zea mays
  CDS (98)..(1222)
cgcacgccttcccgttgtccatttgctccacgggccagcctgccggcgccgccactgcaaagtccgtacacacagacacacaacgcacgtcaccgccatgtctgccgccactgcttgcatgcccctggtccttgatccgtctcctctccatggatcggcggcaatggcagatgccgttgagaggcggcagcccggtggcatggagaccaccaagaccggttccgagggaacgctcggccgcgtcgtcaggagccaagtgtttggcaacgaggacgacgaccgtgctgggcacggcgacggcgacgaggtgagcaagccgcgggcggtggtccacacactgacgtgcgagcgcaagccattgttcgagggcttcgcgctctggcggagcatcggcaggcctgagcttcccgaactggatccaatcttatcgttcgacgaattcgagttttctgctccagctggcttccttgaccatcctcacaggggatttgagaacgttacctatatgctcgagggcggcatcagttaccacgacttttcaggccacaagggaaccatcaacccaggagacgttcagtggctgacggcggggcgcggcgtcgtgcacgcggagatgcccgccgccggccagggagtacagaggggcatcaacatctggatcaacctctctgccgccgacaagatggtggagccgaggtaccaggacctggcgagccacgacatccccgccgccgcggcggacgccgctggcggcgtctccgtcaaggtcatcgcgggcgagtgcctcggcgcgcgctccccgctccggccccgcaccccggcgctgtgcctcgacgtcgccctgcggcccggcgcgcgcctgcgccagcctgtcccgcgcgggtggagcgcctgcgcgtacgtcatccacggcgaggccgccttcggcactgcctccggcgagggtaacggcgcctccacggctaccgcgcgcacgctcgtcgtgttcggtggcgacggcgacggcgtggagctgcggggcgatgcagcgggccagggcgcgagggtcatgctggtcgcagctcggtcgcacggcgaggcggtggcgcgggacggccccttcgtcatgaatacccgggaggaggtggaccaggcgcgggaggactaccgccaccgccgcaacggcttcgagatggccgacggctggacctccgatcacgcctccgcagctgaaaagcattcataggatacacctaccttaggctagtcgcgcgcggatgcaactgtgtaaggctttatatgtagtttgatttccatcaataatccacaagttttatttccaaaaaaaaaaaaaa

SEQ ID NO: 966 - DNA, 1276 bp, Arabidopsis thaliana
  CDS (47)..(1147)
taatccgattcgtcttcatctgattccctcccttccgagaataataatgtacccgccacctccctcaagcatctacgctcctccgatgctggtgaattgctccggttgccggacgcctctccagctcccatccggcgcccgatctattcgctgcgctctctgccaggctgttactcatatcgccgaccctcgcaccgcccctcctccgcaaccttcctccgccccttctccgcctccccaaatccacgcgcctcccggtcagctgcctcacccccatggcaggaagagggccgtgatctgtggcatctcgtatcgtttctctcgccacgagctcaaaggctgcatcaacgacgccaagtgcatgcgtcaccttctcatcaacaaattcaaattctccccagattcaattctcatgcttaccgaggaagaaactgatccatatcgtatcccgaccaagcaaaacatgaggatggcattgtattggctcgtacagggatgcacagcaggcgactcacttgtcttccactactctggtcatggttcgcgtcaaagaaactacaacggtgatgaagttgatggctatgatgaaacactctgtcctctggattttgaaactcaggggatgattgtagacgatgagatcaacgcaaccattgtacgccctcttccacatggtgtcaagctccattcaattatcgatgcttgccatagtggtaccgttctggatttacccttcctatgcagaatgaacagagctgggcagtatgtgtgggaggatcatcggcctaggtcaggtttgtggaaaggaactgctggtggagaagccatttcaattagtggatgtgatgatgatcagacttcggccgacacatcagcgctgtcgaagatcacgtctacgggtgctatgactttctgttttattcaagcaattgaacgcagcgcacaaggcacaacctatggaagccttctgaattctatgcgcaccacaataaggaatacagggaatgatggtggtggtagtggtggagttgtgacgactgtgctgagcatgcttctgacagggggaagtgcgattgggggattaagacaggagcctcaactgactgcttgccaaacattcgatgtctatgcaaagcctttcactctctagtaaaggacaagtcactttttatgtatagcgagtgtgatttgagaatccgtccatataaccaccttttgtttcttatttttatttttctttcaaaagaataaaggaaaacattgatttggtgattcg

SEQ ID NO: 967 - DNA, 1560 bp, Arabidopsis thaliana
  CDS (1)..(1557)
atgggtggtggtggtgatacaacagataccaatatgatgcagagagttaattcttcttctggtacatcgtcttcttcgatccctaaacacaatcttcacttgaatcctgctcttatccgctctcaccatcacttccgtcaccctttcaccggagctcctccaccgccgattccacccatttctccttactctcagatcccggcgactttacaacctagacattctcgctctatgtcgcaaccgtcttctttcttctcctttgattcattgccgccgttaaatccttctgctccgtcggttttggtgtcggtggaggagaaaaccggtgccggatttagtccttcgttgcctccgtcaccgtttacgatgtgtcattcttctagctctaggaacgccggagatggagagaatctacctccgagaaagtcgcataggcgttcgaatagtgatgttacttttgggtttagttcaatgatgtctcagaatcaaaagtctcctcctttgagttctttggagagatcgatctctggtgaagatacatcagattggtctaatttggtgaagaaagaaccgagagaaggcttctacaagggaagaaagccagaggttgaagcagctatggacgatgttttcacggcttatatgaatcttgataacattgatgtcttgaattcttttggaggtgaagatggcaagaatgggaatgagaatgtggaggagatggagagtagtagaggtagtggtacaaagaagacgaatggtggaagtagtagtgattctgaaggagatagcagtgcgagtgggaatgtgaaggttgcgttgagttcttcttcttcaggcgtgaagagaagagcaggtggagatattgctcctactggtagacattacaggagtgtttctatggacagttgtttcatggggaagttgaatttcggcgacgaatcatcgctaaagcttccgccttcttcatcagctaaagtttccccaaccaattcaggtgaagggaattcaagtgcttatagtgttgaatttggaaacagtgagtttactgcagctgaaatgaagaagattgcagctgatgagaaactcgctgagattgtaatggctgaccctaagcgtgttaaaagaatcttggcgaaccgcgtatctgctgcacgttcaaaggagcggaagacgcgatacatggcagagttggaacacaaggtgcggacacttcagactgaagctactacattatcggctcagctcacacatttgcagagagattctatggggttgacaaaccagaacagtgagctgaagtttcgtcttcaagctatggagcagcaagcacaactccgcgatgctctgtcagagaaactgaatgaagaagtccagcggttgaaactggtgataggggagccgaaccgcaggcaaagtgggagcagcagcagcgaatcaaagatgtcactaaacccggagatgtttcagcagcttagcataagtcagttacaacaccaacagatgcagcattccaatcagtgtagcacaatgaaagcaaagcacacttcaaacgactag

SEQ ID NO: 968 - DNA, 1986 bp, Zea mays
  CDS (38)..(1675)
gttggtggggtcattagcggagctgtgtgaggcgacgatggggctgggggctgcggtggcgctggcgctgggcgacccgccggcggactacgcctccatcgcggcggtggggctgttcgtggcgctcatgtgcgtctgcatcgtcgtcgggcacctcctcgaggagaaccgctggatgaacgagtccatcaccgcgctcttcatcgggctgggaactggagcggtcatcctgttcgcgtcgagcgggaagcattcgcgcgtgctggtgttcagcgaggacctcttctttatttacctgctgccgccgatcatattcaatgcagggttccaagtgaagaagaaacagttctttcgaaacttcattactattacactgtttggtgcagttggcaccttgatctcttttactgtaatatcccttggcgctctaggactaatatcaaggcttaatatcggcgcacttgaactgggagactatcttgcacttggggcaatattctcggccacagactcggtttgcaccttgcaggtgttaagccaagatgagacaccattcttgtacagcctcgtgtttggtgaaggtgttgtcaatgacgcaacttctgttgtgttgttcaatgcaatccagaactttgatcctggaaatatcagcagtgccaaattactgaacttcattggcagtttcctttatctgttcggctccagcaccattcttggagtagcttctggacttcttagtgcttataccattaagaagttgtacttcggcaggcattcaaccgatcgtgaagtttccattatgatgctaatggcttatttatcttacatgctagctgaattgctcgatttgagtggcattctcactgtgtttttctgcggtatcgtaatgtcacactatacttggcacaatgtaacagaaagttcgagggtcacaaccaagcatgcctttgcaacattgtcgtttatctccgagacttttctgtttctttatgttggtatggatgcattggatatagagaagtggaagattgtcggtcaaacttatagcccggtaaagtctatcgctttgagcagcaccattttagccttggtgctggtttcaagagctgcttttgttttcccactatcctttgtatcaaatttgaccaaaaaaactccaaatggaaagatatcttttaggcagcaggttattgtttggtgggcgggtctcatgagaggtgctgtgtctattgcgttggcttacaataagttcacaagatcaggccatactcaacaacctagcaatgctatcatgatcacaagcacaatcagcgttgttcttttcagcacaattgtctttgggctgctgacgaagccactgatcaggctcttgatcccgtcaaggcacctatccagggaaccaagcgccctttctgaaccttccagcccgaagtctttctttgagcagctggccgccaacagccctggacacccggatcttgagaatggcataagcctacgacgcccggcgagcctccgttttctcctagtaagcccggcacggtccgtccaccattactggcgcaagttcgatgacagtttcatgcggccggtgtttggtggccgtggcttcgttcccttcgtccctggttcacccactgagagcagcttgccattgcttcctggcaatgagaactgaaaccagcgtatcgaggggctttaattcagcagaagttttgtaaattggcttcgcttatggttataatattttgtgtaaatctaggtttgtagattcaacttggtagcatgtacatgttgatgtaggctagttaactgaccagcgaccaaacggctgtgcatattgatatctcgtcgctctcaatgagtttgtatttataaaatactctgtacatcggatcactaaatatgtatcgtctccaacttaataaatactcatccgttctaaaataatattagtcgttttagatttccaaaaaaaaaaaaaaa

SEQ ID NO: 969 - DNA, 2313 bp, Oryza sativa
  CDS (297)..(1904)
gagaagagagttttgtagcgagctcgcgcgaatgcgaagccaaccgagagaggtctcgataccaaatcccgatttctcaacctgaatcccccccccacgttcctcgtttcaatctgttcgtctgcgaatcgaattctttgtttttttttctctaattttaccgggaattgtcgaattaggcattcaccaacgagcaagaggggagtggattggttggttaaagctccgcatcttgcggcggaaatctcgctctcttctctgcggtgggtggccggagaagtcgccgccggtgaggcatggggatggaggtggcggcggcgcggctgggggctctgtacacgacctccgactacgcgtcggtggtgtccatcaacctgttcgtcgcgctgctctgcgcctgcatcgtcctcggccacctcctcgaggagaatcgctgggtcaatgagtccatcaccgcgctcatcatcgggctctgcaccggcgtggtgatcttgctgatgaccaaagggaagagctcgcacttattcgtcttcagtgaggatctcttcttcatctacctcctccctccgatcatcttcaatgcaggttttcaggtaaagaaaaagcaattcttccggaatttcatgacgatcacattatttggagccgtcgggacaatgatatcctttttcacaatatctattgctgccattgcaatattcagcagaatgaacattggaacgctggatgtaggagattttcttgcaattggagccatcttttctgcgacagattctgtctgcacattgcaggtcctcaatcaggatgagacaccctttttgtacagtctggtattcggtgaaggtgttgtgaacgatgctacatcaattgtgcttttcaacgcactacagaactttgatcttgtccacatagatgcggctgtcgttctgaaattcttggggaacttcttttatttatttttgtcgagcaccttccttggagtatttgctggattgctcagtgcatacataatcaagaagctatacattggaaggcattctactgaccgtgaggttgcccttatgatgctcatggcttacctttcatatatgctggctgagttgctagatttgagcggcattctcaccgtattcttctgtggtattgtaatgtcacattacacttggcataacgtcacagagagttcaagagttacaacaaagcacgcatttgcaactctgtccttcattgctgagacttttctcttcctgtatgttgggatggatgcattggatattgaaaaatgggagtttgccagtgacagacctggcaaatccattgggataagctcaattttgctaggattggttctgattggaagagctgcttttgtattcccgctgtcgttcttgtcgaacctaacaaagaaggcaccgaatgaaaaaataacctggagacagcaagttgtaatatggtgggctgggctgatgagaggagctgtgtcgattgctcttgcttacaataagtttacaagatctggccatactcagctgcacggcaatgcaataatgatcaccagcaccatcactgtcgttctttttagcactatggtatttgggatgatgacaaagccattgatcaggctgctgctaccggcctcaggccatcctgtcacctctgagccttcatcaccaaagtccctgcattctcctctcctgacaagcatgcaaggttctgacctcgagagtacaaccaacattgtgaggccttccagcctccggatgctcctcaccaagccgacccacactgtccactactactggcgcaagttcgacgacgcgctgatgcgaccgatgtttggcgggcgcgggttcgtgcccttctcccctggatcaccaaccgagcagagccatggaggaagatgaacagtgcaaagaaatgagaatggaatggttgatgaggagaatacatgtaaaatgtgacagcaaaagagagaaggcaagttttgggtttgtagagtttggctgctgctaatgagttgttgatagtgcctatattcttcagaacttcagatggtgcctcaccaaggcctaagagccaggaggaccttctgataatggttcgggatgattggtttgttctgtcaggatgaaccctagtgagtgacacagggtgatgtgctccgacaacctgtaaattttgtagattaacagccccatttgtacctgtctaccatctttagttggcgggtgttctttcctagttgccaccctgcatgtaaaatgaaattctccgccaaaatagatttgtgtgtataataattttgcttggttg

SEQ ID NO: 970 - DNA, 2747 bp, Zea mays
  CDS (124)..(2409)
gaattcccgggtcgacccacgcgtccgcccacgcgtccgcggacgcgtgggcgcgtctcccacacggccgccgccctcgccttcgtgcgttccccgcgtagagtttagggttttgtcgccgccatggcgatcctctcggcgctcgccaccgaggtgttcatccccgtcgccgccgtcatcggcatcgccttcgccgtcgtgcagtgggtgctcgtgtcgcgggtgaagctctccccggctgcagccgcgtccggcggcagcaagaacggctacggcgactacctcatcgaggaggaggaggggctcaacgaccacaacgtcgtcgtcaagtgcgccgagatccagaccgctatctccgaaggagcaacatcgtttcttttcactgagtaccaatatgttggtatcttcatgtccatctttgctgttgtgatcttcctcttccttggttcggttgagggattcagcacgaagagccagccctgcacctatagcaaggacaagtactgcaagcctgcactgttcactgcactctttagcactgtgtccttcttgcttggagccatcacctctctggtctccggtttccttggcatgaagattgccacatatgcgaatgccagaactaccctggaagctaggaagggtgttggcaaggcttttatcaccgcttttcgctctggtgctgttatgggcttcctgcttgcatcaagtgggcttgtggttctgtacatcaccattaatgtatttaagttgtattacggtgatgactgggagggtctttttgagtctatcactggctatggccttggtgggtcgtccatggctctctttggaagagttggtggaggcatctacacaaaggctgctgacgttggtgctgatcttgttggaaaggtcgagaggaacattcctgaggatgatcctaggaacccagctgtgattgctgataatgtcggtgacaatgttggtgacattgctggaatgggatctgatctctttgggtcatatgcagagtcttcctgtgctgcccttgttgttgcgtctatttcatctttcggaatcaaccatgatttcactgggatgtgctacccactccttgttagctctgttggtatcattgtctgcttgatcaccaccctttttgctactgatttctttgaagtcaaggctgtgaaagaaattgagcctgcacttaagaagcagctcatcatctccactgtcctgatgactgttggtattgctgtaatcagctggttggcccttccagctaagtttaccatcttcaactttggtactcagaaggatgtctccaactggggcttgttcttctgtgttgcaattggtctgtgggctggtctgattattggttttgtcacagaatactacactagcaatgcatacagtcctgtgcaagacgttgcagattcttgcagaactggtgctgccactaatgtcatttttggtcttgctcttggatacaagtcagttatcatcccgattttcgctatcgctgttagcatctatgtcagtttctccattgctgcaatgtacggcatcgcagttgccgctcttggtatgctgagcacaattgcaactggtcttgctattgatgcttatggtcccatcagtgacaatgctggtggtattgctgagatggctggaatgagtcacagaatccgtgagagaactgatgctcttgatgctgctggcaacaccactgccgctattggaaagggatttgccattggttcagctgctcttgtgtctctggcgctttttggtgccttcgtcagcagagctggagtgaaggttgtcgatgtcctctcccccaaggttttcattggtttgattgttggagccatgcttccctattggttctctgccatgaccatgaagagtgttggaagtgccgccctaaagatggtggaggaggtccgcagacagttcaacaccattcctgggttgatggagggaactgccaagcctgactatgcaacctgtgtgaagatctccactgatgcttccatcaaggagatgattcctcctggtgctctggtcatgctcactcccctcattgttggaaccctcttcggtgttgagactctctctggtgttcttgccggtgccctggtttctggagtgcagattgccatctctgcttccaacaccggtggtgcatgggacaatgctaagaagtacattgaggctggtgccagcgagcatgccaggaccctcggccccaagggatctgactgccacaaggctgctgtgataggtgacaccattggtgaccccctgaaggacacctcgggcccgtccctcaacatcctgatcaagctcatggcggtggagtcccttgtgtttgcccccttcttcgccacccacggtggcctgctgttcaagtacctgtaagggccacaccaatcatcacagcagaaatatacgaccgaccgaccgtggacatctcgaataactcctgccaaatcgccagttcatgtgtattgtgcgctagccgcctagctgcactgctgtttttttggtctcattgttcgtattttctccttggcccctccccctagaggcgttactgttagccttactcttactccctgtagctgcacgtagaagagaactgttgtcctgcaggtctggcaaattttcccagtctcttgatgatggcgatgatgttgaaatctttgaacaatgatacatgattgttgcaaaaaaaaaaaaaaaagggcggccgc

SEQ ID NO: 971 - DNA, 2796 bp, Zea mays
  CDS (93)..(2390)
ccacgcgtccgctcccggattctctccggttcgtgggagggccaaagcttcgagttaggaaaaccctaccgctgtgggagtagcctccggcgatggctgcggcggcgatcctgccggagctggcgacgcaggtgctcatcccggtcgcggcggccgtgggcatcgcgttcgcggtggtgcagtgggtgctggtctccaaggtgcgggtcacccccgagcgccgcgcggacggcggggccgtgaagagcgggcccagcgactacctcatcgaggaggaggagggactcaacgaccacaacgtcgtcgtcaagtgcgccgagatccagaccgccatctctgaaggagctacatctttccttttcactgagtacaagtatgttggattattcatgggcatctttgcaatccttatattcctcttccttgggtctgtcgagggattcagcacgaagagtcaaccttgccactatatcaaggaccagacttgcaagcctgcccttgctaatgccatcttcagtactatagcttttgtgcttggtgcagtcacctcactagtttccggctttcttggaatgaagatcgcaacttatgcgaatgcccggacaactttagaggccagaaagggtgtcggaaaggcatttattactgccttccgagctggtgcagtaatgggcttcctgcttgctgccagcggtcttttggttctttacattgctatcaatttgtttggaatttattacggtgatgactgggaaggtctttttgaagctattactggttatggccttggtggttcttctatggctcttttcggccgcgttggtggtggtatttataccaaggctgctgatgttggtgctgaccttgtggggaaggtagaaagaaacattcctgaggacgatccaagaaacccagctgttattgctgacaatgttggtgataatgttggagatattgctggaatgggatcagatctctttggctcatatgctgaatcatcatgtgctgctcttgttgtggcctctatctcgtcttttggaatcaaccatgaatttactccgatggtgtaccctcttctcgtcagttctgttggtattatagcatgtctcataacaacgctgtttgcaactgatttcttcgagataaaggctgtggatgaaatagagcctgctctcaagaaacagctcataatttccacaattgtgatgaccattggcattgcactaatcagttggcttggtcttccatacactttcactattttcaactttggagtccagaagacagtgcaaagctggcaattgttcttgtgtgtggcggttggtctctgggctggcctagtcattggttttgttactgagtactacacaagcaatgcctacagccctgtacaagatgttgctgattcctgcagaactggagcagctactaatgtcatttttgggcttgctttgggttacaaatcagtcattatcccaatttttgctattgcgtttagtatcttcctcagcttcagccttgctgccatgtatggtgttgctgtggctgctcttggaatgctgagcaccattgccacaggtcttgctattgatgcatatggccctatcagtgataatgctggaggaatagctgaaatggctgggatgagccataggattcgtgagagaactgatgctctagatgctgcaggaaataccacggctgcaattgggaagggttttgccattggctctgcagccttggtttcccttgcactatttggtgcgtttgtaagccgggctgctatctccactgttgatgttctgactcctaaagtattcatcgggcttattgtcggtgctatgctcccgtactggttctcggcaatgaccatgaagagtgtgggcagtgctgcgctcaagatggtggaggaagttcgtcggcagttcaacaacatccctgggctcatggaaggcaccacaaagcctgactacgcaacttgtgtcaagatctcaacggatgcatccatcaaggagatgatccccccaggtgctcttgttatgctcacaccactgatcgttgggattctatttggggttgagaccctctctggagtccttgctggtgcccttgtctctggtgttcagattgccatttctgcatccaacactggtggtgcctgggacaacgccaagaagtacattgaggctggagtttcagagcatgccaggacccttggcccaaaaggttctgaccctcacaaggcggctgtcattggtgacaccattggagatcctctcaaggacacgtctggcccttccctcaacatcctcatcaagcttatggcggttgaatcccttgtcttcgcccccttcttcgccgcccatggtggcattctcttcaaatggctctaagccagcgagagacgcaggataaaggccgtagttttgcaaggcgagtagagcagtatgtcagtaatacagcatctatggcatgtgcttttgctcgtccagttcatgagccccgttgtgtatttggtttccgttttcttggttggagtttttagttccaaggtccgatcatgttttgatcccataaattctcttccagccttcgagcaactgagtccatcttcctaagtcatcagccccagcgagacattgaagcatggggaaacttaaacagtatggtgatgattaatctcagcattttttttcttgcagcaaaaaaaaaaaaaaaaaaaaaaaaaaaaaaaaaaaaaaaaaaaaaaaaaaaaaaaaaaaaaaaaaaaaaaggggcgggcggttctagaagaac

SEQ ID NO: 972 - DNA, 2571 bp, Zea mays
  CDS (35)..(2329)
caactccctccatcgtcttgaggcgtgcgcagccatggctgtcctcggcaccgcggcggttgaggtgctcatcccggtagcggcattggttggcatcgctttcgcgttgttgcagtggtatgtggtggccagagtccccgtgccttcgcacgccggcgaggacggcggtggaggaggcaataagaacgtgagggaggaggaggagcatgtggaggaggacggcatggactaccttctcgtggaggcccggtgcgccgagatccagcgcgccatctccgtcggcgccacgtcgttcctgctaaccgagtacaagtacctggccgtgttcacggcggcgttcgcggtggtgatcttcgtgttcctgggttcggcgcagcggttcagcgcgcgccctgggccgtgcgcgtacgacccgtcgcgggagtgccggccggcgctggcgaacgcggccttcagcgcggtggcgttcctgctgggcgcggcgacgtccgtgctgtccgggtacctcggcatgcgcgtggcgacgttcgcgaacgcgcggacggcgctggaggcccgccacggcgtggggcgcgccttcgccgccgcgttccggtcgggcgccgccatggggttcctcctcgcctccagcgcgctgctcgtgctctacgccgccgtcaacctcttcggcctctactacggcgacgactggggcgggctctacgagtccatcaccggatacggcctcggcgggtcctccgtcgcgctgttcggtcgcgtgggcggcggcatctacaccaaggccgctgacgtcggcgccgacctcgtcgggaaggtcgagcgcaacatccccgaggacgaccctcgcaaccccgcggtgatcgccgacaacgtgggggacaacgtcggcgacatcgccgggatggggtcggacctgttcgggtcgtacgcggagtcgtcctgcgcggcgctcttcgtggcttccatctcctccttcggggcggagcacaacctcacggcgatgatgtacccgctgctcatcagcgccgtgggcctgctcgtgtgcgcgatcaccactgtcgtcgccaccgacgtcaccgaggtgaagggttccgacgaggttgggccggcgctcaagcggcagatcctcatctccaccgtgcttatgaccgccggcatcgccgccgtcaccttcctcggcctgccgcccagcttcaccctcttcgacttcggcaacgacaagcacgtcaagaactggcacctattcatctgcgtgtcggccggtctgtgggcggggctcgtgatcggctacgtcaccgagtacttcacgagcaacgcgtacggcccggtgcaggcggtggcgcggtcgtgcaggacgggcgcggcgacgaacgtcatcttcggcctggcggtgggttacaagtcggtgatcgtgcccatcatggccatcgcggcggccatctacgccagcttccgcctggcggccatgtacggcatcgcgctggcggcgctggggatgctgagcaccatcgccacggggctcgccatcgacgcctacgggcccatcagcgacaacgccggcggcatcgcggagatggccggcatgccgcaccgggtccgggagcggacggacgcgctcgacgccgcgggcaacaccacggccgccatcggcaaaggcttcgccatcggctccgcggcgctggtgtcgctggcgctgttcggcgcgtacgtcagccgcgccgggatcacggcggtggacgtgctgagcccgcgtgtgttcgtgggactcctcctcggcgccatgctcccctactggttctcggcgatgaccatgcggagcgtcggaagcgcggcgctgaggatggtggaggaggtgcgccgccagttcgacaccatcccgggcctcgccgagggcctcgccgtgccggactacgccacctgcgtcaggatctccaccgacgcctcgctcaagaagatgatggcgccgggcgcgctcgtcatgttcagcccgctcgtcgccggtacgctcttcggggtcgagacgctcgcggggctcctcgccggcgcactcgtctccggcgtccaggtcgccatctctgcctccaacagcgggggtgcatgggacaacgccaagaagtacatcgaggccggcttgtcggaggaggcgaggtcgctggggcccaagggatcggaggcgcacaaagcggcggtgatcggggacaccatcggcgacccgctcaaggacacctccggaccgtccctcaacatcctcatcaagcttatggccgtggagtcgctcgtcttcgcgcccttcttcgccgcgcacggtggcatcatcttcgaccacctctgatcaatgcatgctgctgacgttccatggcaaaggcgccggctgtcgccgcaagccgcctctttgaatttgccgtgatcagttagtaagaataatcgtcgtgtatgtagcctgtaacaagtaatgccagaccaccagagttggaggcttattcatgtctggccctcttatcttacccttgaatatgttgctcggtatgctgcaactgcaatacaaagcgcgaacactagtcggctaaaaaa

SEQ ID NO: 973 - DNA, 750 bp, Anabaena
  CDS (1)..(747)
atgaagccatttctttttgtcaccgatttggatcatactctggtaggtaatgatgcagccctggcagaactcagccagatactcactcaccatcgtcaagaatatggcacaaagatagtttatgccactgggcgatcgcctattctttacaaagaactgcaagtagaaaaaaacctgatagaacctgatgggttagttttgtctgtgggtacggaaatctatcttgatggtagtggtaatcctgattctgactggtcagaaattcttaacgatggctggaatcgagaactagtattgtccgtaactaaaaaatttcctgaattaatgctgcaaccagactcggaacaacgtccttttaaagtcagtttttttctgcatcaagaagcctcatttaaggtcataccacaacttgagacagagttagcgaaatgtaaactaaatataaagttaatttatagtagcggtatagaccttgacattgtaccattaaacagcgataaaggtcaggcaatgcagtttcttcgtcaaaagtggaaatttgcagcagaaagaacagttgtctgtggtgattcaggtaatgatattgctttgttcgctgtgggcaacgaaaggggaatcatcgtcgggaatgcccgaccggagttgcttcagtggcacagtgagtatcccgcagaccatcgctacctggcaaaaaacttttgtgcaggtggaattattgaaggtttacaattctttggtttcctcgaatga

SEQ ID NO: 974 - DNA, 1272 bp, Zea mays
  CDS (1)..(1269)
atggataagctcagtggttctgcacgtcttatgattgtttcagatcttgaccatacaatggttgatcatcatgacgaggagaacctgtccttgcttaggtttggtgccctgtgggaatctgtttactgtgaggattctctactagtcttctcgactggaagatcaccaactctttacaaggaattaaggaaagagaagcctatgctaactccagacatcactatcatgtctgttggcactgagataacatatggggaggcaatggttcctgatgatggctgggaagaatatctgaacaataagtgggacaggaatattgttgtagcagaaactgtgagcttttctgagctgaagcttcagccagagacagaacagcgcccgcacaaggtcagcttttttgttgataagaagaatgcccaggaagtgataaaatctgttgccgagagattggacaaatgtgggctagatgccaaaataatatatagtggtggccaggaccttgatatattacctcaaggagctggaaagggccaagcacttgcatatttgcttgaaaagctaagctcatgtggaaaaccgcccaacaatactcttgtttgtggtgactctggtaatgatgcagaattattcagcatccctggtgtacatggtgtcatggtcagcaatgcccaagaggaactacttcagtggtacacagaaaatgcgaaggataacccaaagataattcattcaaatgagagatgtgcagctggtattatacaagctattggacacttcaagctaggacctaacatttctcctagagacctgcagtttccttatgcaaaggaagcctctttcaaacctacagatgctgtagtgaagttctacgttctctatgagaagtggcgcagggctgaggttccaaagtctgattcagttataaagtacttcaaaaacatcactcatgcaaatggagttaccatccatcctgctgggcttgaactctcactccatgcatccattgatgcgttgggatcatgttatggtgacaaacaagggagaaagtaccgagcatgggtggacagactttttatcacacagactggttcagatagttgggtggggaggtttgacttgtgggaatcagaaggtgatgtgcgtgtgtgttctctgtcaagtcttgctttgattctgaaggctgaatccccagagggctttgtgctaacccacatccaaaagacatggctgaacggatactcgtcaggggttgagcaggcgtttaagctgtag

SEQ ID NO: 975 - DNA, 1422 bp, Zea mays
  CDS (1)..(1419)
atggccaccgccgcggtgtcggtcgacgagaagctcgacaagcttcgcgccgaggtcgccaagctcgaccagatcagcgagaacgagaagtccgggttcatcagcctcgtgtcacgctacctcagtggggaagcggagcagatcgagtggagcaagatccagacccctacggatgaggtggtggtgccctacgataccgtcgcgtcgcctcccgaagatctcgaggagacgaagaagctgctggataagctcgttgtgctcaagcttaacggagggctcgggacgaccatgggctgcactgggcccaagtctgtcattgaagtccgcaatgggttcacattccttgaccttattgtgattcaaattgagtccctgaacaagaagtatggatgcaatgtccctttacttctgatgaactctttcaacacccatgatgacacacagaagattgttgagaagtattccaactccaacatcgaaattcatactttcaatcagagccagtatcctcgcattgttaccgaggacttcttgccacttcccagcaaagggaaatctgggaaggatggctggtatcctcctggtcatggtgatgtgtttccctctttgaataacagcggaaaacttgacatcttattggctcagggcaaagagtatgtctttgttgcaaactcagacaacttgggtgctatagtcgacatcaagatcctaaaccatctgatcaataaccagaacgagtactgcatggaggttactccaaagacgctggctgacgttaagggtggcactctcatctcttacgaaggaagagttcagcttttggagattgcccaagtacccgatgagcatgtgaatgaatttaaatcaatcgagaagtttaagatattcaacactaacaacttgtgggtgaaccttaaagctatcaagagactcgtagaggctgaggcacttaagatggaaattattccaaaccccaaggaagttgatggtgtgaaagtccttcaactcgaaaccgcagctggtgcagctattcggttcttcgacaaagcgattggaattaatgttccccgctcaaggtttctcccagtgaaggctacatctgatctgttgcttgtgcagtctgatctttacaccttggttgatggctttgtcatccgcaacccatccagagcgaatccagctaacccttcaattgagcttggacctgagttcaagaaggttgccaatttccttgctcggttcaagtccatccccagcatagttgagcttgacagcttgaaggtttctggtgatgtctggtttggctctggaattacactcaagggcaaggtgacaattatcgccaagcctggagtgaagttggagattccagatggagacgtacttgagaacaaggatgtcaatggccctgaggatctttaa

SEQ ID NO: 976 - DNA, 2163 bp, Synechocystis PCC6803
  CDS (1)..(2160)
atgagctattcatcaaaatacattttactaattagtgtccatggtttaattcggggagaaaaccttgagttgggcagagatgccgacaccggcgggcaaaccaaatatgtgctggaactggcccgggccttggtaaaaaatccccaggtggccagggtggatttgctgacccgtttaattaaagatcccaaagtagatgcagattatgcccagcctagagaacttattggcgatcgggcccagattgttcgcattgagtgcggcccggaggaatatattgccaaggaaatgctctgggactatttggataattttgctgaccatgccctggactatctcaaagaacagcccgaactgcccgatgtcatccatagccattacgccgatgcgggttacgtgggcaccagactttctcaccaattgggtattcctttggtgcacaccggacattccctgggtcgtagtaagcgcacccgtctcctgctcagtgggattaaagccgacgaaattgaaagccgttacaatatggcccgccggattaacgcggaggaagaaaccctaggatcagcggcgagggtgattaccagtacccatcaggaaatcgcagaacagtacgcccaatacgactattaccagccagaccagatgttggttattccccccggcactgatttagaaaagttttatccccccaaagggaacgagtgggaaacgcccattgttcaagagttgcaacgatttctacggcatccccgtaagcctattatcctcgctttgtcccgaccggatccccgcaaaaatatccataaattaattgcagcctatggccagtccccgcagttacaggcccaggccaatttggtcattgtggcgggcaatcgggatgacatcacggatctagaccaggggccgagggaagtactgacggatttactgttgaccattgaccgttacgatctctacggcaaagtggcttaccccaaacagaatcaggcggaggatgtgtatgctttgtttcgcctcactgctttatcccagggagtatttatcaatccggctttgacggaaccctttggtttaactttgattgaagcggcggcctgtggtgtgcccattgtggccacggaggatgggggcccggtggatattatcaaaaattgtcagaatggctatctaattaatcccctcgatgaagtggatattgcggataaattgctcaaagtactaaacgacaaacaacaatggcaattcctttctgaaagtggtctagagggagttaagcgccattattcttggccttcccacgttgaaagttatttagaagccatcaacgctctgacccaacagacttcagtgctgaaacgtagtgatttaaagcggcggcggactttgtactataacggtgccctggttactagtttggaccaaaatttactgggggcattacaggggggattaccgggcgatcgccagacgttggacgaattactggaagtgctgtatcaacatcgaaaaaatgtcggcttttgcattgccactgggagaagattggattcggtgctgaaaattttgcgggagtatcgcattccccaaccggatatgttgatcaccagcatgggcacggaaatttattcttccccggatttgatccccgaccagagttggcgcaatcacattgattatttgtggaaccgtaacgccattgtgcgtattttgggggaattacccggtttagccctccaacccaaggaagaactgagcgcctataaaattagctatttctacgatgcggcgatcgcccctaacctagaagaaattcggcaactgttgcataaaggggaacaaaccgtaaataccatcatttcctttggtcaatttttggatattctgcccatccgagcttccaaaggctatgctgtgcgttggttgagccaacagtggaatattcccctggagcacgttttcaccgccggaggatcgggagccgacgaagatatgatgcggggtaacaccctttccgtcgtcgtggctaaccgtcaccatgaggaactttctaatctaggggagatcgaaccgatttatttttccgaaaaacgttacgccgccggtattctggacggtctggcccattaccgcttctttgagttgttagaccccgtttaa

SEQ ID NO: 977 - DNA, 3268 bp, Zea mays
  CDS (29)..(2920)
gcccgatctcatctcgccggcggcggcgatggcgggcaacgataattggatcaacagctacctcgacgccatcctagacgccggaaaggctgccatcggcggcgaccggccttccctcctcctccgcgagcgcggccatttctcccccgcgcgctacttcgtcgaggaggtcatcaccgggtacgacgagaccgacctctacaagacatggctacgcgcgaacgccatgcggagcccgcaggagaggaacacgcggctcgagaacatgacgtggaggatctggaaccttgcaaggaagaagaaggagttcgagaaagaagaagcttgtcgtatgtcaaaacgccagccagaaactgagaaaacacgagctgatgctactgcagatatgtctgaagatctctttgaaggagaaaaaggagaagatgctggtgatccatctgtcgcatacggggacagcaccacggggagctcacctaaaacaagttcaattgacaagctatacatagtattgatcagtctacatggtctggtccgtggtgagaatatggagcttggccgagattcagatacgggtggccagatcaaatatgtggttgaacttgctaaagcattaagttcatccccaggagtttaccgggttgacctgctaacaagacaaatcttagcaccaaattttgatcgtagttatggtgaacctaaagaattattggtttcaacaagtggtaaaaattataaacaagaaaagggagaaaatagtggtgcatatataattcggataccgtttggtccaaaagacaagtatctagctaaagaacatctatggcctttcattcaagaatttgttgatggtgcactcagccatattgtgaggatgtcaaaagccataggtgaagaaactggccgtgggcatccagtatggcctgctgtgattcatggacattatgccagtgcaggaattgctgctgcgttactttctggagcacttaatcttcctatggcgttcacaggacattttcttgggaaagataaattggaagggcttctcaaacaagggagacaaactagggaacagataaatatgacatacaaaataatgtgccgaattgaggccgaggagctatctcttgacgcatctgagattgtcattgcaagcactaggcaagaaatagaagagcagtggaacttgtatgatggttttgaggttatacttgcaagaaagctccgagcaagagttaaacgtggtgctaattgttatggccgttttatgcctcgtatggttataattcctcctggagttgaatttggtcacattattcatgattttgatatggatggcgaagaagagaatccatgcccagcatctgaggatccacctatttggtctcagataatgcgcttctttacaaatcctaggaagcctatgattctagctgttgcccgcccttatcctgagaagaatattactacacttgtaaaggcatttggtgaatgcaggccattaagggagcttgccaatcttacactgataatgggaaaccgtgaagctatatctaagatgcacaatatgagtgctgctgtcttgacatcagtgcttacattgattgacgaatatgacctgtatggtcaagtggcataccccaagcatcataaacactcagaagttcctgacatttatcgtttagctgcaagaacaaagggggcttttgtaaatgtagcttacttcgaacaatttggagttactctgatagaggctgctatgaatggtttgcctataattgcgacaaaaaatggagcccctgttgaaattaatcaggtcctgaacaatggtctccttgttgatccgcacgatcagaatgccattgcggatgcactatataaacttctttctgataaacatctttggtcaaggtgcagagagaatggactgacaaatattcaccaattctcgtggcctgaacattgcaagaattacctgtcaaggatactaactcttggcccaaggtctcctgctattggtaacagagaggagcggagtaatacacctatttcaggaaggaagaatatcattgttatttctgtagactctgttaacaaggaaggtctagtcaggataatcagaaatgctattgaggtcatacataaagaaaacatgtcgggttcaactggttttgtgctgtcaacttccttaacgatatcagaaatacattcactgctactatctggaggcatgcttcccactgattttgatgctttcatctgcaatagtgggagtaacatttactatccttcacattccggagaaacgtcaaacaactccaagattacatttgcattagatcaaaatcaccagtcacatattgagtatcgttggggaggagaaggcctaaggaaatatcttgtgaagtgggccacttcagtggtagaaagaaagggaagaacagagagacaaattatttttgaagatccagagcactcttcggcgtattgtcttgcatttagagtggttaatcccaatcatcttcctcctttaaaggagttgaggaagttgatgagaatccaatctctccgttgcaatgcattatataaccacagcgctaccagattatctgtagtccctatccacgcatcacgctctcaggccctaaggtacctgtgtatacgattggggatagaagtgccaaatgttgcagtcctcgtgggtgaaagcggcgattcagattacgaggaactgctggggggtctccataggaccgttatcctaaagggcgagttcaacatcgccgcaaacaggatccacacggtgaggagataccccctgcaggatgtcgtcgccctcgatagctcaaacatcatcggtgtcgacggctacaccacggatgatctgaggtctgccctgcagcagatgggtatactggcacggtaacaccttccggagcttccgtttccactaccaggtcaacgaagagaaacgagaaaacagacagaatggtgacgaaacaagtgcgaccgtttccatgctcgatgggaatgccgattttgcattgtaggctgtagcggttgtgttcgtgtgtgtgtgcccgcgcgcggtggtggcctattcttgtgctgtgaataactgcccctcctttgtttgtgatatgccaaaattttgaagtgagtacagtacaaccaaacatgttgatgatggaaaaacgaatggagaaaggggaaaaacaaacaaaaatggtttgggaaaaaaaaaaaaaaaaaaaaaaaaaaaaaaaaaaaa

SEQ ID NO: 978 - DNA, 3608 bp, Zea mays
  CDS (89)..(3265)
ccttccagaaacctccaggatccgactccaatcgaatcgccaaagcagacaggggcgctcgcgggggcgccgagctcgacggggcgagatggccgggaacgactggatcaacagctacctggaggctattctggacgctggcggggccgcgggagatctctcggcagccgcaggcagcggggacggccgcgacgggacggccgtggagaagcgggataagtcgtcgctgatgctccgagagcgcggccggttcagccccgcgcgatacttcgtcgaggaggtcatctccggcttcgacgagaccgacctctacaagacctgggtccgcacctcggctatgaggagtccccaggagcggaacacgcggctggagaacatgtcgtggaggatctggaacctcgccaggaagaagaagcagatagaaggagaggaagcctcacgattgtctaaacaacgcatggaatttgagaaagctcgtcaatatgctgctgatttgtctgaagacctatctgaaggagaaaagggagaaacaaataatgaaccatctattcatgatgagagcatgaggacgcggatgccaaggattggttcaactgatgctattgatacatgggcaaaccagcacaaagataaaaagttgtacatagtattgataagcattcatggtcttatacgcggggagaatatggagctgggacgtgattcagatacaggtggtcaggtgaaatatgttgtagaacttgctagggctttaggttcaacaccaggagtatacagagtggatctactaacaaggcagatttctgcacctgatgttgattggagttatggggaacctactgagatgctcagtccaataagttcagaaaactttgggcttgagctgggcgaaagcagtggtgcctatattgtccggataccattcggaccaagagacaaatatatccctaaagagcatctatggcctcacatccaggaatttgttgatggcgcacttgtccatatcatgcagatgtccaaggtccttggagaacaaattggtagtgggcaaccagtatggcctgttgttatacatggacactatgctgatgctggtgattctgctgctttactgtctggggcactcaatgtacccatggtattcactggtcattctcttggcagagataagttggaccagattttgaagcaagggcgtcaaaccagggatgaaataaatgcaacctataagataatgcgtcgaattgaggccgaggaactttgccttgatacatctgaaatcataattacaagtaccaggcaagaaatagaacagcaatggggattatatgatggttttgatctaactatggcccggaaactcagagcaagaataaggcgtggtgtgagctgctttggtcgttacatgccccgtatgattgcaatccctcctggcatggagtttagtcatatagcaccacatgatgttgacctcgacagtgaggaaggaaatggagatggctcaggttcaccagatccacctatttgggctgatataatgcgcttcttctcaaacccccggaagccaatgattcttgctcttgctcgtccggatccgaagaagaatatcactactctagtcaaagcatttggtgaacatcgtgaactgagaaatttagcaaatcttacactgatcatggggaatcgtgatgtcattgatgaaatgtcaagcacaaatgcagctgttttgacttcagcactcaagttaattgataaatatgatctatatggacaagtggcataccccaagcaccataagcaatctgaagttcctgatatttatcgtttagctgcgagaacaaaaggagtttttatcaattgtgcattggttgaaccatttggactcaccttgattgaggctgctgcatatggtctacccatggttgccacccgaaatggtgggcctgtggacatacatcgggttcttgataatggaattcttgttgacccccacaatcaaaatgaaatagctgaggcactttataagcttgtgtcagataagcacttgtggtcacaatgtcgccagaatggtctgaaaaacatccataaattttcatggcctgaacattgccagaactatttggcacgtgtagtcactctcaagcctagacatccccgctggcaaaagaatgatgttgcagctgaaatatctgaagcagattcacccgaggactctctgagggatattcatgacatatcacttaacttaaagctttccttggacagtgaaaaatcaggcagcaaagaagggaattcaaatgctttgagaaggcattttgaggatgcagcgcaaaagttgtcaggtgttaatgacatcaaaaaggatgtgccaggtgagaatggtaagtggtcgtcattgcgtaggaggaagcacatcattgtaattgctgtagactctgtgcaagatgcagactttgttcaggttattaaaaatatttttgaagcttcaagaaatgagagatcaagtggtgctgttggttttgtgttgtcaacggctagagcaatatcagagttacatactttgcttatatctggagggatagaagctagtgactttgatgccttcatatgcaacagtggcagtgatctttgttatccatcttcaagctctgaggacatgcttaaccctgctgagctcccattcatgattgatcttgattatcactcccaaattgaatatcgctggggaggagaaggtttaaggaagacattaattcgttgggcagctgagaaaaacaaagaaagtggacaaaaaatatttattgaggatgaagaatgctcatccacctactgcatttcatttaaagtgtccaatactgcagctgcacctcctgtgaaggagattaggaggacaatgagaatacaagcactgcgttgccatgttttgtacagccatgatggtagcaagttgaatgtaattcctgttttggcttctcgctcacaggctttaaggtatttgtatatccgatggggggtagagctgtcaaacatcaccgtgattgtcggtgagtgtggtgacacagattatgaaggactacttggaggcgtgcacaaaactatcatactcaaaggctcgttcaatactgctccaaaccaagttcatgctaacagaagctattcatcccaagatgttgtatcctttgacaaacaaggaattgcttcaattgagggatatggtccagacaatctaaagtcagctctacggcaatttggtatattgaaagactaaatctttgatctttgctggtcagcagaggaatcaaagcaggaatgtaggatcgaggagagtgacaggacttcccctctgtgcacttcgccgaaaagtaataatgggattgctatgcatggcccttgttgtacactagaaaattgggcacgcaaacttgtgtcagtttttccgctgttgcgaaattcagtgatggtgtttttgtaactataccaacctgtgtcagttttgccgttgttgcaaaactcagtgatggtgttttttgtaattattatacatccgaataataagactggtgtttccagacagactatgcaagctaaggggaaatcacgattttcct

SEQ ID NO: 979 - DNA, 3328 bp, Zea mays
  CDS (72)..(2987)
gcccggcctccccccaccccacccgcacccgcccgcgcgcccctcattcattcgcctcgatctcgccggcgatgtacggcaacgacaactggatcaacagctacctcgacgccatcctcgatgccggcaagggcgccggccccgccaggggccggggaggcggcggcggggaccggccctcgctgctcctgcgcgagcgcggccacttctccccggcgcgctacttcgtcgaggaggtcatcaccggctacgacgagaccgacctctacaagacctggctccgggcgaacgcgatgcggagcccgcaggagaagaacacgcgcctggagaacatgacctggaggatctggaacctcgccaggaagaagaaggagtttgagaaagaggaagccaatcgcttgtccaaacgccgtctagaggctgagaagccacaaaatgatgctactgcagacatgtctgaagatctttttgaaggtgtgaagggagaagacgttggtgatccatctgttgcctacggtgacagcacagctgggaacacacctaggatcagttcatttgacaagctatacatagtgttaatcagtcttcatggcctgatacgtggagagaatatggagcttggccgtgattcagatactggtggccaggtcaaatatgtcgtggaacttgctaaagcattaagttcatgtcctggagtttaccgggttgatctattgacaagacaaatcatagccccaaattttgatcgtggctatggtgaaccagacgagatgctggctttgacaagtttcaagaactttaaatgcgaacgaggagagaacagtggtgcacatatcatcagaataccatttggccccaaagaaaagcatctagctaaagaaaatatctggcctttcattcaagaatttgttgatggtgcactaggtcatattgtgcggatgtcaaaaactttaggcgaagaaactggcagtgtgtgtccagtgtggcctgctgtgattcatggtcattatgccagtgcaggagttgctgctgctctactatctggagcacttaatgtcccgatggtgtttaccgggcattttcttgggaaagataagcttgaagggcttctcaagcaagggagacagacaagagaacaaataaacgtgacatacaaaataatgcgccgaattgaggcagaggagttgtctcttgatgcgtctgaaatagttatcgctagcacaaggcaagaaatagaagaacaatggaacttgtatgatggttttgaagtcatgcttgcgaggaagctccgtgcgttagtcaagcgtggtgctaactgttatggtcgttatatgcctcgtatggttataattcctccaggagttgaattcggccaattgattcatgattttgatatctatggagatgaagataacccatctccagcctctgaggatccatctatttggtttgagataatgcggttcttcacaaatcctaggaaacctatgattctggctattgcccgtccatatgctgagaagaatatcgcaacgcttgtgaaggcatttggtgaatgccatccgttgagggaacttgctaaccttacattgataatgggtaaccgtgaggctatttccaagatgaacaaaatcagtgcagctgttttgacatcagtgcttacattgattgatgaatacgatttatatggtcaagtggcatacccaaagcatcacaagcactctgaagttcctgatatttatcgtttagcagcaagaacaaagggcgcttttataaatgttgcttactttgaacaatttggtgttaccttgatagaggctgccatgcacgggctgcctgttattgcaacaaaaaatggggctcctgttgaaattcatcaggttctggaaaatggtctccttgttgatccccatgatcagcatgcaatcgcagatgccctctataagatgctgtctgaaaagcaattttggtcaagatgtcgagagaatggattgaaaaatatacaccagttttcttggcctgaacattgcaagaattacttgtcaaggatattaactctaggtccaagacatcctgctttcgcatgcaaagaagaccataaagtgcctgtgaagtgcaggaagcatatattcgttattgctgtagactccgttaacaaggaagatttaattcagattatcagaaattctgttgaggctacacgctctggaactatgtcagatttgacaggttttgtgctgtcgacttcactgacaatagcagagttacagtctgtaatagtacgcacaggcatgctccctactgactttgatgcctttatatgcaatagtgggagtgacatatattatccatcacagtctagtgatgtgccaagcaattcccgtgttacatttgcatcggaccataactaccgatcacatattgagtatcgttggggtggagaaggtttaaggaagtacttagttaagtgggtctcttcagtagtagaaagaagggggagaaccgaaaagcaagtcatctttgaagattcggaacactcttcaacatattgtcttgcatttaaagtgattaatccaagtcatttgcctcctttgaaggagctgcaaaaattgatgagaatccagtcactgcgttgtcatgcactgtataaccatggcgccaccaggttatctgtaattccaattcatgcatcgcgatctcaggctctaaggtatttgtctatttgctggggcatagagttgccagatgctgtggtcattgttggtgaaactggtgattctgattacgaggaactgtttggaggtcttcacaagacagtcatccttaagggtggattcaacactcctgccaataggatccatacggttagaaggtaccctttacaggatgttgttgctcttgatagctcaaatatcattgcaattgagggatttagcactggtgacatcaggtctgctatgcaacaacagcttggtatacccacacgatgacaccaagtgcgatctattttgttattaatagaaagaaacaaagaaaaaaaaatggccaatacaaatatacgatacaaacacttcgtttccattctattggaaatgcccgattttgcctgccagtcgtttaatgtatgtgtgccagtgtgtggtctctgcatgggttatgaatgacattcccttggatccatgcactggaaatttttggagcgaagagcatgtcaatggatacatccagctgtacagaagaaacaaatttgttcaaatgttgatagtgaaaacattttatggaagcattttcagcaacaaagcttccaatatacaaagctcacactttc

SEQ ID NO: 980 - DNA, 1278 bp, Nostoc PCC7120
  CDS (1)..(1275)
atgttccaaaataaaaaacatcggatcgcacttatttctgtttctggagatccagccgttgaaataggtcaagaagaagccggtggtcagaacgtatatgttcgagaagtaggctatgcactagccgaacaaggttggcaagttgatatgttcactcgccgtatcagtcccgaccaggccgagattgtccaacatagtcctaattgccgcactatccgcttacaagcggggccggttgaatttatcggacgtgatcacgtatttgattatttaccggaatttgttgccgaattccaacgcttccaaaagcgccaaggttataactatcaactcattcacacaaattactggttgtcatcttgggtgggaatgcaactgaaaaagcaacaacccttggtgttggtgcatacataccactcattaggagcaatcaaatatcaaacgatcgcagatatacccgccattgcgaatcagcgattagctatagaaaaagcttgtttagagagtgtagacacagtagttgccaccagcccccaagaacagcaacatatgcgcgccctggtttctaagaagggacgcatagagatgattccttgcgggactgacattaataacttcggaaacattgaaaagtcggctgcacgggaaaaactgggaattgagcctgatgccaagatggtattttatgtaggtcgttttgatccccgtaaaggcatagaaaccttagtcagagcggttgctcagtctaggttgagaggtgaagcaaacctccagttagtaattggtggtggtagccgtcctggtcaaagtgatggcagagagcgcgatcgcattgcgaatattgtggctgaactagaactgaacgattgcaccaccttcgctggtcgcctagatcatgaaatcctcccttactactacgctgcggctgatgtttgcgttgtccccagtcactacgaaccctttggtttagttgctattgaagcgatggctagcaaaactcccgtaatcgccagtaatgtaggtggattgcaatttacagtagttccagaagtcacaggtttacttgcacctccacaagatgagtcagcttttgctacagccatagaccgcatattagccaacccaacttggcgagatcagctaggcacagccgcccgccagcgagtggaaaccaccttcagctgggccggtgtagcatcccaattgagtcagctatacactcatctgttaactcaaaatgcgccagaaaagaaggaaaaagaggctgttgcagcgtag

SEQ ID NO: 981 - DNA, 1269 bp, Nostoc PCC7120
  CDS (1)..(1266)
atgaactctaacactgaaaaacgcatagctttaatttcagttcacggagacccagcaatcgaaattggcaaagaagaagctggagggcaaaatgtttacgtgcgcgaagtgggtaaagcattagcccaactgggatggcaagtggatatgtttagccgcaaagtgagtcctgaacaagagttaattgttcaccatagcccactttgtcggacaattcggttaacagcagggccagaagaatttgtaccaagagataatggctttaaatatttaccagaatttgtacaacaactgcttcgattccaaaaagaaaacaacgttaattacccattagtgcatacaaactactggctttctagttgggtgggaatgcagttaaaagcaatccaaggaagcaaacaagttcatacttatcactctttaggagcagtcaagtacaaatctatagatacgattcctttggttgctactaaacgtttatcggtagaaaaacaagtattagaaacagcagaaagaatcgttgctaccagtcctcaagaacagcaacatatgcgatcgctagtttctactaaaggttacattgatatcgttccttgcggtacagatattcaccgctttggttcaattgctagacaagccgcaagagcagaattaggaattgatcaagaagcaaaagtggtcttgtatgtaggacgctttgatcaacgtaaaggcatagaaaccttagtacgtgccatgaatgagtctcaattgcgtgacacgaataaactcaaactaattattggtggtggtagtactcctggtaatagcgatggcagagagcgcgatcgcattgaggccattgtgcaagaattgggcatgacggaaatgactagtttcccaggccgcctcagccaagatgtcctccctgcttactacgctgcggctgatgtttgcgttgttcccagtcactatgaaccttttggattggtggcaattgaagcaatggcaagtggtacacctgtagtagccagcgatgttggtggacttcaatttacggtagtttccgagaaaaccggtttattggtaccaccaaaagatattgctgcgttcaacattgcaattgatagaattttgatgaatccacaatggcgggatgagttaggccttgctgcgaggaaacacgttacccacaaatttggttgggaaggagtagctagccaactggatggaatatacactcaattattgacacaacaggttaaagagccagcattggtaactaaatag

SEQ ID NO: 982 - DNA, 3310 bp, Zea mays
  CDS (105)..(3035)
gcctcgtgccgttgctctcctctctttacccgtcgccgccctcgccctcgccaccacccgcacccgccgcgcggcccccattcgcctcgatttcgccggcggcgatgtacggcaacgacaactggatcaacagctatctcgacgccatcctcgatgccggcaagggcgtcgcggccgcggccgcgggcgccgccaggggccggggcggaggctggggcggggaccggccctcgctgctcctccgcgagcgcggccacttctcccccgcgcgctactttgtcgaggaggtcatcaccggctacgacgagaccgacctctacaagacctggctccgggcgaacgcgatgcggagcccgcaggagaagaacacgcggctggagaacatgacctggaggatctggaacctcgccaggaagaagaaggagtttgagaaagaggaagccattcgcttgtccaaacaccgtttagagactaagaagccacggaatgatgctactgcagaaatgtctgaagatctttttgaaggagtgaagggagaagacgctggtgatccatctgttgcctacggtgacagcacaactgggaacacacctaggaccagtttatttgacaagctatacatagtgttgatcagtctgcatggcctgatacgtggagagaacatggagcttggccgtgattcagatactggtggccaggtcaaatatgtcgtggagcttgctaaagcattaagttcatgtcctggagtttaccgggttgatctattgacaagacaaatcttagccccaaattttgatcgtggctatggtgaactagatgagctgctggcttcgacaagtttcaagaactttagatgcgaacgaggagagaacagtggtgcacatatcatcagaataccatttggccccaaagacaagcatctagctaaagaaaatatctggcctttcattcaggaatttgttgatggtgcactaggtcatattgtgcgcatgtcaaaaactataggcgaagaaactggcagtgtgtgtccagtgtggcctactgtgattcatggccattatgccagtgcaggagttgctgctgctctattatctggagcacttaatgttcccatgttgtttaccgggcattttcttggtaaagataagctggaagagcttctcaagcaaggtaggcagacaagagaacaaataaatgtgacatacaaaataatgcgccgaattgaggcagaggagttatctcttgatgcatctgaaataattatcgcaagcacacggcaagaaatagaagaacaatggaacttgtatgatggttttgaagtcatgcttgcgaggaagctccgtgcgttagtcaagcgtggtgctaactgttatggtcgttatatgcctcgtatggttataattcctccaggagttgaattcggccaattgattcatgattttgatatgtatggagatgaagataaccaatctccagccttggatccatctatttggtttgagataatgcggttcttcacaaatcctaggaaacctatgattttggctattgctcgtccatattctgaaaagaatattgcaacacttgtgaaggcatttggtgaatgccatccgttgagggaacttgctaaccttacactgataatgggcaaccgtgaggctatttccaaaatgaacaaaatcagtgcagctgttttgacatcggtgcttacattgattgatgaatatgatttatatggtcaagtggcatacccaaagcttcacaagcactctgaagttcctgatatttatcgtttagcagcaagaacaaagggcgcttttgtaaatgttgcttattttgaacaatttggtgtcaccttgatagaggctgccatgcacgggttgcctgttattgcaacaaaaaatggggctcctgttgaaatttatcaggttctggaaaatggtctccttgttgatccccatgatcagcatgcaattgcagatgccctctataagatgctttctgaaaagcagttttggtcaagatgtcgagaaaatggattgaaaaatatacaccaattttcttggcctgaacattgcaagaattacttgtcaaggatatcaagtcttggtccaagacatcctgcttttgcatgcaaagaagaccacaaggtgcctgtgaagtgcaggaagcatatatctatcattgctgtagactctgttaacaaggaagatttaattcaaattatcagaaactctgttgaggctacacgcactggaactatgtcaggttctacaggttttgtgctgtcaacttcactgacaatagcagagctacagtctgtaatagtacgcacaggcatgctcccgactgactttgatgcctttatatgcaatagtgggagcgatatatattatccattacagtctagtgatgtgccaagcaattcccgtgttacatttgcgttggaccataactaccgatcacatatcgagtatcgttggggaggagaaggtttaaggaagtacttagttaagtgggcttcttcagtagtagaaagaagggggagaactgaaaagcaagtcatctttgaagattcagaacactcttcaacatattgtcttgcatttagagtggttaatccaaatcatttgcctcctttgaaggagctgcaaaagttgatgagaatccagtcactgcgttgtcatgctctgtataaccatggcgccaccaggctatctgtaattccaatgcatgcatcgcgatctcaggctctaaggtatttgtctattcgctggggcatagagttgccaaatgctgtggtcattgttggtgaaactggtgattctgattacgaggaactgtttggaggtctccacaagacagtcatccttaagggtggattcaacactcctgcgaataggatccatacggtcagaaggtaccctttacaggatgttgttgctcttgatagctcaaatatcattggaattgagggattcagcactggtgacatcaggtctgctatgcaacaacagcttggtatacccacacaatgacaccaactgcaatctattttgttattaatagaaagaaagaaacagataacagaaatatacgatacaaatacttagtttccattctattggaaatgtccgattttgcctgccagtcatttaatgtatgtgtgtggtggtccctgcacgggttatgaatgacattcccttggatcccgcactggagattttttggattgaagagcttgttaatggatacatccagctgtacagacggaacaaatttgttcaaatgttgatagtgaaaacatttt

SEQ ID NO: 983 - protein, 484 aa, Zea mays
MDKSGGEAAAAAAAADDVERRGGDYEQDEHERRGTVWTATAHIVTAVIGSGVLALAWSVAQLGWVAGPLALAGFACVTYYTSTLLAGAYRAPHPVTGHRNRTYMDAVRSYLSPREVFMCGVAQYVNLWGTMVGYTITATISMAAIRQADCLRRDGAGAGARCDAPGTVLMLAFSVVQVVLSQFPGLEHITWLSVVAAAMSFAYSFAGLGLSVGHWVSRGGGGLGGRVAGAAAASSTRKLWNVLLALGNIAFAYTFAEVLIEIQDTLKSPPPENRTMKKAAMYGIGATTIFYISVGCAGYAAFGSNAPGNILAAGGLGPLWLVDIANMCLILHLIGAYQVYAQPVFASVERWAASRWPEAKFMSSAYTVSVSIPLLQRGSVTVAPHKLVLRTAIVGATTAVALAIPFFNAVLGLLGAFSFWPLTVYFPISMHIAQGKIARGTKWWCLLQALSMVCLVISVAVGVGSVTDIVDSLKASSSPFKIVG

SEQ ID NO: 984 - protein, 473 aa, Oryza sativa
MDQHQLDEENQRAALFHSSAPSSSLGADGEEERETVPLLSCKMADDKSDTVQVSEDTAHQISIDPWYQVGFILTTGVNSAYVLGYSASIMVPLGWIGGTCGLILAAAISMYANALLAHLHEVGGKRHIRYRDLAGHIYGRKMYSLTWALQYVNLFMINTGLIILAGQALKAIYVLFRDDGVLKLPYCIALSGFVCALFAFGIPYLSALRIWLGLSTVFSLIYIMIAFVMSLRDGITTPAKDYTIPGSHSDRIFTTIGAVANLVFAYNTGMLPEIQATIRPPVVKNMEKALWFQFTVGSLPLYAVTFMGYWAYGSSTSSYLLNSVKGPIWIKTVANLSAFLQTVIALHIFASPMYEFLDTRFGSGHGGPFAIHNIMFRVGVRGGYLTVNTLVAAMLPFLGDFMSLTGALSTFPLTFVLANHMYLTVKQNKMSIFRKCWHWLNVVGFSCLSVAAAVAAVRLITVDYSTYHLFADM

SEQ ID NO: 985 - protein, 442 aa, Sorghum bicolor
MAGSSSMDTEAAGQQLKHGSGYSIPATAHAVDTDSWQQVSLLMVIGFNCAYVLSFSNLMMVPLGWAWGVACLLLVGAAAWYANWLLAGLHFVDGQRFIRYRDLMGFVFGRNMYYITWFLQFTTLLLCNMGFILLGARALKAINSEFTHTPARLQWFVTATGFIYFAFAYFVPTISAMRNWLATSAALTLAYDVALLAILIRDGKSNKQKDYNVHGTQAEKVFNALGAVAAILVCNTSGLLPEIQSTVREPAVRGMRRALLLQYTAGAAGYYGISVAGYWAYGSAVSEYLPNELGGPRWAAVLINATAFLQSIVSQHLFTVPIHEAMDTRLQRLDEGMFSRYNLTRRLCARGLVFGFNVFVTALFPFMGDFVNLVGSFALVPLTFTFPSMAILKIKGKSGGRCNRLWHWGIIVFSSVLCVATTAAAVRLIFNNARIYHFFADM

SEQ ID NO: 986 - protein, 475 aa, Oryza sativa
MASGQKVVKPMEVSVEAGNAGEAAWLDDDGRARRTGTFWTASAHIITAVIGSGVLSLAWAIAQLGWVAGPAVMLLFAFVIYYTSTLLAECYRTGDPATGKRNYTYMDAVRANLGGAKVTFCGVIQYANLVGVAIGYTIASSISMRAIRRAGCFHHNGHGDPCRSSSNPYMILFGAVQIVFSQIPDFDQIWWLSIVAAVMSFTYSGIGLSLGIVQTISNGGIQGSLTGISIGVGVSSTQKVWRSLQAFGDIAFAYSFSNILIEIQDTIKAPPPSEAKVMKSATRLSVATTTVFYMLCGCMGYAAFGDAAPDNLLTGFGFYEPFWLLDVANVAIVVHLVGAYQVFVQPIFAFVERWASRRWPDSAFIAKELRVGPFALSLFRLTWRSAFVCLTTVVAMLLPFFGNVVGLLGAVSFWPLTVYFPVEMYIAQRGVPRGSARWVSLKTLSACCLVVSIAAAAGSIADVIDALKVYRPFSG

SEQ ID NO: 987 - protein, 455 aa, Zea mays
MGTQAPEKENYPPEKDARSAREKAIDEWLPITSSRNAKWWYSAFHNVTAMVGAGVLSLPYALSELGWGPGIAVLVVSWVITLYTLWQMVEMHEMVPGKRFDRYHELGQHAFGEKLGLWIVVPQQLVVEVGVNIVYMVTGGRSLKKFHDVLVCGDGGASCQGKDNIKTTYFIMIFASVHFVLSQLPNFNSISGVSLAAAVMSLSYSTIAWGASVDKGRMAGVDYHLRATTTPGKVFGFFGALGDVAFAYAGHNVVLEIQATIPSTPEKPSKKPMWKGVVVAYVVVALCYFPVALIGYWAFGNSVQDNILITLSRPRWLIALANMMVVIHVIGSYQIYAMPVFDMIETVLVKKLRFPPGLTLRLISRTAYVAFTMFIAITFPFFGGLLGFFGGFAFAPTTYFLPCVMWLAIYKPKRFSLSWFTNWICIILGVILMILSPIGGLRQIIMDAKTYQFYS

SEQ ID NO: 988 - protein, 446 aa, Oryza sativa
MAPPSAMNTSRAEEKAIDDWLPITSSRNAKWWYSAFHNVTAMVGAGVLSLPFAMSELGWGPGVAAMIMSWVITLYTLWQMVEMHECVPGRRFDRYHELGQHAFGDKLGLWIVVPQQLIVEVGVCIVYMVTGGKSLKKFHDLVAPPSAPPIRTSYFIVIFGCLHLVLSQLPNFNSITGVSLAAAVMSLSYSTIAWAASLHHHNHNNGAAAGGVDYSLTAATPAGRTFNFLSALGDVAFAYAGHNVVLEIQATIPSTPERPSKGPMWRGVVLAYGVVAVCYLPVAFAGYYVFGNAVDDNVLITLERPAWLIAAANIFVVVHVVGSYQIYAMPVFDMLETFLVKKLRFKPGMPLRLIARSLYVLFTMFVAIAVPFFGGLLGFFGGFAFAPTTYFLPCIMWLSIMKPKRFGLSWCINWFCIIIGVLLSVFAPIGGLRSIIVNAQSYKFFS

SEQ ID NO: 989 - protein, 446 aa, Zea mays
MQEQDVDDGGGRTTQQQEKSIDDWLPINSSRKAKWWYSAFHNVTAMVGAGVLGLPYAMSELGWGPGIAVMILSWIITLYTLWQMVEMHEMVPGKRFDRYHELGQHVFGDRLGLWIVVPQQLAVEVSLNIIYMVTGGQSLKKFHDVICDGGRCGGDLKLSYFIMIFASVHLVLSQLPNFNSISAVSLAAAVMSLSYSTIAWGASLHRGRREDVDYHLRATTTPGKVFGFLGGLGDVAFAYSGHNVVLEIQATIPSTPDKPSKKAMWKGAFVAYVVVAICYFPVTFVGYWAFGSGVDENILITLSKPKWLIALANMMVVVHVIGSYQVYAMPVFDMIETVLVKKMRFAPSLTLRLIARSVYVAFTMFLGITFPFFGGLLSFFGGLAFAPTTYFLPCIMWLKVYKPKRFGLSWFINWICIVIGVLLLILGPIGGLRQIILSATTYKFYQ

SEQ ID NO: 990 - protein, 473 aa, Oryza sativa; identical to SEQ ID NO: 984

SEQ ID NO: 991 - protein, 447 aa, Oryza sativa
MGTQVADNYPPAKDGRSAQEKAIDDWLPITSSRNAKWWYSAFHNVTAMVGAGVLSLPYAMSELGWGPGIAVLILSWIITLYTLWQMVEMHEMVPGKRFDRYHELGQHAFGEKLGLWIVVPQQLVVEVGVNIVYMVTGGKSLKKFHDVLCEGHGCKNIKLTYFIMIFASVHFVLSQLPNFNSISGVSLAAAVMSLSYSTIAWGASVDKGKVADVDYHLRATTSTGKVFGFFSALGDVAFAYAGHNVVLEIQATIPSTPEKPSKKPMWKGVVVAYIIVALCYFPVALVGYWAFGNHVDDNILITLSRPKWLIALANMMVVIHVIGSYQIYAMPVFDMIETVLVKKLRFPPGLTLRLIARTLYVAFTMFIAITFPFFGGLLGFFGGFAFAPTTYFLPCIMWLAIYKPRRFSLSWFTNWICIILGVMLMILSPIGGLRQIIIDAKTYKFYS

SEQ ID NO: 992 - protein, 247 aa, Arabidopsis thaliana
MNIAHTIFGVFGNATALFLFLAPSITFKRIIKNKSTEQFSGIPYPMTLLNCLLSAWYGLPFVSKDNTLVSTINGTGAVIETVYVLIFLFYAPKKEKIKIFGIFSCVLAVFATVALVSLFALQGNGRKLFCGLAATVFSIIMYASPLSIMRLVVKTKSVEFMPFFLSLFVFLCGTSWFVYGLIGRDPFVAIPNGFGCALGTLQLILYFIYCGNKGEKSADAQKDEKSVEMKDDEKKQNVVNGKQDLQV

SEQ ID NO: 993 - protein, 291 aa, Oryza sativa
MEHIARFFFGVSGNVIALFLFLSPVVTFWRIIKKRSTEDFSGVPYNMTLLNCLLSAWYGLPFVSPNNILVTTINGTGSVIEAIYVVIFLIFAERKARLKMMGLLGLVTSIFTMVVLVSLLALHGQGRKLFCGLAATIFSICMYASPLSIMRLVIKTKSVEFMPFLLSLSVFLCGTSWFIYGLLGRDPFIAIPNGCGSFLGLMQLILYAIYRNHKGATPAAAAGKGDAADDVEMAEGRNNKVADGGAADDDSYGRRQGGHRSVALACVSNRLRFPACVLLLQVVILARPLLL

SEQ ID NO: 994 - protein, 244 aa, Oryza sativa
MVSNTIRVAVGILGNAASMLLYAAPILTFRRVIKKGSVEEFSCVPYILALFNCLLYTWYGLPVCLPSMGLAYCLRSHSSAYTHGLHPEKERQKFVLRMVLPVLAFFALTAIFSSFLFHTHGLRKVFVGSIGLVASISMYSSPMVAAKQVITTKSVEFMPFYLSLFSFLSSALWMIYGLLGKDLFIASPNFIGCPMGILQLVLYCIYRKSHKEAEKLHDIDQENGLKVVTTHEKITGREPEAQRD

SEQ ID NO: 995 - protein, 252 aa, Zea mays
MISPDTIRTAIGVIGNGTALVLFLSPVPTFIRIWKKGSVEQYSPIPYVATLLNCMMWVLYGLPAVHPHSMLVITINGTGMAIQLTYVALFLLYSVGAARRKVVLLLAAEVGFVGAVAALVLSLAHTHERRSMVVGILCVLFGTGMYAAPLSVMKMVIQTKSVEYMPLFLSLASLVNGICWTAYALIRFDLYITIPNGLGVLFAVAQLVLYAIYYKSTQEIIEARKRKADQIAMTGVVVDGGKTNNQAGAGQY

SEQ ID NO: 996 - protein, 489 aa, Zea mays
MDYLAAAVPVTLALGVGAILLVLRWTYCRRRTSAEEARLPPGSRGLLFLGETLHYLAASSTPGVLPPFFQRRLERYGPIFRTNLVGEDLVVSLDAELNAHVLKQEERGFQIWYPPSFMRVFGADNITAKLGVLHRHMRTLVLRLFGHQTVRSVLLHDVQRSARDELRSWLGRPDVEVRTATSRMIFGVTANKLISHDDAASGGTLWRCFHDWTSGLLSFPVSIPGTTFYRCMQGRKKVMTMLKQQLVERRRNAAERETTEDFFDLVIDELNKPDPMMDESTALDLLFTMLFASHETTSMVLTVILKYLTDNPKALQELTEEHERILESRADPGSDLTWEEYRSMKFTSHVIHESLRLANIALAMFRKANQDVHINGYTIPKGSKIMMCALASHLNTEVYEDPSVFNPWRWKDIPEPVGTSKDFMAFGGGLRLCAGAEFSKMQMAMFLHYLVTNYSWKPVSGGTMLFYPGLQFPEGFHIQLLPKIPNVVP

SEQ ID NO: 997 - protein, 499 aa, Zea mays
MAFFLALVCILILLAIASYVQYTRWQKGKGRFGGHGRSAPLKLPPGSMGWPYLGETLQLYSQDPSFFFASKQKRYGEIFKTHLLGCPCVMLASPEAARFVLVTQAHLFKPTYPRSKERMIGPSALFFHQGDYHLRLRKLVQGALGPDALRALVPEVEAAVRSTLASWDAGHVRSTFHAMKTLSFDVGIVTIFGGRLDERRKAELRKNYSVVEKGYNSFPNSLPGTLHYKAMQARRRLHGVLCDIMRERRGQAQAAGTGLLGCLMRSRGDDGAPLLSDEQIADNVIGVLFAAQDTTASALTWIVKYLHDHPKLLEAVRAEQAAVREATGGGRQPLAWAHTKSMALTHRVILESLRMASIISFTFREAVADVEYKGFLIPKGWKVMPLFRNIHHSPDYFQDPHKFDPSRFQVAPRPSTFLPFGHGVHACPGNELAKLEMLVLIHHLVTGYRWQIVGSSDEVEYSPFPVPKHGLPVRLWRQNNPVDRKGRETDDDHVERIFI

SEQ ID NO: 998 - protein, 518 aa, Zea mays
MCPVRGGGCSWPASVVGSVTAALLLAAVIVRLFVPRACSSGIIKGRRQVGAGAAGGARLPAGSLGWPLLGETLAFIRAAYSPRPESFVEKRRVLYGKVFKSHLWGSPAVVSSDPEVSRAVLQADASAFVPWYPRSLMELMGQSSILVLGGGLQRRVHGLAGAFFKSPQLKAQVTLDMQRRVGRAMDMWGRRHRSMGDDDSGGMPVRVQNEAKSIVFEILVRALIGLEEGDKMQYLRQQFQEFIAGLISLPVKLPGTQLYRSLKAKKRMTKLIKTIIQEKRKKMMSEGDEDLRGGTHPRDMIDVLLGNGNDELSDELISDNMIDFMIPAEDSVPVLITLAVKYLSECPLALQQLEEENMELKRQKSGAGETLEWTDYMSLAFTQHVITETLRMGNIINGIMRKAVRDVEVRGHLVPKGWRVLVYFRAVHLDAAVHDDPHAFNPWRWKERPDVVAMSGFTPFGGGQRLCPGLDLARLEASIFLHHLVTNFRWVAEEDTVVNFPTVRLKRGMPIAVTPRTC

SEQ ID NO: 999 - protein, 503 aa, Zea mays
MDAGGPPPLFLLGAVLAAALGWLLVVWRAAAGRRRSASARLPPGSTGLPLIGETLRLIAAYKSPNPEPFIDERVARHGSGVFTTHVFGERTVFSADPAFNRLLLAAEGRAVSCSYPSSIATLLGPRSLLLTSGPAHKRLHSLTLTRLGRPASPPLLAHIDRLVLATMRGWDRPGAGAMRLLDEAKKITFNLTVWQLVSIEPGPWTESVRREYVKLVDGFFSIPFPFASLLPFTVYGQALKARKKVAGALREVVRKRMDDKAEDDCGASKKNGEKKDMVEELLEAEGGSFSVEEMVDFCLSLLVAGYETTSVLMTLAVKFLTETPTALAQLKEEHDSIRGVKGKGQALEWSDYKSMPFTQCVISETLRVANLISGVFRRANTDIHFKGHVIPKGCKIFASFRAVHLSLDHYENARTFDPWRWQQGKSKLQSAEGASLFTPFGGGPRLCPGYELARVVVSVFLHHLVTRFSWEEAEEDRIVFFPTTRTLKGYPIILRRRPDCDDL

SEQ ID NO: 1000 - protein, 519 aa, Zea mays
MLGVGMAAAVLLGAVALVLADAAARRAHWWYREAAEAVLVGAVALVVVDAAARRAHGWYREAALGSARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFLAFGLGARLCPGNDLAKLEISVFLHHFLLGYKLARTNPRCRVRYLPHPRPVDNCLAKITRVGS

SEQ ID NO: 1001 - protein, 470 aa, Zea mays
MGAFLLFVCLLAPVVVLACAVRGRKRRASSAAAGGKALPLPPGSMGWPYVGETFQLYSSKNPNVFFARKQNRYGPIFKTHILGCPCVMVSSPEAARFVLVTQAHLFKPTFPASKERMLGPQAIFFQQGDYHAHLRRLVSRAFSPEAIRGSVPAIEAIALRSLESWDGRLVNTFQEMKLYALNVALLSIFGEEEMRYIEELKQCYLTLEKGYNSMPVNLPGTLFHKAMKARKRLGAVVAHIIEARREGERQRGSDLLASFLDDREALTDAQIADNVIGVIFAARDTTASVLTWMVKFLGDHPAVLKAVIEEQQEIARSKGSSGEPLTWADTRRMRTTSRVIQETMRVASILSFTFREAVEDVEYQGYLIPKGWKVMPLFRNIHHSPDHFPCPEKFDPSRFEVAPKPNTFLPFGNGTHSCPGNELAKLEMLVLFHHLATKYRWSTSKSESGVQFGPFALPLNGLPMTFVRKD

SEQ ID NO: 1002 - protein, 1420 aa, Oryza sativa
MLSIASRSPSPALIAPHASARATGLRAPFAGNRIVGWGWGDQTKSGTDRNRASICVVLFLRVRSGEPTQAPRDPPAAVGGGGCYVRLPAPPRDRDAVLSFLVPVSKPAYHVCLFTLLLCFIPITALAESDIKNLFALRKAIAVGKGFLHNWFELETPPCNWSGISCVGLTVVAIDLSSTPLYVDFPSQIIAFQSLVRLNVSGCGFSGELPEAMVNLQHLQHLDLSDNQLGGPLPASLFDLKMLKVMVLDNNMFSGQLSPAIAHLQQLTVLSISTNSFSGGLPPELGSLKNLEYLDIHTNAFSGSIPASFSNLSRLLYLDANNNNLTGSIFPGIRALVNLVKLDLSSNGLVGAIPKELCQLKNLQSLILSDNELTGSIPEEIGNLKQLEVLNLLKCNLMDTVPLSIGNLEILEGLYISFNSFSGELPASVGELRNLRQLMAKSAGFTGSIPKELGNCKKLTTLVLSGNNFTGTIPEELADLVAVVLFDVEGNRLSGHIPDWIQNWSNVSSISLAQNMFDGPLPGLPLHLVSFSAESNRLSGSIPAKICQGTFLQILRLNDNNLTGSIDETFKGCKNLTELSLLDNHLHGEIPEYLALLPLVSLDLSHNNFTGMIPDRLWESSTILDISLSDNQLTGMITESIGKLLSLQSLSIDRNYLQGPLPRSIGALRNLTALSLSGNMLSEDIPIQLFNCRNLVTLDLSCNNLTGHIPKAISHLTKLNTLVLSRNRLSGAIPSELCVAFSRESHSELEYVQHIGLIDLSRNRLTGHIPRAINNCSILVELHLQDNLLSGTIPVELAELRNITTIDLSSNALVGPVLPWPVPLASLQGLLLSNNRLSGSIPSGIGNILPQITMLDLSGNALTGTLPLDLLCKESLNHLDVSDNNISGQIPFSCHEDKESPIPLIFFNASSNHFSGSLDESISNFTKLTYLDLHNNSLTGRLPSAIARVTSLYYLDLSSNDFSGTIPCGICGMFGLTFANFSGNRDGGTFTLADCAAEEGGVCAANRVDRKMPDHPFHVLEATICCIATAIVIVLVVILVVYLRRRRKMLRRRQFVLVPAGDNAMADHETTLSNNLLGRRRMKKREPPSINLATFEHAPVRVTVDEIMRATGNFDGMHVVGDGGFGTVYRAELPGGRRVAVKRLHGVGRRFQGGEREFRAEMETVGKVRHPNLVPLLGYCAAGDERFLVYEYMEHGSLEDRLRGGGGAALGWPERLTICGGAARGLAFLHHGFVPHVIHRDVKSSNVLLGEGLQPRVSDFGLARIISACETHVSTVLAGTLGYIPPEYALAMRCTAKGDVYSFGVVMLELLTGRPPTWSSAEVTAEGDDERGGGGSLVGWVRWMAARGRGGEVFDACLPVSGAEREQMARVLDVARDCTADEPWRRPTMAEVARRVGAIEAMEYGPLVVAVSSGEPPAMP

SEQ ID NO: 1003 - protein, 482 aa, Zea mays
MMMMMMAGEHVLAALGTLLLASLLTLVLNHFLPLLLNPKAPRGSFGWPLLGETLRFLTPHASNTLGGFLEDHCSRYGRVFKSHLFCTPTVVSCDQDLNHFILQNEERLFQCSYPRPIHGILGKSSMLVVLGEDHKRLRNLALALVTSTKLKPSYLGDIEKIALHVVGAWRRHGGVRVVAFCEEARKFAFSVIVKQVLGLSPEEPVTARILEDFLAFMKGLISFPLYIPGTPYAKAVRARERISSTVKGIIKERRSAGSWNKQGDFLDVLLSSNELSDEEKVSFVLDSLLGGYETTSLLISMVVYFLGQSAQDLDLVKREHDSIRSNKGKEECLTSEDYKKMEYTQQVINEALRCGNIVKFVHRKALKDVKYKEYLIPSGWKVLPVFTAVHLNPSLHGDAQQFQPCRWEGTSQGTSKRFTPFGGGPRLCPGSELAKVETAFFLHHLVLNYRWRIDGDDIPMAYPYVEFQRGLPIEIEPTSPES

SEQ ID NO: 1004 - protein, 1294 aa, Oryza sativa
MVSNSFWLFILLVSFIPISAWAESRDISTLFTLRDSITEGKGFLRNWFDSETPPCSWSGITCIGHNVVAIDLSSVPLYAPFPLCIGAFQSLVRLNFSGCGFSGELPEALGNLQNLQYLDLSNNELTGPIPISLYNLKMLKEMVLDYNSLSGQLSPAIAQLQHLTKLSISMNSISGSLPPDLGSLKNLELLDIKMNTFNGSIPATFGNLSCLLHFDASQNNLTGSIFPGITSLTNLLTLDLSSNSFEGTIPREIGQLENLELLILGKNDLTGRIPQEIGSLKQLKLLHLEECQFTGKIPWSISGLSSLTELDISDNNFDAELPSSMGELGNLTQLIAKNAGLSGNMPKELGNCKKLTVINLSFNALIGPIPEEFADLEAIVSFFVEGNKLSGRVPDWIQKWKNARSIRLGQNKFSGPLPVLPLQHLLSFAAESNLLSGSIPSHICQANSLHSLLLHHNNLTGTIDEAFKGCTNLTELNLLDNHIHGEVPGYLAELPLVTLELSQNKFAGMLPAELWESKTLLEISLSNNEITGPIPESIGKLSVLQRLHIDNNLLEGPIPQSVGDLRNLTNLSLRGNRLSGIIPLALFNCRKLATLDLSYNNLTGNIPSAISHLTLLDSLILSSNQLSGSIPAEICVGFENEAHPDSEFLQHHGLLDLSYNQLTGQIPTSIKNCAMVMVLNLQGNLLNGTIPVELGELTNLTSINLSFNEFVGPMLPWSGPLVQLQGLILSNNHLDGSIPAKIGQILPKIAVLDLSSNALTGTLPQSLLCNNYLNHLDVSNNHLSGHIQFSCPDGKEYSSTLLFFNSSSNHFSGSLDESISNFTQLSTLDIHNNSLTGRLPSALSDLSSLNYLDLSSNNLYGAIPCGICNIFGLSFANFSGNYIDMYSLADCAAGGICSTNGTDHKALHPYHRVRRAITICAFTFVIIIVLVLLAVYLRRKLVRSRPLAFESASKAKATVEPTSTDELLGKKSREPLSINLATFEHALLRVTADDILKATENFSKVHIIGDGGFGTVYKAALPEGRRVAIKRLHGGHQFQGDREFLAEMETIGKVKHPNLVPLLGYCVCGDERFLIYEYMENGSLEMWLRNRADALEALGWPDRLKICLGSARGLAFLHHGFVPHIIHRDMKSSNILLDENFEPRVSDFGLARIISACETHVSTDIAGTFGYIPPEYGLTMKSTTKGDVYSFGVVMLELLTGRPPTGQEEVQGGGNLVGWVRWMIARGKQNELFDPCLPVSSVWREQMARVLAIARDCTADEPFKRPTMLEVVKGLKMTHGMECGPLVVTVSRDM

SEQ ID NO: 1005 - protein, 1110 aa, Oryza sativa
MDILIPLLLSSIYVSSSAAAAETDAAALLRFKAFVHKDPRGVLSSWVDPGPCRWRGVTCNGDGRVTELDLAAGGLAGRAELAALSGLDTLCRLNLSGNGELHVDAGDLVKLPRALLQLDLSDGGLAGRLPDGFLACYPNLTDVSLARNNLTGELPGMLLASNIRSFDVSGNNMSGDISGVSLPATLAVLDLSGNRFTGAIPPSLSGCAGLTTLNLSYNGLAGAIPEGIGAIAGLEVLDVSWNHLTGAIPPGLGRNACASLRVLRVSSNNISGSIPESLSSCHALRLLDVANNNVSGGIPAAVLGNLTAVESLLLSNNFISGSLPDTIAHCKNLRVADLSSNKISGALPAELCSPGAALEELRLPDNLVAGTIPPGLSNCSRLRVIDFSINYLRGPIPPELGRLRALEKLVMWFNGLDGRIPADLGQCRNLRTLILNNNFIGGDIPVELFNCTGLEWVSLTSNQITGTIRPEFGRLSRLAVLQLANNSLAGEIPRELGNCSSLMWLDLNSNRLTGEIPRRLGRQLGSTPLSGILSGNTLAFVRNVGNSCKGVGGLLEFAGIRPERLLQVPTLKSCDFTRLYSGAAVSGWTRYQTLEYLDLSYNSLDGEIPEELGDMVVLQVLDLARNNLTGEIPASLGRLRNLGVFDVSRNRLQGGIPDSFSNLSFLVQIDISDNNLSGEIPQRGQLSTLPASQYAGNPGLCGMPLEPCGDRLPTATMSGLAAAASTDPPPRRAVATWANGVILAVLVSAGLACAAAIWAVAARARRREVRSAMMLSSLQDGTRTATTWKLGKAEKEALSINVATFQRQLRKLTFTQLIEATNGFSTASLIGSGGFGEVFKATLKDGSCVAIKKLIHLSYQGDREFMAEMETLGKIKHKNLVPLLGYCKIGEERLLVYEFMSHGSLEDTLHGDGGRSASPAMSWEQRKKVARGAARGLCFLHYNCIPHIIHRDMKSSNVLLDGDMEARVADFGMARLISALDTHLSVSTLAGTPGYVPPEYYQSFRCTVKGDVYSFGVVLLELLTGRRPTDKDDFGDTNLVGWVKMKVGDGAGKEVLDPELVVEGADADEMARFMDMALQCVDDFPSKRPNMLQVVAMLRELDAPPPATAI

SEQ ID NO: 1006 - protein, 1121 aa, Oryza sativa
MDSLWAAIAALFVAAAVVVRGAAAADDAQLLEEFRQAVPNQAALKGWSGGDGACRFPGAGCRNGRLTSLSLAGVPLNAEFRAVAATLLQLGSVEVLSLRGANVSGALSAAGGARCGSKLQALDLSGNAALRGSVADVAALASACGGLKTLNLSGDAVGAAKVGGGGGPGFAGLDSLDLSNNKITDDSDLRWMVDAGVGAVRWLDLALNRISGVPEFTNCSGLQYLDLSGNLIVGEVPGGALSDCRGLKVLNLSFNHLAGVFPPDIAGLTSLNALNLSNNNFSGELPGEAFAKLQQLTALSLSFNHFNGSIPDTVASLPELQQLDLSSNTFSGTIPSSLCQDPNSKLHLLYLQNNYLTGGIPDAVSNCTSLVSLDLSLNYINGSIPASLGDLGNLQDLILWQNELEGEIPASLSRIQGLEHLILDYNGLTGSIPPELAKCTKLNWISLASNRLSGPIPSWLGKLSYLAILKLSNNSFSGPIPPELGDCQSLVWLDLNSNQLNGSIPKELAKQSGKMNVGLIVGRPYVYLRNDELSSECRGKGSLLEFTSIRPDDLSRMPSKKLCNFTRMYVGSTEYTFNKNGSMIFLDLSYNQLDSAIPGELGDMFYLMIMNLGHNLLSGTIPSRLAEAKKLAVLDLSYNQLEGPIPNSFSALSLSEINLSNNQLNGTIPELGSLATFPKSQYENNTGLCGFPLPPCDHSSPRSSNDHQSHRRQASMASSIAMGLLFSLFCIIVIIIAIGSKRRRLKNEEASTSRDIYIDSRSHSATMNSDWRQNLSGTNLLSINLAAFEKPLQNLTLADLVEATNGFHIACQIGSGGFGDVYKAQLKDGKVVAIKKLIHVSGQGDREFTAEMETIGKIKHRNLVPLLGYCKAGEERLLVYDYMKFGSLEDVLHDRKKIGKKLNWEARRKIAVGAARGLAFLHHNCIPHIIHRDMKSSNVLIDEQLEARVSDFGMARLMSVVDTHLSVSTLAGTPGYVPPEYYQSFRCTTKGDVYSYGVVLLELLTGKPPTDSADFGEDNNLVGWVKQHTKLKITDVFDPELLKEDPSVELELLEHLKIACACLDDRPSRRPTMLKVMAMFKEIQAGSTVDSKTSSAAAGSIDEGGYGVLDMPLREAKEEKD

SEQ ID NO: 1007 - protein, 561 aa, Oryza sativa
MADLQEPLVRPKRKKVLVDYLVKFRWILVIFVVLPISALIYFNIYLGDVWSAMKSEKRRQKEHDDNVQKVVKRLKQRNPKKDGLVCTARKPWIAVGMRNVDYKRARHFEVDLSAFRNILEIDRERMVAKVEPLVNMGQITRATCPMNLALAVVAELDDLTVGGLINGYGIEGSSHLYGLFSDTVVAVEVVLADGRVVRATKDNEYSDLFYGIPWSQGTLGFLVSAEIKLIPIKEYMRLTYTPVKGSLKEIAQGYCDSFAPRDGDPAKVPDFVEGMVYTENEGVMMTGVYASKEEAKKKGNKINCVGWWFKPWFYQHAQTALKKGEFVEYIPTREYYHRHTRCLYWEGKLILPFGDQFWFRFLLGWLMPPKVSLLKATQGESIRNYYHDNHVIQDMLVPLYKVGDALEFVHKEMEVYPLWLCPHRLYKLPVKTMVYPEPGFEHHHRQGDTSYAQMFTDVGVYYAPGAVLRGEEFNGALAVHRLEQWLIENHSYQPQYAVSELNEKDFWRMFDASHYEHCRQKYGAVGTFMSVYYKSKKGRKTEKEVQEAEAAILEPAYADEA

SEQ ID NO: 1008 - protein, 562 aa, Zea mays
MADVHEPLVRRKRKKVLVDYLVKFRWILVIFVVLPISTLIYFNIFLGDMWSAMKSEKKRQKQHDENVQKVVKRLKQRNPKKDGLVCTARKPWIAVGMRNVDYKRARHFEVDLSSFRNILEIDKERMVAKVEPLVNMGQITRATCPMNLALAVVAELDDLTVGGLINGYGIEGSSHLYGLFSDTVVAMEVVLADGRVVRATKDNEYSDLFYGIPWSQGTLGFLVSAEIKLIPIKEYMKLTYTPVKGGLKEIAQAYADSFAPRDGDPAKVPDFVEGMVYTESEGVMMTGVYASKEEAKKKGNKINCVGWWFKPWFYQHAQTALKRGEFVEYIPTREYYHRHTRCLYWEGKLILPFGDQFWFRFLLGWLMPPKVSLLKATQGEAIRNYYHDNHVIQDMLVPLYKVGDALEFVHREMEVYPLWLCPHRLYKLPVKTMVYPEPGFEHQHRQGDTSYAQMFTDVGVYYAPGAVLRGEEFNGAEAVHRLEQWLIENHSYQPQYAVSELNEKDFWRMFDASHYEHCRQKYGAVGTFMSVYYKSKKGRKTEKEVQEAEAAILEPAYADEEA

SEQ ID NO: 1009 - protein, 238 aa, Oryza sativa
MAGGGGEYLRQFVEETAWYNEIFLSHVVPGDWWRALPHPLQSWLRNGLGGYLIYFACGFLWCFVIYYWKRHAYIPKDSIPTIEAMKKQIIVASKAMPLYCALPTLSEYMVENGWTQCYVNISEVGWPMYLVYLALYLIFVEFGIYWMHRELHDIKPLYKYLHTYHHIYNKENTLSPFAEAVWTTNIHDCIHGKVWPVMGAGYHTIHHTTYRHNYGHYTVWMDWMFGTLREPEDILKKD

SEQ ID NO: 1010 - protein, 274 aa, Zea mays
MAVHGGDYLRRFVAETEWYNEVVLNAVAPGDWWRGLPHPVQSWMRNCVGGYLLYFISGFLWCFVIYYWKRHAYIPKDAIPTNEAMKKQIAVASKAMPFYCALPTLSEYMIESGWTRCYFNISEMGFSAYLCYMAMYLIFVEFGIYWMHRELHDIKPLYKHLHATHHIYNKENTLSPFAGLAFHPLDGILQAIPHVLALFLLPTHFRTHIALVFLEGVWTTNIHDCIHGKVWPVMGAGYHTIHHTTYRHNYGHYTVWMDWMFGTLREPDDILKKA

SEQ ID NO: 1011 - protein, 276 aa, Zea mays
MEAVARSGDYLWRFVAETEWYNEVVLSAVAPGDWWRGLPHPVQSWMRNCVGGYLLYFISGFLWCFVIYYWKRHAYIPKDAIPTNEAMKKQIVVASKAMPFYCALPTLSEYMIESGWTRCYFNISEIGFSMYLCYMAMYLIFVEFGIYWMHRELHDIKPLYKYLHATHHIYNKENTLSPFAGLAFHPLDGILQAIPHVFALFLFPTHFRTHIALLFLEAVWTTNIHDCIHGKIWPVMGAGYHTIHHTTYRHNYGHYTIWMDWMFGTLNEPEDILKKA

SEQ ID NO: 1012 - protein, 283 aa, Glycine max
MEDPSAATTLLLNSEYSRLFVEDTDLYNRIVLGTLLPHFVWGPLPHFLQTWLRNYLGGVLLYLLSGLLWCFYIYYWKRNVYVPKDAIPSRRAMLLQISVAMKAMPWYTLLPTVSEYLVETGWTKCYPRLYNVGWLAYLVYLAIYLSIVEFGIYWMHRELHDIKPLYKYLHATHHIYNKQNTLSPFAGLAFHPLDGILQALPHSLCLFFMPIHFTTHLVLIFIEGIWTANIHDCIHGKLWPVMGAGYHTIHHTTYRHNYGHYTIWMDWLFGTLHNPEEDEGKAM

SEQ ID NO: 1013 - protein, 471 aa, Oryza sativa
MATRGRIVAAVASVVVAWLAVAVGVNGGGCEAERDRVEALPGQPPVAFAQYAGYVAVSEASGRALFYWLTEAAAAAAATKPRARWLFPGPGCSSIAYGASEEIGPFRIKTNGTGLYLNKYSWNREANLLFLESPAGVGFSYSNTTSDLKTSGDERTAQDALQFLISWMSRFPQYRHRDFYIAGESYAGHYVPQLARKIVEFNKASPYPFINLKGILVGNGVTDNYYDNIGTVTYWWTHAMISDTTYKAIMSSCNFTSANVSRLCNRAMSYAMNHEFGDIDQYSIYTPSCAAAAANATGRRRGKAAVLRFKDTFLRRRSFGYDPCTETYAEKYYNRPDVQKAMHANITGIPYRWTACSDVLIKTWRDSEFSMLPTYKLLMKAGLRIWVFSGDTDSVVPVTATRFALSHLGLKTKIRWYPWYSAGQVGGWSEVYEGLTFASVRGAGHEVPLFQPRRAFRMFQSFLAGEPLPKS

SEQ ID NO: 1014 - protein, 480 aa, Zea mays
MATTRPRGGGGAASGALVMAIVVLLLLPPYGAGAEECEDGGISSRARAGDRVEALPGQPAVAFAQYSGYVAVDRDRGRALFYWLTEAVGDDAAAKPLVLWLNGGPGCSSVAYGASEEIGPFRIKPNGTGLFLNKYSWNREANLLFLESPAGVGFSYANTTSDLKTSGDERTAQDALQFLVSWMSRFPQYRHRDFYIAGESYAGHYVPQLARKIVEYNEASPHPFINLKGILVGNAGTDNYYDNIGTVTYWWTHAMISDRTYKAILRWCNFSSSSISRPCNRAMSYAMNHEFGDIDQYSIYTPSCAAAARAIRLELRFKNTLVRRRRSSGYDPCTETYAERYYNRMDVQRAMHANTTGIPYRWTACSDVLIKTWQDSEFSMLPTYKKLMKAGLRIWVFSGDTDSVVPVTATRFAISHLGLKIKTRWYPWYSAGQVGGWSEVYEGLTFASVRGAGHEVPLFQPRRAFRMFRSFLAGEPLPKS

SEQ ID NO: 1015 - protein, 330 aa, Oryza sativa
MADFRTSTHRERWIFQTNDLMDRWGAANQRATETLVQYGTTRLKVDPVDGSLSYPEPAPDHVVGSSGVKPLSCEEERLMRVFYEQKIQEVCSAFKFPHKIQATAIIYFKRFYLQWSVMEHHPKHIMLTCIYSSCKVEENHVSAEELGKGIQQDHQIILNNEMIVLKSLDFDLIVYAPYRSIEGFVDDMEDFCRAGNGEHQRLQDLRQTAISQVDKMMLTDAPLLYTPGQLALAALHKSNDMHKILNFERYLESVFSRQHSDCPIEQFVGSINMINYLVEQLKIPTPKDMRHIDRKLKHCLDPSSQDEHKKKEKKSKHKSKRAANEAQLDS

SEQ ID NO: 1016 - protein, 424 aa, Oryza sativa
MASGDGGDDAGVKRVADRYLKREVLGEGTYGVVFKAVDTKTGNTVAIKKIRLGKYKEGVNFTALREIKLLKELKDSNIIELIDAFPYKGNLHLVFEFMETDLEAVIRDRNIVLSPADTKSYIQMMLKGLAFCHKKWVLHRDMKPNNLLIGADGQLKLADFGLARIFGSPERNFTHQVFARWYRAPELLFGTKQYGSAVDIWAAGCIFAELLLRRPFLQGSSDIDQLGKIFAAFGTPKSSQWPDMVYLPDYVEYQFVSAPPLRSLFPMASDDALDLLSRMFTYDPKARITAQQALEHRYFLSVPAPTKPSQLPRPPPKGDSGNNKIPDLNLQDGPVVLSPPRKLRRVTAHEGMEVHMHRADRTEEHPSGARHMDDMSSQSSRIPMSVDVGAIFGTRPAPRPTLNSADKSRLKRKLDMDPEFGYTE

SEQ ID NO: 1017 - protein, 409 aa, Glycine max
MDPPPKSWSIHTRSEIIAKYEVMERVGSGAYADVYRGRRLSDGLTVALKEIHDYQSAFREIDALQLLEGSPNVVVLHEYFWREDEDAVLVLEFLRTDLATVIADTAKANQPLPAGELKCWMIQILSGLDACHRHMVLHRDLKPSNLLISEHGLLKIADFGQARILMEPGIDASNNHEEYSRVLDDIDNKDTITSTHDGNATCNTSDVDREEEELGCFTSCVGTRWFRAPELLYGSRNYGLEVDLWSLGCIFAELLTLQPLFPGTADIDQLSRIIGVLGNLDENAWAACSKLPDYGIISFSKVENPAGLEACLPNRSPDEVALVKKLVCYDPAKRATAMELLHDKYFSDEPLPVLVSELRVPLTRKEQDGDSPGGWGDINDMDSDSDSQFDEFGPLNITRTGTGFSIQFP

SEQ ID NO: 1018 - protein, 194 aa, Zea mays
MVMVSGGGGNAWAKEMTLRRRIASIFNKTQEHFPTLKDYNDYLEEVEDMTFNLIEGIDVEEIEAKIARYQQENAEQIYLSRAKRAEDLAAALKASRMNPVKAEANDTAAGSSQGISGGAGVQGQYAPAAVLGGVAQPRPTGMAPQLIGSGSDPLQGDDEETRRLRAERAARAGGWTAELSKRRALEEAFSAIFI

SEQ ID NO: 1019 - protein, 429 aa, Zea mays
MASAGISGSGDDDAGGKLLADRYQKGEVLGEGTYGVVFKAFDTKTGNTVAVKRIWVGKDKKEGVNFTTLREIRLLKELKGPNIIELIDCFPYKENLHLVFEFMETDLEALIKDKNIILSPADTKSYLQMLLKGLSFCHKKWVIHRDMKPNNLLIGADGQLKLADFGLARMFGSPGRNFTHQVFARWYRAPELLFGSKQYGSGVDIWAAGCIFAELLTRRAFLQGSSDIDQLGKIFAALGTPKSSQWPDMVYLPDYVEYQYVAAPPLRTLLPMASDDALDLLSKMLTYDPKARISAQQALEHRYFSSLPAPTRPSQLLRSRWKGDQGNNKMPDLNLQHGPLVLSPPRKLRRVIAHEWMEGMHRADKVDEHPSGMRHTDDMPSQKSSRIPMSVDVGAVFGTRPAPRPTLNSADKSRLKRKLDMDPEFGFAE

SEQ ID NO: 1020 - protein, 1511 aa, Saccharomyces cerevisiae
MPEAKLNNNVNDVTSYSSASSSTENAADLHNYNGFDEHTEARIQKLARTLTAQSMQNSTQSAPNKSDAQSIFSSGVEGVNPIFSDPEAPGYDPKLDPNSENFSSAAWVKNMAHLSAADPDFYKPYSLGCAWKNLSASGASADVAYQSTVVNIPYKILKSGLRKFQRSKETNTFQILKPMDGCLNPGELLVVLGRPGSGCTTLLKSISSNTHGFDLGADTKISYSGYSGDDIKKHFRGEVVYNAEADVHLPHLTVFETLVTVARLKTPQNRIKGVDRESYANHLAEVAMATYGLSHTRNTKVGNDIVRGVSGGERKRVSIAEVSICGSKFQCWDNATRGLDSATALEFIRALKTQADISNTSATVAIYQCSQDAYDLFNKVCVLDDGYQIYYGPADKAKKYFEDMGYVCPSRQTTADFLTSVTSPSERTLNKDMLKKGIHIPQTPKEMNDYWVKSPNYKELMKEVDQRLLNDDEASREAIKEAHIAKQSKRARPSSPYTVSYMMQVKYLLIRNMWRLRNNIGFTLFMILGNCSMALILGSMFFKIMKKGDTSTFYFRGSAMFFAILFNAFSSLLEIFSLYEARPITEKHRTYSLYHPSADAFASVLSEIPSKLIIAVCFNIIFYFLVDFRRNGGVFFFYLLINIVAVFSMSHLFRCVGSLTKTLSEAMVPASMLLLALSMYTGFAIPKKKILRWSKWIWYINPLAYLFESLLINEFHGIKFPCAEYVPRGPAYANISSTESVCTVVGAVPGQDYVLGDDFIRGTYQYYHKDKWRGFGIGMAYVVFFFFVYLFLCEYNEGAKQKGEILVFPRSIVKRMKKRGVLTEKNANDPENVGERSDLSSDRKMLQESSEEESDTYGEIGLSKSEAIFHWRNLCYEVQIKAETRRILNNVDGWVKPGTLTALMGASGAGKTTLLDCLAERVTMGVITGDILVNGIPRDKSFPRSIGYCQQQDLHLKTATVRESLRFSAYLRQPAEVSIEEKNRYVEEVIKILEMEKYADAVVGVAGEGLNVEQRKRLTIGVELTAKPKLLVFLDEPTSGLDSQTAWSICQLMKKLANHGQAILCTIHQPSAILMQEFDRLLFMQRGGKTVYFGDLGEGCKTMIDYFESHGAHKCPADANPAEWMLEVVGAAPGSHANQDYYEVWRNSEEYRAVQSELDWMERELPKKGSITAAEDKHEFSQSIIYQTKLVSIRLFQQYWRSPDYLWSKFILTIFNQLFIGFTFFKAGTSLQGLQNQMLAVFMFTVIFNPILQQYLPSFVQQRDLYEARERPSRTFSWISFIFAQIFVEVPWNILAGTIAYFIYYYPIGFYSNASAAGQLHERGALFWLFSCAFYVYVGSMGLLVISFNQVAESAANLASLLFTMSLSFCGVMTTPSAMPRFWIFMYRVSPLTYFIQALLAVGVANVDVKCADYELLEFTPPSGMTCGQYMEPYLQLAKTGYLTDENATDTCSFCQISTTNDYLANVNSFYSERWRNYGIFICYIAFNYIAGVFFYWLARVPKKNGKLSKK

SEQ ID NO: 1021 - protein, 590 aa, Arabidopsis thaliana
MSLPETKSDDILLDAWDFQGRPADRSKTGGWASAAMILCIEAVERLTTLGIGVNLVTYLTGTMHLGNATAANTVTNFLGTSFMLCLLGGFIADTFLGRYLTIAIFAAIQATGVSILTLSTIIPGLRPPRCNPTTSSHCEQASGIQLTVLYLALYLTALGTGGVKASVSGFGSDQFDETEPKERSKMTYFFNRFFFCINVGSLLAVTVLVYVQDDVGRKWGYGICAFAIVLALSVFLAGTNRYRFKKLIGSPMTQVAAVIVAAWRNRKLELPADPSYLYDVDDIIAAEGSMKGKQKLPHTEQFRSLDKAAIRDQEAGVTSNVFNKWTLSTLTDVEEVKQIVRMLPIWATCILFWTVHAQLTTLSVAQSETLDRSIGSFEIPPASMAVFYVGGLLLTTAVYDRVAIRLCKKLFNYPHGLRPLQRIGLGLFFGSMAMAVAALVELKRLRTAHAHGPTVKTLPLGFYLLIPQYLIVGIGEALIYTGQLDFFLRECPKGMKGMSTGLLLSTLALGFFFSSVLVTIVEKFTGKAHPWIADDLNKGRLYNFYWLVAVLVALNFLIFLVFSKWYVYKEKRLAEVGIELDDEPSIPMGH

SEQ ID NO: 1022 - protein, 584 aa, Oryza sativa
MDSSYQHDKPLLDEENSSQVTLEYTGDGSVCIRGHPALRKHTGNWKGSSLAIVFSFCSYLAFTSIVKNLVSYLTKVLHETNVAAARDVATWSGTSYLAPLVGAFLADSYLGKYCTILIFCTIFIIGLMMLLLSAAVPLISTGPHSWIIWTDPVSSQNIIFFVGLYMVALGYGAQCPCISSFGADQFDDTDENERTKKSSFFNWTYFVANAGSLISGTVIVWVQDHKGWIWGFTISALFVYLGFGTFIFGSSMYDFRNLEEAPLARICQVVVAAIHKRDKDLPCDSSVLYEFLGQSSAIEGSRKLEHTTGLKFFDRAAMVTPSDFESDGLLNTWKICTVTQVEELKILIRMFPVWATMILFAAVLDNMFSTFIEQGMVMEKHIGSFEIPAASFQSIDVIAVLILVPVYERVLVPVFRKFTGRANGITPLQRMGIGLFFSMLSMVSAALVESNRLRIAQDEGLVHRKVAVPMSILWQGPQYFLIGVGEVFSNIGLTEFFYQESPDAMRSLCLAFSLANVSAGSYLSSFIVSLVPVFTAREGSPGWIPDNLNEGHLDRFFWMMAGLCFLNMLAFVFCAMRYKCKKAS

SEQ ID NO: 1023 - protein, 524 aa, Zea mays
MAAVGAPGSSLHGVTGREPAFAFSTEHEEAASNGGKFDLPVDSEHKAKSVRLFSVANPHMRTFHLSWISFFTCFVSTFAAAPLVPIIRDNLNLTKADIGNAGVASVSGSIFSRLTMGAVCDLLGPRYGCAFLIMLSAPTVFCMSLIDDAAGYIAVRFLIGFSLATFVSCQYWMSTMFSSKIIGTVNGLAAGWGNMGGGATQLIMPLVYDVIRKCGATPFTAWRLAYFVPGLMHVVMGVLVLTLGQDLPDGNLRSLQKKGNVNKDSFSKVMWYAVINYRTWIFVLLYGYCMGVELTTDNVIAEYMYDRFDLDLRVAGTIAACFGMANIVARPMGGIMSDMGARYWGMRARLWNIWILQTAGGAFCLWLGRASTLPVSVVAMVLFSFCGQAACGAIFGVIPFVSRRSLGIISGMTGAGGNFGAGLTQLLFFTSSTYSTGRGLEYMGIMIMACTLPVVFVHFPQWGSMFFPPSATADEEGYYASEWNDDEKSKGLHSASLKFAENSRSERGKRNVIQADAAATPEHV

SEQ ID NO: 1024 - protein, 533 aa, Oryza sativa
MDSSTVGAPGSSLHGVTGREPAFAFSTEVGGEDAAAASKFDLPVDSEHKAKTIRLLSFANPHMRTFHLSWISFFSCFVSTFAAAPLVPIIRDNLNLTKADIGNAGVASVSGSIFSRLAMGAICDMLGPRYGCAFLIMLAAPTVFCMSLIDSAAGYIAVRFLIGFSLATFVSCQYWMSTMFNSKIIGLVNGLAAGWGNMGGGATQLIMPLVYDVIRKCGATPFTAWRLAYFVPGTLHVVMGVLVLTLGQDLPDGNLRSLQKKGDVNRDSFSRVLWYAVTNYRTWIFVLLYGYSMGVELTTDNVIAEYFYDRFDLDLRVAGIIAASFGMANIVARPTGGLLSDLGARYFGMRARLWNIWILQTAGGAFCLLLGRASTLPTSVVCMVLFSFCAQAACGAIFGVIPFVSRRSLGIISGMTGAGGNFGAGLTQLLFFTSSRYSTGTGLEYMGIMIMACTLPVVLVHFPQWGSMFLPPNAGAEEEHYYGSEWSEQEKSKGLHGASLKFAENSRSERGRRNVINAAAAAATPPNNSPEHA

SEQ ID NO: 1025 - protein, 516 aa, Oryza sativa
MEAKPVAMEVEGVEAAGGKPRFRMPVDSDLKATEFWLFSFARPHMASFHMAWFSFFCCFVSTFAAPPLLPLIRDTLGLTATDIGNAGIASVSGAVFARLAMGTACDLVGPRLASASLILLTTPAVYCSSIIQSPSGYLLVRFFTGISLASFVSAQFWMSSMFSAPKVGLANGVAGGWGNLGGGAVQLLMPLVYEAIHKIGSTPFTAWRIAFFIPGLMQTFSAIAVLAFGQDMPGGNYGKLHKTGDMHKDSFGNVLRHALTNYRGWILALTYGYSFGVELTIDNVVHQYFYDRFDVNLQTAGLIAASFGMANIISRPGGGLLSDWLSSRYGMRGRLWGLWTVQTIGGVLCVVLGIVDFSFAASVAVMVLFSFFVQAACGLTFGIVPFVSRRSLGLISGMTGGGGNVGAVLTQYIFFHGTKYKTETGIKYMGLMIIACTLPVMLIYFPQWGGMLVGPRKGATAEEYYSREWSDHEREKGFNAASVRFAENSVREGGRSSANGGQPRHTVPVDASPAGV

SEQ ID NO: 1026 - protein, 585 aa, Arabidopsis thaliana
MGSIEEEARPLIEEGLILQEVKLYAEDGSVDFNGNPPLKEKTGNWKACPFILGNECCERLAYYGIAGNLITYLTTKLHQGNVSAATNVTTWQGTCYLTPLIGAVLADAYWGRYWTIACFSGIYFIGMSALTLSASVPALKPAECIGDFCPSATPAQYAMFFGGLYLIALGTGGIKPCVSSFGADQFDDTDSRERVRKASFFNWFYFSINIGALVSSSLLVWIQENRGWGLGFGIPTVFMGLAIASFFFGTPLYRFQKPGGSPITRISQVVVASFRKSSVKVPEDATLLYETQDKNSAIAGSRKIEHTDDCQYLDKAAVISEEESKSGDYSNSWRLCTVTQVEELKILIRMFPIWASGIIFSAVYAQMSTMFVQQGRAMNCKIGSFQLPPAALGTFDTASVIIWVPLYDRFIVPLARKFTGVDKGFTEIQRMGIGLFVSVLCMAAAAIVEIIRLHMANDLGLVESGAPVPISVLWQIPQYFILGAAEVFYFIGQLEFFYDQSPDAMRSLCSALALLTNALGNYLSSLILTLVTYFTTRNGQEGWISDNLNSGHLDYFFWLLAGLSLVNMAVYFFSAARYKQKKASS

SEQ ID NO: 1027 - protein, 610 aa, Zea mays
MGAGATARDEETATGRHHGRKPHGAAAEYAQDGSVDLRGNPVLRSQRGGWTACSFIVVYELFERMAYYGISSNLIIYLTDRLHQGTVEASNNVTNWSGTVFLTPLLGAYVADAYLGRYWTFVVGSAIYLLGMVLLVLSVSVPALKPPPCGAGGVCPQASALQLGAYFGGLYIVALGNGGTKPNISTIGADQFDEFDPRERTHKLSFFNWWMFTIFLGILFSSTVLVYLQDNVSWSVGYGIPTLGLMVSISVFLAGTRLYRHRVPQGSPFTSMGRVLAAALWKWSVPVPADAKELHELDVEEYARKRKFRMDSTDAMAFLNKAAAVPSGGPAATPAWSLCTVTQVEETKQILRLVPLLVAMIVPCTLIAQTNTLFVKQGTTMDRHMGPRFEIPAASLGAFVTLTMLVAVVVYDRVFVRAVRRYTKDPRGITILRRMGTGMLLQVATMAVASAIESRRLAYARSHGLDATGGQLGLTIFALLPQFVLMGLADAFLVVGKIEFFYDQAPESMKSLGTAMSLTAYGIGNFLSSFLLSTVTRVTRDRGHAWVTNNLNASNLDYYYAFLTALGVVNFVAFLALSARYRYKAQSTDTIDAAVGLETEKAKLQAEPLG

SEQ ID NO: 1028 - protein, 580 aa, Zea mays
MGEVEDMYTQDGTVDMKGNPAVKKGTGNWRACPYILANECCERLAYYGMSTNLVNYMKTRLGQVNSVASNNVTNWQGTCYITPLIGAFFADAYMGRFWTIAIFMIIYIFGLALLTMASSVKGLVPTSCGDKDVCHPTDAQAAVVFVALYLIALGTGGIKPCVSSFGADQFDENDEREKKSKSSFFNWFYFSINIGALVASTVLVYVQTHVGWGWGFGIPAVVMAIAVGSFFVGTPLYRHQKPGGSPLTRIAQVLVACARKWNVAVPADKSRLHETVDGESGIEGSRKLEHSEQLACLDRAAVVTAEDGAEASPWRLCSVTQVEELKSVIRLLPIWASGIVFAAVYSQMSTMFVLQGNTLDQSMGPRFKIPSATLSMVDTISVIVWVPVYDRAIVPLVRSYTGRPRGFTQLQRMGIGLVVSIFSMVAAGVLDIVRLRAIARHGLYGENDIVPISIFWQIPQYFIIGCAEVFTFVGQLEFFYDQAPDAMRSMCSALSLTTVALGNYLSTVLVTIVTHITTRHGRIGWIPENLNRGHLDYFFWLLAVLSLLNFLAYLVIASWYKYKKTADDYPGAKGEHGTEH

SEQ ID NO: 1029 - protein, 593 aa, Oryza sativa
MAEVTVVRAEREEESTLEQGLLAIPEESNQLTYTGDGSVDFSGNPVVKERTGRWRACPFILGNECCERLAYYGISTNLVTYLTKKLHDGNASAASNVTAWQGTCYLTPLIGAILADAYWGRYWTIATFSTIYFIGMAVLTLSASVPTFMPPPCEGSFCPPANPLQYTVFFLGLYLIALGTGGIKPCVSSFGADQFDDTDPVERIQKGSFFNWFYFSINIGALISSSFLVWVQDNIGWGIGFGIPTIFMGLAIISFFSGTSLYRFQKPGGSPITRVCQVVGASFRKWNVHVPEDSSRLYELPDGASAIEGSRQLEHTDELRCLDKAATITDLDVKADSFTNPWRICTVTQVEELKILVRMFPVWATTIVFSAVYAQMSTMFVEQGMMLDTSVGPFKIPPASLSTFDVVSVIIWVPLYDSILVPIARRFTGNPRGFTELQRMGIGLVISIFSMAAAAVLEIKRLDIARAEHLVDQNVPVPLNICWQIPQYFLVGASEVFTFVGSLEFFYDQSPDAMRSLCSALQLVTTALGNYLSAFILTLVAYFTTRGGNPGWIPDNLNQGHLDYFFWLLAGLSFLNFVIYVICANKYKSKKAA

SEQ ID NO: 1030 - protein, 580 aa, Oryza sativa
MGEVAEDIYTQDGTVDVKGNPATKKNTGNWRACPYILANECCERLAYYGMSTNLVNYMKTRLGQESAIAANNVTNWSGTCYITPLLGAFLADAYMGRFWTIASFMIIYILGLALLTMASSVKGLVPACDGGACHPTEAQTGVVFLALYLIALGTGGIKPCVSSFGADQFDENDEGEKRSKSSFFNWFYFSINIGALVASSVLVYVQTHVGWGWGFGIPAVVMAVAVASFFVGTPLYRHQRPGGSPLTRIAQVLVASARKWGVEVPADGSRLHETLDRESGIEGSRKLEHTGQFACLDRAAVETPEDRSAANASAWRLCTVTQVEELKSVVRLLPIWASGIVFATVYGQMSTMFVLQGNTLDASMGPHFSIPAASLSIFDTLSVIVWVPVYDRLIVPAVRAVTGRPRGFTQLQRMGIGLVISVFSMLAAGVLDVVRLRAIARHGLYGDKDVVPISIFWQVPQYFIIGAAEVFTFVGQLEFFYDQAPDAMRSMCSALSLTTVALGNYLSTLLVTIVTHVTTRNGAVGWIPDNLNRGHLDYFFWLLAVLSLINFGVYLVIASWYTYKKTADSPDDKAEHAGAN

SEQ ID NO: 1031 - protein, 243 aa, Synechocystis PCC6803
MTGKVYLVGAGPGDPEYLTLQAQQCLQSAEVLIYDALIDPRILDLVPANCDRIAVGKRGGAESTPQATINQLLVEHCQQGRKVIRLKSGDPFVFGRAASELDALERSGCDYAVLPGLSTALAAPLLAGIPITDPVLSRGFAVYTVHEPDALNWEALAQLETLILLMGSRHLLTIGHELIRHGRSPDSPVALIQWAGHPQQTVLESSLSRMAQQWGDQPLSPCVIVIGEVVRLRKYWAHYRYDG

SEQ ID NO: 1032 - protein, 257 aa, Xylella fastidiosa
MSVTLVGAGAGDAGLLTLNALRALNEADIILYDRLVSDTVLQVARRDAEQIEVGKSATGHSVRQEDIHSLMLQHARAGQRVVRLKGGDPFVFGRGGEELEFLRTHNIPYEVIPGITAALACAAYAGIPLTHRDHAQSLCLITAHCQSSLDTLDWAALAQERQTLAFYMGVAGLPTIQQRLCEAGRAETTPFALIENGARAQQRVLTGTLKTLAHTAQTYAVRPPALLILGEVTTLAEHLHWFGTAPLSAPCPPALIL

SEQ ID NO: 1033 - protein, 423 aa, Zea mays
MALAVRTPRFQPRPASISAPTTPASTSLAAGNARPRPCAGAAVRASPFTEATSSSRYRRDAWSYAADGSSNSASPSSAAAAAAGRRDDEIALQLPELRRLLDVLRASRGRGAEEGGGPGEVALVGTGPGDPELLTLKAVRAIEAADLVLYDRLVSNDVLDLVGEGARLLYVGKTAGYHSRTQEEIHELLLSFAEAGANVVRLKGGDPLVFGRGGEEMDFLQQQGIKVEVIPGITSASGIAAELGIPLTHRGVATSVRFLTGHSRNGGTDPLYVAGNAADPDTTLVVYMGLSTLPSLAPKLMKHGLPPDTPAVAVERGTTPQQRTVFASLKDLVDEVKSADLVSPTLIIIGKVVSLSPFWVESSEHDALKVQSSYANEADDNRFSWFLVTGQYLRNARSQIWEHRFDLVYTETSQEAWILNGGW

SEQ ID NO: 1034 - protein, 195 aa, Zea mays
MASHQDKASYQAGETKARTEEKTGQAVGATKDTAQHAKDRAADAAGHAAGKGQDAKEATKQKASDTGGYLGKKTDEAKHKAGETTEATKQKASETTEATKQKAGETTEAARQKAADAMEAAKQKAAEAGQYAKDTAVSGKDKSSGVIQQATEQVKSAAAGAKDAVMSTLGMGGDDKQGDANTNTNKDSSTITRDH

SEQ ID NO: 1035 - protein, 129 aa, Zea mays
MAARSSSSQPQLVAAAAVLAAALLLLAAGAGTASAAVSCGEVTSSVAPCLGYAMGSAASPSAACCSGVRSLNSRASSAADRQATCNCLKSMTGRLGGGVSMANAANIPGKCGVSVGVPISPTVDCTKIN

SEQ ID NO: 1036 - protein, 233 aa, Glycine max
MFLTRSALFRFSKSLPYAPSLSLKPSMVTFSSTPNSGWRNAAEGGRRDGRTNWTYDSAEARREADEMSESAKETMNEGYDRAKDQAREAKDRTKDFAHDAKEKTNQPQSHQVSTILPLLTTKPVPRSESTQIMVLRRRKKQKMQRRKKLESTQIMLRRRRRKRRTRQWKRLESTLIMLRRRRRKRRTRQWRRLESTQIMLRRRRKKPRTRQWRREGNIKTMLQRRLKKEKMLL

SEQ ID NO: 1037 - protein, 226 aa, Glycine max
MASYQKHYDDQGRKVDEYGNVEKQTDEYGNPVHAASVTYVATRTAAGGYSDDINKQHDTTNAYGVDTGRQHSSGGYDGDTNKHHGTTGGYNDDTNRHHGTTGVYGIDTDRQQHGTTGGYAGDTGRQHGNIGGPYYGTNTADTGTGPRSGTTGGTGYGGTGGTDYGTTGGTGYGSGTGYGVNTGGAHTEAGYRKEHRQHDQSHGDQNEKKGIMDKIKEKLPGGHSDK

SEQ ID NO: 1038 - protein, 156 aa, Zea mays
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGGYGGGGGYGGGGGGYGGGNRGGGYGNSDGNWRN

SEQ ID NO: 1039 - protein, 167 aa, Zea mays
MEYGQQGQRGHGATGHVDQYGNPVGGVEHGTGGMRHGTGTGGMGQLGEHGGAGMGGGQFQPAREEHKTGGILHRSGSSSSSSSEDDGMGGRRKKGIKEKIKEKLPGGHKDDQHATATTGGAYGQQGHTGSAYGQQGHTGGAYATGTEGTGEKKGIMDKIKEKLPGQH

SEQ ID NO: 1040 - protein, 290 aa, Zea mays
MEDERNTQQHQGGEAQQDAADQVDVKDRGLLDSLLGRKKHDDDQEKKKQTDELATGMEKVTVSEPEKHGHKEEEHEVVGEKKEGLLAKLHRTSSSSSSSSDEEEEAIDENGEIIKRKKKKMGLKEKLKEKLPGHKDGHHTAAPSPAPAPVETHAHHQEEAHRPHVVPTPAPPPPPHVHQHDHGVVVQDDVKTGTPPHAPEEEKKGLLDKIKEKLPGGHNKKPEAAAAAAPAPPVHAPAPAPQAENVSSPDGKEKKGLLGKIMDKIPGYHKSSAEEADHKADAAGEHRTSS

SEQ ID NO: 1041 - protein, 168 aa, Saccharomyces cerevisiae
MSNLLNKFADKLHGNDHDERYEDDNDDQTRQQRHEKHQQREFRNQGSKADPYGEENQGNFPQRQQPQSNLGGNTQFGGNDFQQQTTDYTAGTGGGTYTQTYRETNTQGQLDDDEDDDFLTSGQQQKQGRTRGAQSNRYQSSNIGSGRRDLSGSGNDEYDDDSGNQGVW

SEQ ID NO: 1042 - protein, 84 aa, Saccharomyces cerevisiae
MTRTNKWTEREGKADPKYFSHTGNYGESPNHIKKQGSGKGNWGKPGDEIDDLIDNGEIPPVFKKDRRGSNLQSHEQKFENVQKE

SEQ ID NO: 1043 - protein, 159 aa, Saccharomyces cerevisiae
MSNMMNKFAEKLQGNDDSHQKGKNAKSSNKERDDMNMDMGMGHDQSKGMKMGHDQSGTKMNAGRGIANDWKTYEHENMYVFGALTKSSYFFNGLFMNCLCLCSLYSKSISAYFSEFSSTNIYKSYLRLPSVLYYVCMMHTMMPNQLDAVGIQSSESLLM

SEQ ID NO: 1044 - protein, 128 aa, Saccharomyces cerevisiae
MSANDYYGGTAGEKSQYSRPSNPPPSSAHQNKTQERGYPPQQQQQYYQQQQQHPGYYNQQGYNQQGYNQQGYNQQGYNQQGYNQQGYNQQGHQQPVYVQQQPPQRGNEGCLAACLAALCICCTMDMLF

SEQ ID NO: 1045 - protein, 109 aa, Saccharomyces cerevisiae
MSDAGRKGFGEKASEALKPDSQKSYAEQGKEYITDKADKVAGKVQPEDNKGVFQGVHDSAEKGKDNAEGQGESLADQARDYMGAAKSKLNDAVEYVSGRVHGEEDPTKK

SEQ ID NO: 1046 - protein, 200 aa, Oryza sativa
MASHQDQASYRAGETKAHTEEKAGQVMGASKDKASEAKDRASEAAGHAAGKGQDTKEATKEKAQAAKERASETAQAAKDKTSSTSQAARDKAAESKDQTGGFLGEKTEQAKQKAAETAGAAKQKTAETAQYTKDSAIAGKDKTGSVLQQASEQVKSTVVGAKDAVMSTLGMTEDEAGTDDGANKDTSATAAATETTARDH

SEQ ID NO: 1047 - protein, 215 aa, Oryza sativa
MASQQERASYHAGETKARAEEKTGRMMGTAQEKAREAKDTASDAAGRAMGRGHGAKEATKEKAYETKDATKEKAYEAKDAASDATGRAMDKGRGAAGATRDKAYDAKDRAADTAQSAADRARDGAGQTGSYIGQTAEAAKQKAAGAAQYAKETAIAGKDKTGAVLQQAGEQVKSVAVGAKDAVMYTLGMSGDNKNNAAAGKDTSTYKPGTGSDYQ

SEQ ID NO: 1048 - protein, 305 aa, Zea mays
MSRLMAAMLLGGARVAGAAKLTGNGNAAGMQALPMPACFLPPRPQAATWTRLCLQAAPRSSQAYDNAPEDRREIGDKYKDAAEEAKDATGDAKEHAKRMAGETKSRAQDKAGRVADQASGMAERAKDQAKGVAEDAADTASRATERAKNETRDAAREAADRAGHVKERAKEAGHEAADRAQGAAKAAKDRTGEAAGRAMDRAGEAKDRAVEGTASYGEKVVEMTKEGAGKVAETAQAIGDMAKQAARSTWDAAKDTAHGVKERVVPDAEDVDAAVKERDRIARDVDRVERERNMREAREKGSGLP

SEQ ID NO: 1049 - protein, 231 aa, Zea mays
MASRQQHPTSYHAGETKARAEEKTGQVMGATQEKGREAKHKASDASDRAMGMGHDAMEATREKARAAADRTMGMGHDAGEAAKDRAYRAKDAASGAAGRARDTASDAAGAAGDRARDGAQQTGSYVAQTAEAARQKAAGAALYAKDTVVAGKDKTGALLQQAGEKVMSTAVGAKDTVVSTAVGAKDTVVSTAVGAKDAMMNSLGMAGEDKDGTTTTDAGKDTSTRKPGRDY

SEQ ID NO: 1050 - protein, 344 aa, Zea mays
MGILCLGASSTLLCGEDRNNVLGLGCGNELVEVGSGHDGLDSVVGAVFPVDTDEAVRALLEKETDHKPQDGYAERLERGGLEYSWRRDAMDWICKVHSYYRFGPLSLYLAVNYLDRFLSSYDLPHDKPWMRQLLSVACLALAVKMEETVLPLPVDLQVCDVKFEFEARTIGRMELLVLATLKWRMQAVTPFTFISYFLDKFNGGKPPSMALASRCTEIIIGTLKGSTFLSFRPSEIAAASALAAVSENQVVGSSSALSASEVPINKEMIARCYELLQEQALVRKTGHINGSPSVPQSPIGVLDATCFSFRSEDVRLGSSQSNNISSSSNDNQVSKRRRLSISPI

SEQ ID NO: 1051 - protein, 419 aa, Oryza sativa
MENMRSENFNQGVSMEGVKHAPEMANTNRRALRDIKNIIGAPHQHMAVSKRGLLDKPAAKNQSGHRPMTRKFAATLANQPSIAPLAPIGSERQKRTADSAFHGPADMECTKITSDDLPLPMMSEMDEVMGSELKEIEMEDIEEAAPDIDSCDANNSLAVVEYVDEIYSFYRRSEGLSCVSPNYMLSQNDINEKMRGILIDWLIEVHYKLELLDETLFLTVNIIDRFLARENVVRKKLQLVGVTAMLLACKYEEVSVPVVEDLILICDRAYTRTDILEMERMIVNTLQFDMSVPTPYCFMRRFLKAAQSDKKLELMSFFIIELSLVEYEMLKFQPSMLAAAAIYTAQCTINGFKSWNKCCELHTKYSEEQLMECSKMMVELHQKAGHGKLTGVHRKYSTFRYGCPAKSEPAVFLLKSVAL

SEQ ID NO: 1052 - protein, 257 aa, Oryza sativa
MAANFWTSSHCKQLLDQEDVDKVPQADSDRGITLEEFRLVKIHMSFHIWRLAQQVKVRQRVIATAVTYFRRVYTRKSMTEYDPRLVAPTCLYLASKVEESTVQARLLVFYIKKMCASDEKYRFEIKDILEMEMKLLEALDYYLVVYHPYRPLLQLLQDAGITDLTQFAWGIVNDTYKMDLILIHPPYMIALACIYIASVLKDKDITLWFEELRVDMNIVKNISMEILDFYDTYKIDPQRGLPEDKIAPVMNKLPSKA

SEQ ID NO: 1053 - protein, 420 aa, Oryza sativa
MDRASENRRLAAVGKPVPGIGEMGNRRPLRDINNLVGAPSHPSAIAKKPMLEKSGKEEQKPALVVSHRPMLRNFAASLTRKEQLDHQVSVADAAVVCTDPQKNPIPDGTVDDDVESCESNDYIAVDECNDTDEDESMMDIDSADSGNPLAATEYVEELYKFYRENEEMSCVQPDYMSSQGDINEKMRAILIDWLIEVHHKFELMDETLFLTVNIVDRFLEKQVVPRKKLQLVGVTAMLLACKYEEVAVPVVEDLVLISDRAYTKGQILEMEKLILNTLQFNMSVPTPYVFMRRFLKAAQSDKQLQLLSFFILELSLVEYQMLKYRPSLLSAAAVYTAQCALTRCQQWTKTCELHSRYTGEQLLECSRMMVDFHQKAGAGKLTGVHRKYSTFKFGCAAKTEPALFLLESGAGGYNLQKQPC

SEQ ID NO: 1054 - protein, 508 aa, Oryza sativa
MSSNLAASRRSSSSSSVAAAAAAKRPAVGEGGGGGGGKAAAGAAAAKKRVALSNISNVAAGGGAPGKAGNAKLNLAASAAPVKKGSLASGRNVGTNRASAVKSASAKPAPAISRHESATQKESVLPPKVPSIVPTAALAPVTVPCSSFVSPMHSGDSVSVDETMSTCDSMKSPEFEYIDNGDSSSVLGSLQRRANENLRISEDRDVEETKWKKDAPSPMEIDQICDVDNNYEDPQLCATLASDIYMHLREAETRKRPSTDFMETIQKDVNPSMRAILIDWLVEVAEEYRLVPDTLYLTVNYIDRYLSGNEINRQRLQLLGVACMLIAAKYEEICAPQVEEFCYITDNTYFRDEVLEMEASVLNYLKFEVTAPTAKCFLRRFVRVAQVSDEDPALHLEFLANYVAELSLLEYNLLSYPPSLVAASAIFLAKFILQPTKHPWNSTLAHYTQYKSSELSDCVKALHRLFSVGPGSNLPAIREKYTQHKYKFVAKKPCPPSIPTEFFRDATC

SEQ ID NO: 1055 - protein, 423 aa, Oryza sativa
MASRRQWGAGAGAVDVPAQERKGEAAKIARRPKTTTVVAQQPPRIRRALADVSNLVNGRAALPVVNRQKAAAAAADKCRKPIKQRNENNKAAKPEVIVISSDSEKHKKNPAQRAASRRAPIQTLTSILTKCSRASDGVISPKKELIYDIDASDSHNELAVVDYVEDIYRFYRNTENTYRPLCTYMVSQTEINERMRAILTDWLIEVHYRLMLMPETLYLTVYIIDQYLSLENVPRKELQLVGVSAMLIACKYEETWAPLVKDFLVISDNSFSRQQVLSTEKSILNKLQWNLTVPTMYMFILRYLKAALGDEELEHMTFFYAELALVQYSMLFFAPSVIAAAAVYAARCTLGLSPLWSDLLEYHTGLAEPQLLECARRLVSLHAAAPESRQKVVYKKYASPKLGAVSLHSPAKKLLPPPSPVAA

SEQ ID NO: 1056 - protein, 372 aa, Zea mays
MENSAAAAAARPRLTRAAAKRSAVVTAVAVAAKRKRVALSQLPTLPNAVLGAHDDDDDKPVRKQRLLPAAKPKPKPKAAPAPAAPAAADDTDDDIQLCKPYASDIYSYLRSMESQAKRRLAVDYIAAVQIDVTPNMRGILIDWLVEVAEEYKLVSDTLYLTVSYIDRFLSAKVLNRQKLQLLGVSAMLIASKYEEISPPNVEDFCYITDNTYTKQEVVKMESDILNVLKFEVGSPTAKTFLRMFIRSAQEDNKKYPSLQLEFLGSYLSELSLLDYGLIRSLPSLVAASAVFVARLTLDPHTHPWSKKMQTLTGYKPSELKDCVAAIHNLQLNRTCQSMVAIREKYRQHRFKGVSALLPPVEIPASYFNTLKE

SEQ ID NO: 1057 - protein, 424 aa, Zea mays
MAARAADENRRPAAGKPAPGVRDMASRRALTDIKNLVGAAPYPYAVAKKPMLQKSKRDEKQPALASSRPMTRKFAASLASKGQPECQPIVADPEPEVCQQKESVGDGTVDIDVELYELVDGSDSDIDMGATENKDIMNEDELLMDIDSADSGNPFAATEYVKELYTFYRENEAKSCVRPDYMSSQQDINSKMRAILIDWLIEVHYKFELMDETLFLMVNIIDIFLEKEVVPRKKLQLVGVTAMLLACKYEEVSVPVVEDLVLISYRAYTKGQILEMEKLILNTLQFNMSVPTPYVFMKRFLKAADADKQLELASFFMLELCLVEYQMLNYRPSHLAAAAVYTAQCAINRCQHWTKVCESHSRYTSDQLLECSRMMVDFHQKAGTSKLTGVHRKYSTYKFGCVAKILPAQFLLESGGTPPPSGAN

SEQ ID NO: 1058 - protein, 479 aa, Zea mays
MECARELRVRSTFTAAAMASKKQVGPGGAVPAQEQMNGGDAARLVRKPMDTFPQPAAARGRRALVDVGNLMNGRPSLVNHQKQAVAAAATSHKPLNVGNKKPLVPQAAARGLRPLADVTNLMIKDRAAPANRQKPVDAVFNRNGKAVKLKECKVKPEVIVIIPDSEKEKKGKFPGGQRVCRRVPTLFDNLTKCSRASDGITTPKKKDPYDIDAPDSCNELAVVEYVEDIYRFYKSTEGTCLPLSSYMSSQAEISERMRAILIDWIIEVQYRLTLMPETLYLTVYIIDQYLSMESVPRKELQLVGISAMLIASKYEEIWAPLVKDLMCLCDNAFTRDQILTKEKAILDMLHWNLTVPTMYMFIVRYLKAAMCDAELENMTFFYSELALVQYAMLVYPPSVTAAAAVYAARSTLGMNPQWTDILEHHTGLAEPQLLDCARRLISFHALAPESKQKAVYRKYSKPKLGSVALQSPDKKLLSG

SEQ ID NO: 1059 - protein, 442 aa, Zea mays
MASRNHNAAAPQLHHHNRAGVPALGKAKAVPARADALNRRPPLGDIGNLVSVRPATGNPQEQVNRPITRSFGAQLVKKAQAKAAIKNAAILPARHAPRQERKAPVKQQPPPEDIIVLSSDSEQSRAQSESSASSVRSRRKAINTLSSVLSARSKAACGIAGKPRQVVDDIDKLDVNNELAVVEYIEDIYTFYKIAQHERRPCDYIDAQLEINSKMRAILADWIIEVHHKFELMPETLYLTMYIIDQYLSLQPVLRKELQLVGVSSMLIACKYEEIWAPEVNDFILISDSAYSREQILSMEKGILNRLEWNLTVPTVYMFLVRFLKAATLGGKVEKEMENMVFFFAELALMQYDLVTRLPSLVAASAVYAARLTLKRAPLWTDTLKHHTGFRESEAELIECTKMLVIAHSTAPESKLRVVYKKYSSEQFGGVALRPPAEEICK

SEQ ID NO: 1060 - protein, 387 aa, Zea mays
MAAFAALFDPLYCPEEHLDLYHEGPVEVVDEQWQDQRGQQQPAALDDELPALFEALRDKEGVVLAGDGEEDGYGGSAGREAAVGWASRAAARLGFSALTSALSAAYLDRCFLPGGALRLGDQPWMSRLAAVACVALAAKVEETRVPLLLDLQLCAAASSDADAADADVFEAKTVRRMELLVLSALGWRMHPVTPFSYLQPVLADAAMRLRNCEAVLLAVMADWRWPRHRPSAWAAAALLTTAGGGDDDSELLALINAPEDETAECAKIISEVTGMSFLVCDVGGMIAGNKRKHAAARMYSPPLSPSGVIGALSCFSCESSLSATADSRTLATTAAGVGPWAPSAPVSVSSSPEPPGRAPKRAAAAGVPHPLPPDEESRDAWPSTCAA

SEQ ID NO: 1061 - protein, 321 aa, Zea mays
MPGDAYDLLCAEDDAAGSALLCTTDDDDGCCSAVEEDSAAAAASIAELIGGEAQYSPRPDYPDRLRSRSIDPAARAESVAWILKVQEYYGFLPLTAYLAVNYMDRFLSLHRLPEDGWAMQLLAVTCLSLAAKMEETLVPSLLDLQVEGTSRYDCFEPGTVGRMELLVLMALNWRLRSVTPFTFVDFFACKVDPGGRHTRCLIARATQVILAAMHDVEFLDHCPSSMAAAAVLCAIGETPSLESVSPGAAVSWCIGLAEEGISSCYRLMQRLVIGNVRTRVASTTTMAAVNLCCSDEALSSHSSATSSPPPAKRRKRSPTAT

SEQ ID NO: 1062 - protein, 349 aa, Zea mays
MGDAAASTSAPTTPTSILICLEDGSDLLADADDGAGTDLVVARDERLLVVDQDEEYVALLLSKESASGGGGPVEEMEDWMKAARSGCVRWIIKTTAMFRFGGKTAYVAVNYLDRFLAQRRVNREHAWGLQLLMVACMSLATKLEEHHAPRLSEFPLDACEFAFDRASVLRMELLVLGTLEWRMVAVTPFPYISCFAARFRQDERRAVLVRAVECVFAAIRAMSSVEYQPSTIAVASILVARGRETPAGNLDALKAILGSSFPQLDTGHVYSCYSAMIREDDKSPTQSTSTSTGVASSGVSVAAHAGGSGSPSPPGASVSVGANNAAGTAPPATTDNRNKRRRLRSPQRQ

SEQ ID NO: 1063 - protein, 445 aa, Zea mays
MATRNHRAAAAPQPANRGAARVAGKQKAAAAGTRRALGDIGNVVSDALDRAIKLPEGIHRPITRSFGAQLMKAALANKNADAAVAPAQPVAARAVTKPARKVTTKNVPRPGAGQAPKENKKPSAEGAAAASGRSVQKNRRKKPACTLSTVLSARSKAACPVTEKPKEPIEDIDKFDGDNQLALVDYVEDIYTFYRPPMHESRPIDYMGQTSPELSPRMRSILADWLIESHRRFQLMPETLYLTIYIVDRYLSLQPTPRRELQLVGVAALLIACKYEEIWAPEVNDLIHIADGAFNRSQILAAEKAILNSMEWNLTVPTPYHFLLRFAKAAGSADEQLQHTINFFGELALMDYGMVMTNPSTAAACAVYAARLTLGRSPLWTETLKHHTGPQRAADTGRAKTLVGSHAASASPDARLKAVYQKYATEQFGRVALHPPAPAALPDLV

SEQ ID NO: 1064 - protein, 391 aa, Zea mays
MAAFAALFDPLYCPEEHLDLYRDEPGEGADEQWPGQHGQQEPAVLDDELPALFEAHRAKEGVVLAEDGGYGGAAGREAAVGWVSRAAARLGLSALTAALAAAYLDRCFLPGGALRLGDQPWMARLAAVTCFALAAKVEETRVPPLLDLQLYAAADAADPYVFEAKTVRRMELLVLSALGWRMHPVTPFSYLQPVLADAATRLRSCEGVLLAVMADWRWPRHRPSAWAAAALLITAAAGDGGDGDGDTELLALINAPEDKTAECAKIISEVTGMSFLACDVGVSAGNKRKHAAAQLYSPPPSPSGVIGALSCFSCESSTSATAMAAAVGPWAPSASVSVSSSPEPPGRAPKRAAAASASASASAGVAPPVQVPHQLPPDEESRDAWPSTCAA

SEQ ID NO: 1065 - protein, 349 aa, Zea mays
MGERGAEEDGSGGSSLSLMCLEDGADLDAGGSAESADDGEPAVVAHSDAGEDQEEEYMDYLVSKESSFCCSPSSSPVSSDAGAETRPSSTASSSDEWFRCARHATVAWVLETRAYFGFSHRAAYLAVSYMDRFCLRRCMDVSVMPWAARLLAVACLSLAAKMEEYRAPALSEFRAHDDYDFSSVCIRRVELLVLSTLGWRMGGVTPLDYLPCLSFRLRRGGGGGLIAAKAAALIFSAAEAASVLDYRPSTVAVAAVLAAAHGAMTKEALECNMSSLTPSCLLDKDDVHACYSTMLSESSSPTPSKLADKRPPPSSSGSTMYESVDAASSFAATAGRSKRARLEMPAIGP

SEQ ID NO: 1066 - protein, 509 aa, Zea mays
MSTIAASRRSSSSSSSATAKRPAIADGPGGPKATAAQAKKRVALGNITNVAARGGRASVGGSLGNVMAPTSSAKLNPTVPLKKPSLATSARSVSSSIRGSADKPASIKPAPPVARHGSATQRHNNVPPPKVPTIADVPSRAPALVSCTGLVSPGRSGDSVSSDETMSTCDSMKSPDFEYVDNQDTSMLASLQRRTSEHLRISEDRDVEENKRKKNAVAPMEIDRICDVDSEYEDPQLCATLASDIYMHLREAETKKRPSTDFMETIQKDVNPSMRAILIDWLVEVAEEYRLVPDTLYLTVNYIDRYLSGNEISRQRLQLLGVACMLIAAKYEEICAPQVEEFCYITDNTYFRDEVLDMEASVLNYLKFEMTAPTAKCFLRRFARAAQACDEDPALHLEFLANYIAELSLLEYSLLSYPPSLIAASAIFLARFILQPTKYPWNSTLAHYTQYKPSKLSECVKALHRLCSVGSGSNLPAIREKYSQHKYKFVAKKQCPPQIPTEFFRDTTC

SEQ ID NO: 1067 - protein, 349 aa, Zea mays
MMPVAAVDDWSERGFSLTCEEDCADLGNGVVDDDEFLPLYNAGEEEEEEYLEQLVFKETSLCSSSDSAADCDGDGEGDEEYPSLASEEWFRQARLAAVKWILETRGCFGFGHRTAYLAIAYFDSFLLRRRVDREAMPWAAQLLSVACVSVAAKMEECQVPALSEFHAGGYDFDSASIRRMELLVLSTLGWRMGAVTPLDFLPCFSSRVHPHGGAGAGGHVAHKAIGFIFATAEAGSVLDHRPSTVAAAAILAATYGPLLTKEALDSKMSYLSPSCLIEKEHVHACYSMMVGDNNRRGSKRSLPCSVSNEIATSTYHSVLVDDVTDTAAAFATAVSARNKRIRLELTGIS

SEQ ID NO: 1068 - protein, 424 aa, Zea mays
MENLRSQNCHQGVAMEGVKFAPEKANTNRRALSDIKNIIGGPHQHLAVSKRALSEKPAAAAAANAKDQAGFVGHRPVTRKFAATLATQPTVALLDPIGSERLKRNADTAFHTPADMESTKMTDDSPLPMVSEMDEMMSPELKEIEMEDIEEAAPDIDSGDAGNSLAVADYVDEIYRFYRKTEGASCVPTNYMSSQTDINEKMRGILIDWLIEVHYKLELLEETLFLTVNIIDRFLARENVVRKKLQLAGVTAMLLACKYEEVSVPVVEDLILIGDRAYTRADILEMERRIVNTLNFNMSVPTPYCFMRRFLKAAQSEKKLELLSFFMIELSLVEYEMLQFCPSMLAAAAIYTAQCTINGFKSWNKCCELHTRYSEEHLMVCSRMMVELHQRAAHGKLTGVHRKYNTSRYSYAAKSEPATFLLDA

SEQ ID NO: 1069 - protein, 257 aa, Zea mays
MAANFWTSSHCKQLLDPEDVDLVPAADRERGITPEEFRLIKIHMSFHIWRLAQQVKVRQRVVATAIAYFRRVYTRKSMSDYDPRLVAPTCLYLASKVEESTVQARLLVFYIKKMCGSDDKYRFEIKDILEMEMKLLEALDYYLVVFHPYRPLLQLLQDAGITDLTQFAWGLVNDTYKMDLILIYPPYMIALACIYIASVLKDKDTTAWFEELRVDMNIVKNISMEILDFYDTYKIDPQRGIPEDKISPVMNKLPAKA

SEQ ID NO: 1070 - protein, 271 aa, Zea mays
MATTTDLGFEATELRLGLPGGGGGGEPALGGEGRSSSSASGKRGFAETIDLKLKLEPAAVVEAEEEEEDHGVAVALEKEEEAGKMKRSPSQSSVAAAAAAVLADPAEKPRAAKAQVVGWPPVRSFRKNIMSVQSDKGAAAANGDKSSPAAGGGAAFVKVSLDGAPYLRKVDLKMYRSYQQLSKALENMFSSFTIGSCGSQGMNGMNESKLVDLLNGSEYVPTYEDKDGDWMLVGDVPWEMFVESCKRLRIMKGSEAIGLAPRAMEKCKNRS

SEQ ID NO: 1071 - protein, 345 aa, Zea mays
MKRKENSEHSAPPLNRPRGKRKALAELPKSNGLNMNHDSAPRPSKPRTRSAARAEAEAEAAMKRRKAGDAARWPMDTRQPDAEAAVAPYVGDIDRYLRSLEVEPLRRPSHSYFQDIQKNICPKMRAILVDWLVEVAEEFKLHAETLHLAVSYVDRFLTMNVVARNKLQLLGVTALLVAAKYEEIESSKMKVVKMETDLLKSLSFQIGGPTVTTFLRQFIASCRGGNSASRGKLEFVCSYLAELSLLDYDCISYLPSVVAAACLFVARFIIHPKTRPWNLSLEQSTGYRVFDLQKSIYVIHELQLTIRCPNQVAIREKYKDPKFGCVSTMVSPREIPTSFLEGCHK

SEQ ID NO: 1072 - protein, 373 aa, Zea mays
MAARKKKPLLIACQATSARITRSQAAANSTRSGLAPSVPVPLKTEHNHPAKKKMKREASDENASADAGASAPLPKRRTVLKNVTNISCAKISKRCTAVTGLKLGPSQKAGQSINKQCTNKISMLLPLAVGGSSLVDDSNNAEETQMVDLLAQKEKQIVLLKEAQPLQNTEQNKGGACDEASVEERNAMNVHETAALKAGVSNGLNIVDIDKNNGDPQMCVTYVAEIYRNLMASEVSDEYKLVADTLYLTVYLIDQFLSQNCIQTHKLQLLGITSMLIASKYEEYSAPSAEEFCNITAGTYAKAEVLEMEQQVLNDLGFHLSVPTTNTFLRRFLRAAQASRTVRSVPKPHCNESFQSICIVLNTKLASYISRLI

SEQ ID NO: 1073 - protein, 352 aa, Glycine max
MAPSFDFASSLLCTEDSTVFDESHNNGGTMMTAMGVYEDTRSPRRRHFDEEPDELPLLSDESLVMMVEKECQHWSGLRYLNKFQTGDLDFGARMEAIDWIHKVRSHFGFGPLCGYLSINYLDRFLFAYELPKGRVWTMQLLAVACLSLAAKLDETEVPLSLDLQVGESKFLFEAKTIQRMELLVLSTLKWRMQAITPFTFLDYFLCKINDDQSPLRSSIMRSIQLISSTARGIDFLEFKPSEIAAAVAMYVMGETQTVDTGKAISVLIQHVEKERLLKCVQMIQELSCNSGSAKDSSASVTCLPQSPIGVLDALCFNYKSDDTNASSCVNSSHNSPVAKRRKLNKTCGAEQL

SEQ ID NO: 1074 - protein, 356 aa, Oryza sativa
MGVLCFGASNILLCAEDSSSVLGLGGFGGGGGEVAAELGCGGGGGFDFFGFGGGAVFPIDSDEFVALLVEKEMDHQPQRGYLEKLELGGLECSWRKDAIDWICKVHSYYNFGPLSLYLAVNYLDRFLSSFNLPHDESWMQQLLSVSCLSLATKMEETVVPLPMDLQVFDAEYVFEARHIKRMELIVMKTLKWRLQAVTPFSFIGYFLDKFNEGKPPSYTLASWCSDLTVGTLKDSRFLSFRPSEIAAAVVLAVLAENQFLVFNSALGESEIPVNKEMVMRCYELMVEKALVKKIRNSNASSSVPHSPITVLDAACFSFRSDDTTLGSSQSNSNNKDYNSQDSAPASKRRRLNTTPI

SEQ ID NO: 1075 - protein, 328 aa, Oryza sativa
MAASAAAAAAVSQALRDRDVLDAVGTSAAALSLAGSSFIVLCYLLFRELRKFSFKLVYFLAVSDMFCSLFTIMGGPSNAFYCFAHDYSAHFFCVASFLWTTTIAFTLHRTVVKHKTDVEEFGSIFHLYVWGTSLATTVLRSIGSDYGRPGTWCWIQQGSMGKACDLLCFVLHLVTFYLPLWGAILYNGYTYFQVNRMINNATRMAVGISDRSIQSDVRADKKAFNRWGYYPLILIGSWAFATINRVHDFANPGHKIFWLSILDVGFAGLMGLFNSIAYGLNSSVRRAIAERLDMYLPERFKRSLPTLTRFKSQQENELTSLIVDASNT

SEQ ID NO: 1076 - protein, 359 aa, Zea mays
MEEITQHFGVGASSHGHGHGQHHHHHHHHHPWASSLSAVVAPLPPQPPSAGLPLTLNTVAATGNSGGSGNPVLQLANGGGLLDACVKAKEPSSSSPYAGDVEAIKAKIISHPHYYSLLTAYLECNKVGAPPEVSARLTEIAQEVEARQRTALGGLAAATEPELDQFMEAYHEMLVKFREELTRPLQEAMEFMRRVESQLNSLSISGRSLRNILSSGSSEEDQEGSGGETELPEVDAHGVDQELKHHLLKKYSGYLSSLKQELSKKKKKGKLPKEARQQLLSWWDQHYKWPYPSETQKVALAESTGLDLKQINNWFINQRKRHWKPSEEMHHLMMDGYHTTNAFYMDGHFINDGGLYRLG

SEQ ID NO: 1077 - protein, 242 aa, Zea mays
MGQGGEVKAAPAVRVLVVDDSPVDRKVVELLLRNHNHQGGAAPFHVTAVDSGKKAMEHLRLMEQGGQLDSCAADANRITIDIVLTDYCMPEMTGYDLLKAIKALSSPNPIPVVVMSSENEPQRISRCLTAGAEDFILKPLKTKDVQRLRNCSSAARPRDDAAHQCESLRRSSRKLRSDQVAAPGHRSQPTTGLTMVLHASSIELSHYFQFLLKFVLLAYAVLCLTELLHRWSNGSVLSLWSA

SEQ ID NO: 1078 - protein, 686 aa, Zea mays
MAAAEARGGEFPVGMKVLVVDDDPTCLVVLKRMLLECRYDVTTCPQATRALTMLRENRRGFDVIISDVHMPDMDGFRLLELVGLEMDLPVIMMSADSRTDIVMNGIKHGACDYLIKPVRMEELKNIWQHVIRKKFNENKDHEHSGSLDDTDRNRPTNNDNEYASSANDGGDGSWKSQRKKREKEDDETDLENGDPSSTSKKPRVVWSVELHQQFVNAVNHLGIDKAVPKKILELMNVPGLTRENVASHLQKFRLYLKRIAQHHAGIPHPFVAPVSSANVAPLGGLEFQALAASGQIPPQALAALQDELLGRPTSSLALPGRDQSSLRVAAIKGNKHHEEREIAFGQPIYKCQNNAYGAFPQNSPAVGGLQPFAAWPNNKVGMTDSTSTLGNVGNSQNSNMLLHELQQQPDTLLLGTLHNIDAKPSGVVMPSQSLNTFPASEGISPNQNPLIIPSQPPSFVSSIPPSMKHESLLGLPSTSTSLLGGLDMVNQASTSQALISSHGTNLPGLMNRSSNAIPSPGISNFQSGNIHYVVNQNAMGVSSKPPGVLKTESTDSLSCSYGYIGGSTSVDSGLFSSQSKNPQYGLLQNQNDVNGSWSPSQDFDSFGNSLGQGHPGTTSSNFQSSALGKLPDQGRGRNHGFVGKGTCIPSRFAVDEVESPTNNLSHSIGNSGDIVNHDIFGFSGHM

SEQ ID NO: 1079 - protein, 709 aa, Zea mays
MQQVDEHKEEQRQSIHWERFLPVKTLRVLLVENDDSTRQVVSALLRKCCYEVIPAENGLHAWRYLEDLQNNIDLVLTEVFMPCLSGIGLLSKITSHKICKDIPVIMMSTNDSMSMVFKCLSKGAVDFLVKPLRKNELKNLWQHVWRRCHSSSGSESGIQTQKCAKLNTGDEYENGSDSNHDDEENDDGDDDDFSVGLNARDGSDNGSGTQSSWTKRAVEIDSPQPISPDQLVDPPDSTCAQVIHPRSEICSNKWLPTANKRNVKKQKENKDESMGRYLGIGAPRNSSAEYQSSLNDVSVNPIEKGHENHMSKCKSKKETMAEDDCTNMPSATNAETADLISSIARNTEGQQAVQAVDAPDGPSKMANGNDKNHDSHIEVTPHELGLKRSRTNGATAEIHDERNILKRSDQSAFTRYHTSVASNQGGARYGESSSPQDNSSEAMKTDSTCKMKSNSDAAPIKQGSNGSSNNDVGSSTKNVAARPSGDRERVASPLAIKSTQHASAFHTIQNQTSPANLIGEDKADEGISNTVKMSHPTEVPQGCVQHHHHVHYYLHVMTQKQPSTDRGSSDVHCGSSNVFDPPVEGHAANYSVNGGVSVGHNGCNGQNGSSAVPNIARPNIESINGTMSQNIAGGGIVSGSGSGNDMYQNRFLQREAALNKFRLKRKDRNFGKKVRYQSRKRLAEQRPRVRGQFVRQSEQEDQTAQGSER

SEQ ID NO: 1080 - protein, 631 aa, Zea mays
MGGGADEVVKVVDSEDGEGEEEEAEAAAAEGSSKETPMLPRMPVRVLLAEGDDSTRHVISALLRKCGYRVAAASDGVKAWDILKEKSFNIDLVLTEVELPLMSGFLLLSTIMEHDASKNIPVIMMSSHDSVSMVFKCMLKGAADFLVKPLRKNELRNLWQHVWRKQLANGGPDVQHIQEENLAERMEQKTGVTKADNLNSDGPHKNRECSEQESDAQSSCTRSELEAESKQTNNILEYMQSTERHLFIRSHKDLELNGETKTRTKGNNLIPTREDDLLPKKRTCLNDNDSERTSRDMELVHIMDNQQKHDTQRDVDTMRTTSRGNDEKNSIPAHQLELSLRRTDYGKLENHEKNDRRTLNHSTSSAFYLYNCRTASSLGNAGDGQLCSTSETLVDVENRNGDLAALSEDTTETNRPPIRVVPFPVPVQCFTFDGQPFWNGTPVASPFYPQSAPPIWNSKTPTWQESTPQATSLPQKSQQNEPVEMDAKPVENAEEQFVVGPPSASGKQLHVEIPKDGLRHISPVTGESGISTVLDSTRNTLSSSGCDSTSNRITASTEPSSNVYRGVPETARAEGLRHLSQREAALNKFRLKRKDRCFEKKVRYQSRKLLAEQRPRVKGQFVRQDHSIQGS

SEQ ID NO: 1081 - protein, 631 aa, Zea mays
MTVDELKLQARASGGHGAKDQFPVGMRVLAVDDDPTCLKILENLLLRCQYHVTTTGQAATALKLLREKKDQFDLVISDVHMPDMDGFKLLELVGLEMDLPVIMLSANGETQTVMKGITHGACDYLLKPVRIEQLRTIWQHVVRRRSCDAKNSGNDNDDSGKKLQVVSAEGDNGGVNRNKRISRKGRDDNGDDGDDSDDNSNENGDSSSQKKPRVVWSVELHRKFVAAVNQLGIDKAVPKKILDLMNVENITRENVASHLQKYRLYLKRLSADASRQANLTAAFGGRNPAYVNMGLDAFRQYNAYGRYRPVPTTNHSQPNNLLARMNSPAFGMHGLLPSQPLQIGHNQNNLSTSLGNVGGMNNGNLIRGAHMPLQDTSKCFPTGPSGNSFANISNSTQLVTTNNLPLQSLEPSNQQHLGRLHSSADPFNSFVGEPPQFADLGRCNTTWPTAVSSSNVQEIGQKDRIVNRPKLEPLSSFTEASSQIPLLGSEMQSHQVASLASNGLPMPFTQEAVPFAYGSSTNSREMLNNNLALSNSGVNSTLPNLRIDGSVVPGQTLGGSNSGGCVVPPLQDGRIDHQAVSSHLNYNNELMGTGRLQRGLSGGLDDIVVDMFRPDRADDGVSFIDGDWELV

SEQ ID NO: 1082 - protein, 584 aa, Zea mays
MALTDATAFPYGLRVLVVDDDPTWLKILEKMLRKCSYEVTTCGLASVAIQILRERRNKFDIVISDVNMPDMDGFKLLELIGLEMDLPVIMMSIDGETSRVMKGVQHGACDYLLKPVRMKELRNIWQHVYRKKMHEVKEIEGNDSYDDLQMFRNGVEGFDERDLFMRADSDTMRKRKDVNKDHADQDSSDGATVKKARVVWSVDLHQKFVNAVNQIGFDKVGPKKILDLMNVPGLTRENVASHLQKYRLYLSRLQKQNEERIMGAARQDFNQKGPSDHLNLRSSFQEQPGNLSNGCQHSSQKVEAQTNILDPHLDDTKTSMPLKVPDKNGISASDAVDPHNITTASPLSGVFSFERMPVNQDRKLSETMILECESWSGSVPPKQFMQYPKHNHERCDLLGDYSCLPKPDLEHPIAPGHLYAPPPVISMSYNVEKDVRDFSDVKPDLLGCMKSLSPALTCTVESVSAQLSDSVVTSTNSDRKFSSVEGLSSIKDCDFDQERNGAILFTSEEASILCGTDFTCLPEDLSGYQLQGVSFGNKGLNSIDLYQCNDTMLIPGLQNNWYDDDVEFSSETVEFPLLDGGLFA

SEQ ID NO: 1083 - protein, 242 aa, Zea mays
MTVPDAESRFHVLAVDDSLVDRKLIEMLLKTSSYQVTTVDSGSKALELLGLRDASSPSPSSPDHQEIDVNLIITDYCMPGMTGYDLLKRVKGSSSLKDIPVVIMSSENVPARISRCLQDGAEEFFLKPVKLADMKKLKSHLLKRKQPKEAQAQAQAQAQQGQAVELEPEQQLDPRTQPAHDAEETAAEPPPAASNGTTDGGNKRKAAAMEEEGMLAVMTVAAPESSTKPRLSTTTSSLAVET

SEQ ID NO: 1084 - protein, 244 aa, Zea mays
MEAGGAGAEGVMRVLLVDDSPVDRRVAQLLLSSNSCAGSFHVIAVDSAKKAMEFLGLKDGGKEQAIDMVLTDYCMPEMTGYDLLKAIKALNPLKPIPVIVMSSEDEPQRISRCLNAGAEDFIVKPLQSKDVQRLRNCSTVGRPSNKGGATLPCEENAVAKWSNNKLPPSAGAGAGASATSPSGRRANLAGVAMRQVLHSSSVEISQYLPLLLKLVVLAYAALCLGELLHRWSSGGSCSLSPWCA

SEQ ID NO: 1085 - protein, 235 aa, Zea mays
MPSQSTHTSSSLSSSTAPILPCSSAAALFRSVMAAVATETPFHVLAVDDSLPDRKLIERLLKTSSFQVTTVDSGSKALQFLGLHDQDSTVPPVHTHQLDVAANQDVAVNLIITDYCMPGMTGYDLLKKIKESSSLRDIPVVIMSSENIPSRINRCLEEGADEFFLKPVRLSDMNKLKPHILKSRCNQEQHQQSDSHSGERRNPTISSSDSINNRKRKGAGTEEILPQLANRSRHS

SEQ ID NO: 1086 - protein, 157 aa, Zea mays
MAAAATATPAVAPEAGDRKAVAPPVDAVDLELELEEKHVLAVDDSSVDRAVIAKILRSSKYRVTTVDSATRALELLALGLVPDVNMIITDYWMPGMTGYELLKHVKESSALRAIPVVIMSSENVPTRISRCLEEGAEDFLLKPVRPADVSRLCSRIR

SEQ ID NO: 1087 - protein, 526 aa, Zea mays
MVGGGEGDRVGGGVGVGGGQQFVDRSKVRILLCDGDASSSREVLRLLCNCSYHVTCAKSPRQVINILNYEGGEIDIILAEVDLPVSKCFKMLKYIARNKDLRHIPIISRQPSYSEPLMSNRDEVSVVVKCLRLGAAEYLVKPLRTNELLNLWTHVWRRRRMLGLPEKNFFNDNFELVLSEPSDANTNSATLLSDETDDRPKENTNQETGTSNQLEYESNPSVAERDQRDKIGAPGSALDASQSSTPGRMFSRPIKTNLKVAESSAFLAYVKSSTPATSSFDSGLQRGDSRLDSLDNHGNCSSATDRSDTGTDVNIRNKEAFEMPVQYPMVCFSSSSMHMERSNEGHNDTSGTPPAYHFPFYYPGMVEHNMALSSVQNFQANINSAQAHTPPAMLHQYNVFSQCHSLPMISPFQFNTSGMSMHSSHLPTQNVWSSASSTPTPDETCNRSERRAAALAKFRQKRKERCFDKKVRYVNRKKLAETRLRVRGQFVRHASNMDIISTGDDISEDEDDDPTSREVDMISSPE

SEQ ID NO: 1088 - protein, 321 aa, Zea mays
MAPAVSAAASAAMRQALRDRQILDAVGTGAAALSLAGSSFIVICYLLFRELRKFSFKLVFYLAVSDMFCSLFTILGGPSNAFYCFAHDYSAHFFCVASFLWTTTISFTLHRTVVKHKTDVEEFGSIFHLYVWGTSLSTTVLRSIGSDYGRPGTWCWIQQGSMAKVLHLITFYLPLWGAILYNGFTYYEVNRMLNNATQMAAGISDRSNQSDIRADRKAFNRWGYYPLILIGSWAFATINRLYDFANPGHRIVWLSFLDVGFAGLMGLFNSIAYGLNSSVRRAISERIDTFLPERIKRSLPALSRLRSQQENELTSLIVEGN

SEQ ID NO: 1089 - protein, 153 aa, Zea mays
MDYSNLRRQAASMKKTLFDQGYLDEQFCQVEDLQDEASPNFAEEVVTLFFKDSARLISNAEQALEKYPKDFNRWDAYMQQLKGSCSSIGASRMKSECVSFRDYCGQGNVEGCMRSFQKVKREHGALRQKLEAYFQLLRQAGPAGAATRPGCKN

SEQ ID NO: 1090 - protein, 152 aa, Zea mays
MEYSNLQQQAASLKKNLFDQGYLDEQFCQIEDLQDEASPNFTEEVVSLFFKNSTRLMTNIEQAMDRNPRDFSKWDVNMQQLKGTCSSIGACRMKNECTSFRNRCGDENVEGCMRSFQNLKREHGVLRQKLESYFQLLRQAGPAVTATRPRGM

SEQ ID NO: 1091 - protein, 155 aa, Glycine max
MDVGQMQRQWIDYTKSLFLEGFLDGQFLQLQQLQDENNPDFVVEVVSLFFEDSERLLKDLTFALDQNGVDFKKVDAHVHQLKGSSSSIGAQRVKNACIAFRNFCEEQNTDACVRCLQQVKQEYCLVKNKLETMFRLEQQIVAAGGSIPTELSFSG

SEQ ID NO: 1092 - protein, 167 aa, Saccharomyces cerevisiae
MSTIPSEIINWTILNEIISMDDDDSDFSKGLIIQFIDQAQTTFAQMQRQLDGEKNLTELDNLGHFLKGSSAALGLQRIAWVCERIQNLGRKMEHFFPNKTELVNTLSDKSIINGINIDEDDEEIKIQVDDKDENSIYLILIAKALNQSRLEFKLARIELSKYYNTNL

SEQ ID NO: 1093 - protein, 636 aa, Oryza sativa
MDGCDCIEPLWPTDELLIKYQYISDFFIALAYFSIPLELIYFVKKSSFFPYRWVLIQFGAFIVLCGATHLINLWTFTTHTKTVAMVMTVAKVSTAVVSCATALMLVHIIPDLLSVKTRELFLKNKAEQLDREMGLIRTQEETGRHVRMLTHEIRSTLDRHTILKTTLVELGGTLGLEECALWMPSRSGSSLQLSHTLRHQITVGSTVSINLPVVNQVFSSNRAIIIPHTSPLARIRPLAGRYVPPEVAAVRVPLLHLSNFQINDWPELSAKSYAIMVLMLPSDSARKWHVHELELVEVVADQVAVALSHAAILEESMRARDLLMEQNVALDLARREAEMAIRARNDFLAVMNHEMRTPMNAIIALSSLLLETELTPEQRLMVETVLKSSNLLATLINDVLDLSKLEDGSLELEIKAFNLHAVFKEVMSFIKPIAAIKRLSVSVMLAPDLPLCAIGDEKRLMQTILNISGNAVKFTKEGHITLVASVVKADSLREFRTPDFHPTASDDNFYLKVQIKDTGCGISPQDLPQVFTKFPQSQPGGNRGYSGSGLGLAICKRFVTLMGGHIWLDSEGTGRGCTVTFVIQLGICDNTNAYQQKLIPLVWPSSGDADFVGPVPNAPNEEKGQASLKSRYQRSI

SEQ ID NO: 1094 - protein, 635 aa, Oryza sativa
MDGSCDCIEPLWQADDLLVKYQYISDFFIALAYFSIPLELIYFVKKSAFFPYRWVLIQFGAFIVLCGATHLINLWTFAIYTKTIAVVLTVAKAATAVVSCITALMLVHIIPDLLNVKLRERFLKDKADELDREMGIIRTQEETGRHVHMLTHEIRSTLDRHTILRTTLVELGRTLVLAECALWMPTRSGSALQLSHTIYNSAAIGSVVPINLPIVSKVFNSNRVVKIPHTSPLASITADKSRYVPPEVVAIRVPLLHLTNFQINDWPELSAKSFAVMVLMLPPDSAREWRPHERELVEVVADQVAVALSHAAILEESMRARDLLMEQNIALDAARREAEMAICARNDFLAVMNHEMRTPMRAIVSLSSLLLETNLSAEQRLMVETILKSSDLLATLTNDVLDVSKLENGSLELEIAPFNLHSTFTDVVNLIKPVAACKRLSVMVTLAPELPLHAIGDQKRLMQIILNVAGNSIKFTKEGHVSITASMARPDALRGPHEPDYHPVVSDGFFYLAVQVKDTGCGISPQDMPHTFRKFAHPENAGKWNSGSGLGLALSRRFVSLMEGNIWLESEGVGKGCTAMFFVKLGMPEKPNANLRRMAPHPLQPNQGAGGPDALSISIMDSNPRVPRVRYQSSV

SEQ ID NO: 1095 - protein, 267 aa, Oryza sativa
MDPKLVEVTQLFSRFKAAFARNDFDTCVDLLSQLKVRLTKFPSLPPSFQQTPNAVEELKIARDIYEHAVVLSVKIEDQDAFERDFCQLKPYYMDTCGIIPPSPQEYPILGLNLLRLLVQNRIAEFHTELELLPVTALENPCIKHAVELEQSFMEGAYNRVLSARQAVPHETYVYFMDLLAKTVRDELAGCSEKGYDYMSIAEARQVLMFSSDKELHQYIAEEHPEWEVKDGSVFFQKAKETQPCKEIPSLQVINQTLSYARELERIV

SEQ ID NO: 1096 - protein, 274 aa, Saccharomyces cerevisiae
MPSLAELTKSLSIAFENGDYAACEKLLPPIKIELIKNNLLIPDLSIQNDIYLNDLMITKRILEVGALASIQTFNFDSFENYFNQLKPYYFSNNHKLSESDKKSKLISLYLLNLLSQNNTTKFHSELQYLDKHIKNLEDDSLLSYPIKLDRWLMEGSYQKAWDLLQSGSQNISEFDSFTDILKSAIRDEIAKNTELSYDFLPLSNIKALLFFNNEKETEKFALERNWPIVNSKVYFNNQSKEKADYEDEMMHEEDQKTNIIEKAMDYAISIENIV

SEQ ID NO: 1097 - protein, 267 aa, Zea mays
MDPKMTEVTQMFARFKAAYTRNDLDACVTLLSQLKVHLTKFPSLPPSFEQTPKAVEELKLARDIYEHAVVLSVKLEDQDAFERDFCQLKPYYMDTCGIIPPSPEEYPILGLNLLRLLVQNRIAEFHTELELLPVKALEHPCIKHAVELEQSFMEGAYNRVLSARQAVPHETYVYFMDLLAKTVRDEIAGCSEKGYDSLSVSDAKQMLMFSSDQDLHEYITEEHPEWELKNGAVFFQKAKESQPYKEIPSLQLINQTLSYARELERIV

SEQ ID NO: 1098 - protein, 267 aa, Glycine max
MDPKLKEVSQLFDRFKASFIRNDFDTCSNLLSQLKVLLTGFRSLPPLFADTPNAVHELTIARDIYEHAVVLSVKNEDQDAFERDFFQLKPYYTDACNRLPPSPQEYPILGLNLLRLLVQNRIAEFHTELELLSSAALENPCIKHAVELEQSFMEGAYNRVLSARQTVPHDTYVYFMDLLAKTVRDEIAGCSEKAYDYLSIKDAKQMLLFSSDQELLEYIKEEHPEWEIKNGSVFFQKAKESAPCKEIPSLQLINQTLSYARELERIV

SEQ ID NO: 1099 - protein, 974 aa, Zea mays
MGGKYRAARTKRWWRGLAAAGWVLTAVVCSAVMHWTLRRDSMDRAEERLVSMCEERARMLQEQFGVTVNHVHAIAILISTFNFEKSPPAIDQDTFAKYTARTSFERPLLNGVAFAQRVFHHEREMFESQQGWVMNTMQREPAPPQVEYAPVIFSQDTVSYLARIDMMSGEEDRENIFRARTTGKAVLTNPFRLLGSNHLGVVLTFAVYRPDLPADASVEQRVEATIGYLGGAFDVESLVENLLSKLAGNQDIVVNVYDVTNASDAMVLYGPSSLDEQVPFLHVSMLDFGDPFRKHEMRCRYRQKLPMPWSAITNPLGTFVIWMLLGYSIAAAYSRYDKVTEDCRKMEELKTQAEAADVAKSQFLATASHEIRTPMNGVLGMLDMLLGTDLTMTQKDYAQTAQMCGRALITLINDVLDRAKIEAGKLELEAVPFDLRSLMDDVVSLFSSKSREKCIELAVFVCDNVPKVVIGDPWRFRQILTNLVGNAVKFTERGHVFVRVCLAENSNMEANQVLHGAMNGKGGRVESTANGAFNTLSGFEAADRRNSWQYFKLLLSDKESLLDDLESENSNQSDSDRVTLAISIEDTGVGIPLQAQDRVFTPFMQADSSTSRNYGGTGIGLSISKCLAELMGGQISFTSHPSVGSTFTFSATLKHSHKDISGDSSRSLTEALPTAFKGMKAILVDGRPVRSAVTRYHLKRLGILLQVVNNMNAVVKAFPGQNGAAGSREKASILFIESDFWRPETDVQLLNHLREQKNGQLSDGHKVVLLVTSEADKDKYGSIFDIVMCKPIRASTIASSIQQLLKVEIAERKDNQNRPSFLRSLLVGKNILVVDDNKVNLRVAAAALKKYGANVSCVESGKDAISLLQPPHRFDACFMDVQMPEMDGFEATGQIRQMELKANEERKNKLASIEGSTTAEYHLPVLAMTADVIQATYEECIKSGMDGYVSKPFDEEQLYQAVSRLVVGTTDSAV

SEQ ID NO: 1100 - protein, 1080 aa, Arabidopsis thaliana
MRRDFVYNNNAMFNPLTTHYSSDMNWALNNHQEEEEEPRRIEISDSESLENLKSSDFYQLGGGGALNSSEKPRKIDFWRSGLMGFAKMQQQQQLQHSVAVKMNNNNNNDLMGNKKGSTFIQEHRALLPKALILWIIIVGFISSGIYQWMDDANKIRREEVLVSMCDQRARMLQDQFSVSVNHVHALAILVSTFHYHKNPSAIDQETFAEYTARTAFERPLLSGVAYAEKVVNFEREMFERQHNWVIKTMDRGEPSPVRDEYAPVIFSQDSVSYLESLDMMSGEEDRENILRARETGKAVLTSPFRLLETHHLGVVLTFPVYKSSLPENPTVEERIAATAGYLGGAFDVESLVENLLGQLAGNQAIVVHVYDITNASDPLVMYGNQDEEADRSLSHESKLDFGDPFRKHKMICRYHQKAPIPLNVLTTVPLFFAIGFLVGYILYGAAMHIVKVEDDFHEMQELKVRAEAADVAKSQFLATVSHEIRTPMNGILGMLAMLLDTELSSTQRDYAQTAQVCGKALIALINEVLDRAKIEAGKLELESVPFDIRSILDDVLSLFSEESRNKGIELAVFVSDKVPEIVKGDSGRFRQIIINLVGNSVKFTEKGHIFVKVHLAEQSKDESEPKNALNGGVSEEMIVVSKQSSYNTLSGYEAADGRNSWDSFKHLVSEEQSLSEFDISSNVRLMVSIEDTGIGIPLVAQGRVFMPFMQADSSTSRNYGGTGIGLSISKCLVELMRGQINFISRPHIGSTFWFTAVLEKCDKCSAINHMKKPNVEHLPSTFKGMKAIVVDAKPVRAAVTRYHMKRLGINVDVVTSLKTAVVAAAAFERNGSPLPTKPQLDMILVEKDSWISTEDNDSEIRLLNSRTNGNVHHKSPKLALFATNITNSEFDRAKSAGFADTVIMKPLRASMIGACLQQVLELRKTRQQHPEGSSPATLKSLLTGKKILVVDDNIVNRRVAAGALKKFGAEVVCAESGQVALGLLQIPHTFDACFMDIQMPQMDGFEATRQIRMMEKEAKEKTNLEWHLPILAMTADVIHATYEECLKSGMDGYVSKPFEEENLYKSVAKSFKPNPISPSS

SEQ ID NO: 1101 - protein, 1176 aa, Arabidopsis thaliana
MSITCELLNLTSKKAKKSSSSDKKWLKKPLFFLILCGSLVIVLVMFLRLGRSQKEETDSCNGEEKVLYRHQNVTRSEIHDLVSLFSDSDQVTSFECHKESSPGMWTNYGITCSLSVRSDKQETRGLPWNLGLGHSISSTSCMCGNLEPILQQPENLEEENHEEGLEQGLSSYLRNAWWCLILGVLVCHKIYVSHSKARGERKEKVHLQEALAPKKQQQRAQTSSRGAGRWRKNILLLGILGGVSFSVWWFWDTNEEIIMKRRETLANMCDERARVLQDQFNVSLNHVHALSILVSTFHHGKIPSAIDQRTFEEYTERTNFERPLTSGVAYALKVPHSEREKFEKEHGWAIKKMETEDQTVVQDCVPENFDPAPIQDEYAPVIFAQETVSHIVSVDMMSGEEDRENILRARASGKGVLTSPFKLLKSNHLGVVLTFAVYDTSLPPDATEEQRVEATIGYLGASYDMPSLVEKLLHQLASKQTIAVDVYDTTNTSGLIKMYGSEIGDISEQHISSLDFGDPSRNHEMHCRFKHKLPIPWTAITPSILVLVITFLVGYILYEAINRIATVEEDCQKMRELKARAEAADIAKSQFLATVSHEIRTPMNGVLGMLKMLMDTDLDAKQMDYAQTAHGSGKDLTSLINEVLDQAKIESGRLELENVPFDMRFILDNVSSLLSGKANEKGIELAVYVSSQVPDVVVGDPSRFRQIITNLVGNSIKFTQERGHIFISVHLADEVKEPLTIEDAVLKQRLALGCSESGETVSGFPAVNAWGSWKNFKTCYSTESQNSDQIKLLVTVEDTGVGIPVDAQGRIFTPFMQADSSTSRTYGGTGIGLSISKRLVELMQGEMGFVSEPGIGSTFSFTGVFGKAETNTSITKLERFDLAIQEFTGLRALVIDNRNIRAEVTRYELRRLGISADIVSSLRMACTCCISKLENLAMILIDKDAWNKEEFSVLDELFTRSKVTFTRVPKIFLLATSATLTERSEMKSTGLIDEVVIKPLRMSVLICCLQETLVNGKKRQPNRQRRNLGHLLREKQILVVDDNLVNRRVAEGALKKYGAIVTCVESGKAALAMLKPPHNFDACFMDLQMPEMDGFEATRRVRELEREINKKIASGEVSAEMFCKFSSWHVPILAMTADVIQATHEECMKCGMDGYVSKPFEEEVLYTAVARFFEPC

SEQ ID NO: 1102 - protein, 1036 aa, Arabidopsis thaliana
MSLFHVLGFGVKIGHLFWMLCCWFVSWFVDNGIEDKSGLLVGSVGDLEKTKMTTLKKKNKMWFWNKISSSGLKIPSFSYQFLGSVKFNKAWWRKLVVVWVVFWVLVSIWTFWYFSSQAMEKRKETLASMCDERARMLQDQFNVSMNHVQAMSILISTFHHGKIPSAIDQRTFSEYTDRTSFERPLTSGVAYAMRVLHSEREEFERQQGWTIRKMYSLEQNPVHKDDYDLEALEPSPVQEEYAPVIFAQDTVSHVVSLDMLSGKEDRENVLRARSSGKGVLTAPFPLIKTNRLGVILTFAVYKRDLPSNATPKERIEATNGYLGGVFDIESLVENLLQQLASKQTILVNVYDITNHSQPISMYGTNVSADGLERVSPLIFGDPLRKHEMRCRFKQKPPWPVLSMVTSFGILVIALLVAHIIHATVSRIHKVEEDCDKMKQLKKKAEAADVAKSQFLATVSHEIRTPMNGVLGMLHMLMDTELDVTQQDYVRTAQASGKALVSLINEVLDQAKIESGKLELEEVRFDLRGILDDVLSLFSSKSQQKGVELAVYISDRVPDMLIGDPGRFRQILTNLMGNSIKFTEKGHIFVTVHLVDELFESIDGETASSPESTLSGLPVADRQRSWENFKAFSSNGHRSFEPSPPDINLIVSVEDTGVGIPVEAQSRIFTPFMQVGPSISRTHGGTGIGLSISKCLVGLMKGEIGFSSTPKVGSTFTFTAVFSNGMQPAERKNDNNQPIFSEFRGMKAVVVDHRPARAKVSWYHFQRLGIRVEVVPRVEQALHYLKIGTTTVNMILIEQEIWNREADDFIKKLQKDPLFLSPKLILLANSVESSISEALCTGIDPPIVIVKPLRASMLAATLQRGLGIGIREPPQHKGPPALILRNLLLGRKILIVDDNNVNLRVAAGALKKYGADVVCAESGIKAISLLKPPHEFDACFMDIQMPEMDGFEATRRIRDMEEEMNKRIKNGEALIVENGNKTSWHLPVLAMTADVIQATHEECLKCGMDGYVSKPFEAEQLYREVSRFFNSPSDTES

SEQ ID NO: 1103 - protein, 1013 aa, Zea mays
  unsure (1)..(1013): unsure at all Xaa locations
MGVGGGGGGGGGEAAAAVAVEGDEAGKGRRWWRVKVKLSTVAVVAWVLASAALWAGLHWRFRRAALHKAEEALVCMCEERARMLQDQFAVSVNHVHALAILVATFHYDKHPPALDQDTFAVYAARTSFERPLLSGVAYAQRVVHADRESFERQQGWIIKTMKHEPSPAQDEYAPVIYSQETISYIEGLDVMSGEEDRENILRARATGKAVLTRPFRLMSNHLGVVLTFPVYLVDLPNDTAVEDRVAATAGYLGGAFDVESLVENLLRQLAGNQELVVNVYDVTNHSNPLVMYGSEVPLGIPSPSHTYTLDFGDPLRKHQMVCRYRNKLHVSWSAITTPSGVFVICMLVGYIIYAAWSRYDNVKEDCRKMEALKKRAEAADIAKSQFLATVSHEIRTPMNGVLGMLDMLLDTELKSTQRDYAQTAQVCGKALISLINEVLDRAKIEAGKIDLESVPFDLRSILDDVISLFSSKSREKGIELAVYVSERVPEILLGDPGRFRQIITNLVGNSIKITIFTLSQFTERGHIFVQVHLADHSNLATEAKIEPVVNGMNGHKDEAIAIPTSGSHNTLSGFEAADSRNNWENFKLLLSYEKNEMPYESDSDKVTLVVSVEDTGIGIPLHAQGRVFTPFMQADSSTSRNYGGTGIGLSISKCLVEIMGGQINFVSRPLVGSTFTFTAVLRRCDKNAISDSKTVALHPLPSSFKGLSALLVDKRPVRATVTKYHLQRLGITSEVVGTIDPTFGVLSGRNGSSLTSIGKKQPCMLLIESDSWGPQMDVSLHARLQEMKQSDRIHVLPKVFLLSAAESDKVKKIHAVDSVIPKPLKASALAACLFQALGITQPSHEKRDDSGSLHGRDGSGSLHGLLLGKNILVVDDNKVNLRVAAGTLKKYGAKVECVESGKDALSLLQVPHKFDLCLMDIQMPXMDGFEATRQIRAMEGKANEQADDSESGSEIAAKTAKWHLPILAMTADVIQATHEECTKCGMDGYVSKPFEEKQLFQAVQKFLGPCVSS

SEQ ID NO: 1104 - protein, 491 aa, Zea mays
MAPSPPRRAALLLTTVLLLAAAGSTPGATAAGIFQVRRKFTAGVGGGAGANISALRAHDGTRHGRLLAAADLPLGGLGLPTDTGLYYTEIKLGTPPKHYYVQVDTGSDILWVNCITCEQCPHKSGLGLDLTLYDPKASSTGSMVMCDQAFCAATFGGKLPKCGANVPCEYSVTYGDGSSTIGSFVTDALQFDQVTRDGQTQPANASVIFGCGAQQGGDLGSSNQALDGILGFGEANTSMLSQLTTAGKVKKIFAHCLDTIKGGGIFSIGDVVQPKVKTTPLVADKPHYNVNLKTIDVGGTTLQLPAHIFEPGEKKGTIIDSGTTLTYLPELVFKEVMLAVFNKHQDITFHDVQGFLCFQYPGSVDDGFPTITFHFEDDLALHVYPHEYFFANGNDVYCVGFQNGASQSKDGKDIVLMGDLVLSNKLVIYDLENRVIGWTDYNCSSSIKIKDDKTGATSTVNSHDLSSGWKFHWHMSPVLLLVTTVCSYLIC

SEQ ID NO: 1105 - protein, 510 aa, Zea mays
MAQLAVRSLLLSLLLVSPVVASPGIVKLNSSSTLFGIEFPPFNTAVAATGCDSKLVAADEAGDEQKQPASSSPSLQLRMKHRSAEGGRTRKESFLDKAEKDAVRIETMHRRAARSGVARMPASSSPRRALSERMVATVESGVAVGSGEYLIDVYVGTPPRRFRMIMDTGSDLNWLQCAPCLDCFEQRGPVFDPAASSSYRNVTCGDQRCGLVAPPEAPRACRRPAEDSCPYYYWYGDQSNTTGDLALESFTVNLTAPGASRRVDGVVFGCGHRNRGLFHGAAGLLGLGRGPLSFASQLRAVYGHTFSYCLVEHGSDAGSKVVFGEDYLVLAHPQLKYTAFAPTSSPADTFYYVKLKGVLVGGDLLNISSDTWDVGKDGSGGTIIDSGTTLSYFVEPAYQVIRQAFVDLMSRLYPLIPDFPVLNPCYNVSGVERPEVPELSLLFADGAVWDFPAENYFVRLDPDGIMCLAVRGTPRTGMSIIGNFQQQNFHVVYDLQNNRLGFAPRRCAEV

SEQ ID NO: 1106 - protein, 478 aa, Zea mays
MSSPAVRRVVLLSSLLCAGALGFLPCSHAAAVAPGYVAVSAASFVPSSTCSSPDRVPPHRRNGTSAVLRLTHRHGPCAPSRASSLAAPSVADTLRADQRRAEYILRRVSGRAPQLWDSKAAAAVATVPASWGYDIGTLNYVVTASLGTPGVAQTMEVDTGSDLSWVQCKPCAAAPSCYSQKDPLFDPAQSSSYAAVPCGGPVCAGLGIYAASACSAAQCGYVVSYGDGSNTTGVYSSDTLTLSASSAVQGFFFGCGHAQSGLFNGVDGLLGLGREQPSLVEQTAGTYGGVFSYCLPTKPSTAGYLTLGVGGPSGAAPGFSTTQLLPSPNAPTYYVVMLTGISVGGQQLSVPASAFAGGTVVDTGTVVTRLPPTAYAALRSAFRSGMASYGYPTAPSNGILDTCYNFAGYGTVTLPNVALTFGSGATVTLGADGILSFGCLAFAPSGSDGGMAILGNVQQRSFEVRIDGTSVGFKPSSC

SEQ ID NO: 1107 - protein, 461 aa, Zea mays
MTSSIPKLLLLLFFLSHRSPIARAGDDGSYKVLSMGSPRTDSVCSQSKAVPSSSAGAATVPLHHRHGPCSPLPTKKMPTLEETLHRDQLRAAYIQRKFSGGGGAGGDVQRSDATVPTALGTSLNTLEYLITVGLGSPATSQTMLIDTGSDVSWVQCKPCSQCHSQADPLFDPSSSSTYSPFSCGSADCAQLGQEGNGCSSSSQCQYIVTYGDGSSTTGTYSSDTLALGSSAVRSFQFGCSNVESGFNDQTDGLMGLGGGAQSLVSQTAGTLGRAFSYCLPPTPSSSGFLTLGAAGGSGTSGFVKTPMLRSSQVPTFYGVRLQAIRVGGRQLSIPASVFSAGTVMDSGTVITRLPPTAYSALSSAFKAGMKQYPPAQPSGILDTCFDFSGQSSVSIPSVALVFSGGAVVSLDASGIILSNCLAFAGNSDDSSLGIIGNVQQRTFEVLYDVGRGVVGFRAGAC

SEQ ID NO: 1108 - protein, 469 aa, Oryza sativa
MEVLLPLLLACSLLFTIATPIRDITDVCASQISDFQHLNSSGLHLTLHHPQSPCSPAPLPSDLPFSAVVTHDDARIAHLASRLANNHPTSPSSSSLLHGHRKKKAGGVGGSQASSSSVPLTPGASVAVGNYVTRLGLGTPATSYVMVVDTGSSLTWLQCSPCSVSCHRQAGPVFDPRASGTYAAVQCSSSECGELQAATLNPSACSVSNVCIYQASYGDSSYSVGYLSKDTVSFGSGSFPGFYYGCGQDNEGLFGRSAGLIGLAKNKLSLLYQLAPSLGYAFSYCLPTSSAAAGYLSIGSYNPGQYSYTPMASSSLDASLYFVTLSGISVAGAPLAVPPSEYRSLPTIIDSGTVITRLPPNVYTALSRAVAAAMASAAPRAPTYSILDTCFRGSAAGLRVPRVDMAFAGGATLALSPGNVLIDVDDSTTCLAFAPTGGTAIIGNTQQQTFSVVYDVAQSRIGFAAGGCS

SEQ ID NO: 1109 - protein, 346 aa, Glycine max
MTSLSTHHTYSRKQKSLGLLCTNFLSLYNKEGVRLVGLDDAASRLGVERRRIYDIVNVLESVGVLTRKAKNQYTWKGFCAIPAALQELKDEGLKENPGSFDDSNDNAKVSDDEEEEEETFPNINIGSQSEKENPDYTATVKSSKNENRREKSLALLTQNFVKLFVCSNFEMISLDEAAKLLLGNANNRTKVRRLYDIANVLSSMNLIEKTHTTNTRKPAFRWLGVRGKTWGGSVDLAQNSNVKESRKRMFGTDIGNISFKRNKVDLSMDGQNSKMQNQHENISPRAQLEKIIIKKDAKQTSESYQFGPFAPAYVPKVGTSENNSVKKVHDWDSLAQEHRPQYQNQG

SEQ ID NO: 1110 - protein, 1043 aa, Zea mays
MFTPQGKGWTGWSTPTPANQRSGGGAPAASAPLGKGKGRVAELEQELHEYQYNMGLLLIEKKEWAAKFEEISEVLTQKEEILKREQAAHLNAISEYERREENMRKALGVEKQCVADLEKALRDIRAEIAEVKFTSEKKITDAQSLEASLEEKSLEIEGKLHAADAKLAEANRKKSQADRDLEEAEARQRRLEKEKLYFETERKAREKQLKEQEESLQEWEKKLKESQNRLNELQRSINEREERANKNDQLFKIKQDELEEARRTVEAAKVTLKVKEDDINKRLNELHLQEKDADSKRSALEEQGKKLDEREAKVTNREKEGLQKLLEDHQVELESKRRDFELELERERKSFDQNMTQKQADLLKREKDVKSLEAKLSKSEQALNDKKKSMENLQNDLDAKSKALKSWDESLKNDEKRLLKEKQQMDHEREQLETYKLELEKIKSALEAEKEKISEEQNNLKLTAQERQEHSLLIAKLKKEIEEYRMRSNSLSEEMEDLRKQRQKFEEEWEQLDEKRALLVEEDKRLNIERMNLERWRDNEEKRLNDMKLKMDEEYKQQLESLERKEKALSDDMKHKQMENDEFLKGERADVQRKLQLKRHELEMEMEQKQATKEKELEEKENELNKKIDFVENKLRHAIELNESKIEKLLLEKREVQMERELLLEERKKTETDKADIRRDIESLHSLSKSLKERREAYNRDRSRLIELFEKYKACKNCGISIFEGLDSLLLKDSAEIEHPSLAVEGDDHALTTDTSGPDTGTLVNSGGRFSLLQKCSRLFKFSPRKKGEQSSEQPSERNISFGARLEEATQSDGDYVPTPVYEIAHDSFNAEDELPSDGETRENEESERHDIADNAQMESSVGVADNSIDILGTKSFDGANDMAVEATIVSVDQNGEDSVVPAEAGVEPETSEQGRRQQNQRGRRKGGMKRTRSVNAVVEDAKMILGEVFEEKTDDQGDTVKVGATRKRRFAGATISEQDEEGSEAHSESVSLGGQRRKRRQTAGAVTDAPGERRYNLRHSRAANAGAATAQADKKKIFKSKK

SEQ ID NO: 1111 - protein, 436 aa, Oryza sativa
MDSVVRTHIGHMLKMIHFCSMFLITFSDYKIQAILSSQQKRKAPEESDVAESSDCMITSPGFAVSPMLTPVSGKAVKTSKSKTKNNKAGPQTPTSNVGSPLNPPTPVGTCRYDSSLGLLTKKFINLLKQAPDGILDLNNAAETLEVQKRRIYDITNVLEGIGLIEKTLKNRIRWKGLDDSGVELDNGLSALQAEVENLSLKEQALDERISDMREKLRGLTEDENNQRWLYVTEDDIKGLPCFQNETLIAIKAPHGTTLEVPDPDEAGDYLQRRYRIVLRSTMGPIDVYLVSQFDEKFEDLGGGATPSGHANVPKHQPTEVFNTTNAGVGQCSNSVAVDNNIQHSQTIPQDPSASHDFGGMTRIIPSDIDTDADYWLISEGDVSITDMWKTAPDVQWDESLDTDVFLSEDVRTPSSHNQQPSAVGGPQMQVSDMHKP

SEQ ID NO: 1112 - protein, 157 aa, Saccharomyces cerevisiae
MSDEEHTFENADAGASATYPMQCSALRKNGFVVIKGRPCKIVDMSTSKTGKHGHAKVHLVTLDIFTGKKLEDLSPSTHNLEVPFVKRSEYQLLDIDDGYLSLMTMDGETKDDVKAPEGELGDSMQAAFDEGKDLMVTIISAMGEEAAISFKEAPRSD

SEQ ID NO: 1113 - protein, 387 aa, Saccharomyces cerevisiae
MSDINEKLPELLQDAVLKASVPIPDDFVKVQGIDYSKPEATNMRATDLIEAMKTMGFQASSVGTACEIIDSMRSWRGKHIDELDDHEKKGCFDEEGYQKTTIFMGYTSNLISSGVRETLRYLVQHKMVDAVVTSAGGVEEDLIKCLAPTYLGEFALKGKSLRDQGMNRIGNLLVPNDNYCKFEEWIVPILDKMLEEQDEYVKKHGADCLEANQDVDSPIWTPSKMIDRFGKEINDESSVLYWAHKNKIPIFCPSLTDGSIGDMLFFHTFKASPKQLRVDIVGDIRKINSMSMAAYRAGMIILGGGLIKHHIANACLMRNGADYAVYINTGQEYDGSDAGARPDEAVSWGKIKAEAKSVKLFADVTTVLPLIVAATFASGKPIKKVKN

SEQ ID NO: 1114 - protein, 297 aa, Saccharomyces cerevisiae
MAFQKDAKSSAYSSRFQTPFRRRREGKTDYYQRKRLVTQHKAKYNTPKYRLVVRFTNKDIICQIISSTITGDVVLAAAYSHELPRYGITHGLTNWAAAYATGLLIARRTLQRLGLDETYKGVEEVEGEYELTEAVEDGPRPFKVFLDIGLQRTTTGARVFGALKGASDGGLYVPHSENRFPGWDFETEEIDPELLRSYIFGGHVSQYMEELADDDEERFSELFKGYLADDIDADSLEDIYTSAHEAIRADPAFKPTEKKFTKEQYAAESKKYRQTKLSKEERAARVAAKIAALAGQQ

SEQ ID NO: 1115 - protein, 466 aa, Saccharomyces cerevisiae
MSSTQVGNALSSSTTTLVDLSNSTVTQKKQYYKDGETLHNLLLELKNNQDLELLPHEQAHPKIFQALKARIGRINNETCDPGEENSFFICDLGEVKRLFNNWVKELPRIKPFYAVKCNPDTKVLSLLAELGVNFDCASKVEIDRVLSMNISPDRIVYANPCKVASFIRYAASKNVMKSTFDNVEELHKIKKFHPESQLLLRIATDDSTAQCRLSTKYGCEMENVDVLLKAIKELGLNLAGVSFHVGSGASDFTSLYKAVRDARTVFDKAANEYGLPPLKILDVGGGFQFESFKESTAVLRLALEEFFPVGCGVDIIAEPGRYFVATAFTLASHVIAKRKLSENEAMIYTNDGVYGNMNCILFDHQEPHPRTLYHNLEFHYDDFESTTAVLDSINKTRSEYPYKVSIWGPTCDGLDCIAKEYYMKHDVIVGDWFYFPALGAYTSSAATQFNGFEQTADIVYIDSELD

SEQ ID NO: 1116 - protein, 799 aa, Oryza sativa
MSSMESLAQLELLCEKLYNSRDSAERAHAESTLKCFSENSDYISQCQYILDNASTPYALMLASSSLLNQVNDRSLSLQLRLDILNYVINYLAMRGPKLQTFVIKSLIQLVCRITKFGWFDDDKFRDIVKEAADFLSLASQDHYFIGLKILYHLVGEMNQANAMPLTLHRKIACSFKDQFLLQIFQISLTSLHQLKSEVPDDFRRDPLSLALRCLSFDFVGCPVDESSEEFGTVQLPASWRPLLQDPSTVQIFFDYYKVNDTCVSKEKECLFKAKYFLQERSRLPAPGDANELSVIEGQLTWLVHIIEAILKIRQTIGCSQESQELIDAELAARVLQLINVTDTGVHAQRYRVLSKQRLGRAILIFVQNFRRSYVGDQAMHSSKQLYARLSELLGLNDHLVLLNAIVGKIATNLKCYAENVAISGPVQIVAVNLEATADAAFWTDVVKYAFIGLMRDLRGIAMATNRTYGLLFDWLYPSRMPLLLKAISLCADEPEVTTPLLKFMCEFVLNKAQRLTFDSSSPNGILLFQEVSKLIVAYGSRILLLPNGTDIYGSKYKGIWISLAVLSRALCGNYVNFGVFELYGDRALADALDISLKMSLSVPLSDILAFKKLSKAFYGYIEVLFSSHITFVLNLDTNTFVHIVSTLESGLKGLDTGISTQCASAIDSLAAFYFNNITAADGPPSPAALNLARHIGEFPTLFPQILKTLFEIIIFEDAGNQWSLSRPILSLIMISEQMFSNLRAQILASQPVDQQQRLSQCFEKLMSDVARNLEPKNRDKFTKNLTTFRHDFRVKNIQA

SEQ ID NO: 1117 - protein, 396 aa, Saccharomyces cerevisiae
MTVTIKELTNHNYIDHELSATLDSTDAFEGPEKLLEIWFFPHKKSITTEKTLRNIGMDRWIEILKLVKCEVLSMKKTKELDAFLLSESSLFVFDHKLTMKTCGTTTTLFCLEKLFQIVEQELSWAFRTTQGGKYKPFKVFYSRRCFLFPCKQAAIHQNWADEVDYLNKFFDNGKSYSVGRNDKSNHWNLYVTETDRSTPKGKEYIEDDDETFEVLMTELDPECASKFVCGPEASTTALVEPNEDKGHNLGYQMTKNTRLDEIYVNSAQDSDLSFHHDAFAFTPCGYSSNMILAEKYYYTLHVTPEKGWSYASFESNIPVFDISQGKQDNLDVLLHILNVFQPREFSMTFFTKNYQNQSFQKLLSINESLPDYIKLDKIVYDLDDYHLFYMKLQKKI

SEQ ID NO: 1118 - protein, 366 aa, Zea mays
MAVLSAAGAPPASAIGFEGYEKRLEITFSEAPVFVDPHGSGLRALSRSQIDSVLDLARKIVIKTCGTTKLLLTIPRILELAEELSMPLAAVKYSRGTFIFPGAQPAPHRSFSEEVAVLNRYFGGLKSGGNAYVIGDAARPGQKWHIYYATEYPEQPMVNLEMCMTGLDTKKASVFFKTNADGNTTCAKEMTKLSGISEIIPEMEICDFDFEPCGYSMNAIHGSAFSTIHVTPEDGFSYASYEVMGLDATALSYGDLVKRVLGCFGPSEFSVAVTIFGGRGQAGTWGKELGAEAYDCNNMVEQELPGGGILIYQSFCAAEDAVASSPKSVLRCFDGENAAPFAKDCKLANLVCLEEVGCYRGEGWSA

SEQ ID NO: 1119 - protein, 400 aa, Zea mays
MAVLSAADASPVSAIGFEGYEKRLEITFSEAPVFVDPHGRGLRALSRAQIDSVLDLARCTIVSELSNKDFDSYVLSESSLFIYPLKIVIKTCGTTKLLLTIPRILELAEELSMPLAAVKYSRGTFIFPGAQPAPHRSFSEEVAALNRYFGGLKSGGNAYVIGDPARPGQKWHVFYATEYPEQPMVNLEMCMTGLDKKKACVFFKTNADGNTTCAKEMTKLSGISEIIPEMEICDFDFEPCGYSMNAIHGSAFSTIHVTPEDGFSYASYEVMGLDATALSYGDLVKRVLRCFGPSEFSVAVTIFGGRGHAGTWGKALGAEVYDCNNMVEQELPGGGLLVYQSFCAAEDAVATSPKSVFHCFDGENVESAPPPMKKDYKLANLLCWEEEADAMEEKAGVLDE

SEQ ID NO: 1120 - protein, 368 aa, Glycine max
MGEAKGKEEEVLASVHSTVFKESESLDGKCVKIEGYDFNRGVNYPLLLSSMVTTGFQASNLGDAIQVVNQMLDWRLVDEPVAEDCSDQERDLEYRKSVTCKVFLGFTSNLISSGVRDTVRFLLQHRMVDVVVTTTGGIEEDLIKCLAPTYKGDFSLPGAYLRSKGLNRIGNLLVPNDNYCKFEDWIIPIFDQMLGEQNNENVLWTPSKLIARLGKEIKNESSYLYWAYKNNIPVFCPGLTDGSLGDMLYFHSFRNPGLIVDIVQDIRAMNGEAVHASPRKTGMIILGGGLPKHHICNANMMRNGADYAVFINTAQEYDGSDSGARPDEAVSWGKIRDSAQTVKVHCDATIAFPLLVAETFASKVKPPH

SEQ ID NO: 1121 - protein, 370 aa, Zea mays
MAAGAGGGELEALEGVRSIVLKPSESLDESRFTRIAGADFNDPAIGLQGLLASLASTGFQASNLGDAIDVVNQMLDWRLSHEKPSEDCDEAELDPKYRASVKCKIFLGFTSNLVSSGIRDIIRFLAQHHMVDVIVTSAGGIEEDLIKCLAPTYRGDFSLPGALLRSKGLNRIGNLLVPNDNYCKFENWIMPLFDQMLQEQSTENVWTPSKVIARLGKEINDESSYLYWAYKNNIPVYCPALTDGSLGDMLFCHAVRNPGLIIDIVQDIRLMNGEAIHATPRKTGIIVLGGGLPKHHICNANMFRNGADYAVYINTAQEFDGSDSGAHPDEAVSWGKIKGSAKPVKVHCDASIAFPLLVAATFARKVHNSK

SEQ ID NO: 1122 - protein, 160 aa, Zea mays
MSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPK

SEQ ID NO: 1123 - protein, 302 aa, Zea mays
MGGFVKTHKTNAYFKRFQVKFKRRRAGKTDYRARIRLINQDKNKYNTPKYRFVVRFTNKDITAQIISASIAGDMVLASAYSHELPRYGLEVGLTNYAAAYCTGLLLARRVLKTRGLDKEYEGNVEATGEDFSVEPADERRPFRALLDVGLIRTTTGNRVFGALKGALDGGLDIPHSEKRFAGFKKDDKQLDADIHRKYIYGGHVADYMRNLAEEEPEKYQSHFSEYIKKGIEADDMEALYKKVHAAIRADPSVVKSTKQPPKEHKRYNPKKLTYEQRKASLIERLNQLNSSGGADDDDEDDE

SEQ ID NO: 1124 - protein, 304 aa, Oryza sativa
MGGFVKTQKTHAYFKRFQVKFKRRRQGKTDYRARIRLTNQDKNKYNTPKYRFVVRFTNKDITAQIVYATIAGDIVMAAAYSHELPRYGLEVGLTNYAAAYCTGLLLARRVLTLRGLDQEYEGNVEATGEDYYVEPADERRPFRALLDVGLIRTTTGNRVFGALKGALDGGLDIPHSDKRFAGFKKDEKQLDSDIHRKYIYGGHVADYMRSMAEEEPEKFQAHFSEYLKKGIDADGMESLYKKVHAAIRADPTMAKSTKKEPATHKRYNLKKLTYEQRKASLVERLNALNSSAGADDDDEEEDDE

SEQ ID NO: 1125 - protein, 302 aa, Zea mays; identical to SEQ ID NO: 1123

SEQ ID NO: 1126 - protein, 288 aa, Zea mays
MGFVKLIKTKAYFKRYQVKFRRRREGKTDYRQRTRLITQDKNKYNTPKYRLVVRKTNKNIIAQIIYATVQGDRVVNAAYSSELPKFGIKLGLTNYASAYATGLLVARRHLTKIGLASKYQGKVEADGNDYTVEPAEGPRPFKALLDIGLARTSTGARIFAVAKGALDGGINIPHSVKRFAGYNAETKKHNPEVLKKYIYGQHVAEYMKKLQKEEPQAYEKQFSRFVKAGVKAGDIEGIYKNAHKAIRADPTKKANEKKAVEHKRYNPKRLTHAQRAERVAKKKAILGL

SEQ ID NO: 1127 - protein, 512 aa, Agrobacterium tumefaciens
MLPKVARAHVCPPSPRCGEDLGKVPGTNPSSRYSGQPGNARTYEATTVRAFLVLCRLSISRGTEEAHHHCLKCGRVIPSNRWQTKPNDALAGHRSHSRLERMLSILRLHRLIRMHISSVLCPPDSAGVGFIGNISMTTARILDFIKTRRPEGPCLVVDLDVVRDNFNAFRHSLPNSAIYYAVKANPAPEILKLLASLGSNFDCASVAEIQMALDAGATSDRISFGNTIKKERDVARAHALGIDLFAVDSHEEVEKVARAAPGARVFCRVLTDGEGAEWPLSRKFGCVPQMAVDVLVYAHQMGLESYGVSFHVGSQMMNLDAWDAALADAKRVFASLAKQGIHLQMVNMGGGFPTKYLRDVPAAEEYGQAIDTALRKHFGNQIPKTIIEPGRGMVGNAGVIKAEVVLVSKKSDNDNHRWVFLDIGKFGGLAETMDEAIRYPIRTERDQDEMQPCVLAGPTCDSADVLYEKNMYPLPVSLTIGDEVLIEGTGAYTTTYSAVAFNGFEPLKAYVI

SEQ ID NO: 1128 - protein, 140 aa, Oryza sativa
MRKYRVAGLVAALLVLHSLATPSAQAEAHRAGGEGEEKMSSDGGPVLGGVEPVGNENDLHLVDLARFAVTEHNKKANSLLEFEKLVSVKQQVVAGTLYYFTIEVKEGDAKKLYEAKVWEKPWMDFKELQEFKPVDASANA

SEQ ID NO: 1129 - protein, 250 aa, Oryza sativa
MRVAATTRPASSSAAAPLPLFLLLAVAAAAAALFLVGSASLAMAGHVLGGAHDAPSAANSVETDALARFAVDEHNKRENALLEFVRVVEAKEQVVAGTLHHLTLEALEAGRKKVYEAKVWVKPWLDFKELQEFRNTGDATTFTNADLGAKKGGHEPGWRDVPVHDPVVKDAADHAVKSIQQRSNSLFPYELLEIVRAKAEVVEDFVKFDILMKLKRGNKEEKFKAEVHKNLEGAFVLNQMQQEHDESSSQ

SEQ ID NO: 1130 - protein, 109 aa, Sorghum bicolor
MAEAHSGRRVGMVGDVRDAPEGHENDLEAIELARFAVDEHNSKTNAMLEFERLVKVRHQVVAGTMHHFTVQVKEAGGGKKLYEAKVWEKVWENFKQLQSFQPVGDAAVA

SEQ ID NO: 1131 - protein, 983 aa, Zea mays
MMESAAAQSCAACGDDARAACRACSYALCRACLDEDAAEGRTTCARCGGDYAAINPARASEGTEAEEEVVENHHTAGGLRERVTMGSHLNDRQDEVSHARTMSSLSGIGSELNDESGKPIWKNRVESWKEKKNEKKASAKKTAAKAQPPPVEEQIMDEKDLTDAYEPLSRVIPISKNKLTPYRAVIIMRLIVLGLFFHYRITNPVNSAFGLWMTSVICEIWFGFSWILDQFPKWYPINRETYVDRLIARYGDGEESGLAPVDFFVSTVDPLKEPPLITANTVLSILAVDYPVEKISCYVSDDGSAMLTFESLAETAEYARKWVPFCKKYAIEPRAPEFYFSQKIDYLKDKIHPSFVKERRAMKRDYEEYKVRINALVAKAQKTPDEGWIMQDGTPWPGNNPRDHPGMIQVFLGETGARDFDGNELPRLVYVSREKRPGYQHHKKAGAMNALVRVSAVLTNAPYILNLDCDHYVNNSKAVREAMCFMMDPTVGRDVCYVQFPQRFDGIDRSDRYANRNVVFFDVNMKGLDGLQGPVYVGTGCCFNRQALYGYGPPSLPALPKSSICSWCCCCCPKKKVERSEREINRDSRREDLESAIFNLREIDNYDEYERSMLISQMSFEKSFGLSSVFIESTLMENGGVPESANPSTLIKEAIHVISCGYEEKTEWGKEIGWIYGSVTEDILTGFKMHCRGWRSIYCMPVRPAFKGSAPINLSDRLHQVLRWALGSVEIFFSRHCPLWYGYGGGRLKWLQRLSYINTIVYPFTSLPLVAYCCLPAICLLTGKFIIPTLSNAATIWFLGLFMSIIVTSVLELRWSGIGIEDWWRNEQFWVIGGVSAHLFAVFQGILKMIAGLDTNFTVTAKATDDTEFGELYLFKWTTVLIPPTSILVLNLVGVVAGFSAALNSGYESWGPLFGKVFFAMWVIMHLYPFLKGLMGRQNRTPTIVVLWSVLLASVFSLLWVKIDPFVGGTETVNTNNCNTIIC

SEQ ID NO: 1132 - protein, 453 aa, Glycine max
MATWVLSECSLKPLAPVIPRPRTGAVLSSTSKVGFLETNKVLEGSKFQPLRCNLRERNWGLKVSVPLRIASIEEEEQKSVDVINGSNGVEHEKLPEFDPGAPPPFNLADIRAAIPKHCWVKDPLKSMSYVVRDVIAVFGLASAAAYLNNWLVWPLYWAAQGTMFWALFVLGHDCGHGSFSNNPKLNSVVGHLLHSSILVPYHGWRISHRTHHQHHGHVENDESWHPLPEKLFRSLDTVTRMLRFTAPFPLLAYPVYLWGRSPGKTGSHFDPSSDLFVPNERKDVITSTACWAAMLGLLVGLGFVMGPIQLLKLYGVPYVIFVMWLDLVTYLHHHGHEDKLPWYRGKEWSYLRGGLTTLDRDYGLINNIHHDIGTHVIHHLFPQIPHYHLVEATEAAKPVFGKYYREPKKSSPLPFHLIGELIKSFKTDHFVSDKGDVVYYQTDSEINGSSKSE

SEQ ID NO: 1133 - protein, 446 aa, Arabidopsis thaliana
MANLVLSECGIRPLPRIYTTPRSNFLSNNNKFRPSLSSSSYKTSSSPLSFGLNSRDGFTRNWALNVSTPLTTPIFEESPLEEDNKQRFDPGAPPPFNLADIRAAIPKHCWVKNPWKSLSYVVRDVAIVFALAAGAAYLNNWIVWPLYWLAQGTMFWALFVLGHDCGHGSFSNDPKLNSVVGHLLHSSILVPYHGWRISHRTHHQNHGHVENDESWHPMSEKIYNTLDKPTRFFRFTLPLVMLAYPFYLWARSPGKKGSHYHPDSDLFLPKERKDVLTSTACWTAMAALLVCLNFTIGPIQMLKLYGIPYWINVMWLDFVTYLHHHGHEDKLPWYRGKEWSYLRGGLTTLDRDYGLINNIHHDIGTHVIHHLFPQIPHYHLVEATEAAKPVLGKYYREPDKSGPLPLHLLEILAKSIKEDHYVSDEGEVVYYKADPNLYGEVKVRAD

SEQ ID NO: 1134 - protein, 435 aa, Arabidopsis thaliana
MASSVLSECGFRPLPRFYPKHTTSFASNPKPTFKFNPPLKPPSSLLNSRYGFYSKTRNWALNVATPLTTLQSPSEEDTERFDPGAPPPFNLADIRAAIPKHCWVKNPWMSMSYVVRDVAIVFGLAAVAAYFNNWLLWPLYWFAQGTMFWALFVLGHDCGHGSFSNDPRLNSVAGHLLHSSILVPYHGWRISHRTHHQNHGHVENDESWHPLPESIYKNLEKTTQMFRFTLPFPMLAYPFYLWNRSPGKQGSHYHPDSDLFLPKEKKDVLTSTACWTAMAALLVCLNFVMGPIQMLKLYGIPYWIFVMWLDFVTYLHHHGHEDKLPWYRGKEWSYLRGGLTTLDRDYGWINNIHHDIGTHVIHHLFPQIPHYHLVEATEAAKPVLGKYYREPKNSGPLPLHLLGSLIKSMKQDHFVSDTGDVVYYEADPKLNGQRT

SEQ ID NO: 1135 - protein, 359 aa, Synechocystis sp. PCC 6803
MRLEISSPQTKLPYPKTEELPFTLQELRNAIPADCFEPSVVRSLGYFFLDVGLIAGFYALAAYLDSWFFYPIFWLIQGTLFWSLFVVGHDCGHGSFSKSKTLNNWIGHLSHTPILVPYHGWRISHRTHHANTGNIDTDESWYPVSEQKYNQMAWYEKLLRFYLPLIAYPIYLFRRSPNRQGSHFMPGSPLFRPGEKAAVLTSTFALAAFVGFLGFLTWQFGWLFLLKFYVAPYLVFVVWLDLVTFLHHTEDNIPWYRGDDWYFLKGALSTIDRDYGFINPIHHDIGTHVAHHIFSNMPHYKLRRATEAIKPILGEYYRYSDEPIWQAFFKSYWACHFVPNQGSGVYYQSPSNGGYQKKP

SEQ ID NO: 1136 - protein, 252 aa, Zea mays
MMLRVSASPAAAVANHLSGGAAATTAPARVTAQRSGVSLSAAAAAGKGKEVLSGVVFQPFEEIKGELALVPQSPDRSLARHKFVDDCEAAINEQINVEYNASYAYHSLFAYFDRDNVALKGFAKFFKESSDEEREHAEKLMEYQNKRGGRVRLQSIVAPLTEFDHPEKGDALYAMELTLALEKLVNEKLHSLHGVATRCNDPQLIDFIESEFLEEQVEAINKVSKYVAQLRRVGNKGHGVWHFDQMLLQEGA

SEQ ID NO: 1137 - protein, 254 aa, Zea mays
MMLRVSPSPAAAVPTQLSGAPATPAPVVRVAAPRGVASPSAGAACRAAGKGKEVLSGVVFQPFEEIKGELALVPQSPDKSLARHKFVDDCEAALNEQINVEYNASYAYHSLFAYFDRDNVALKGFAKFFKESSDEEREHAEKLMEYQNKRGGRVRLQSIVTPLTEFDHPEKGDALYAMELALALEKLVNEKLHNLHGVATRCNDPQLTDFIESEFLEEQVEAINKISKYVAQLRRVGKGHGVWHFDQMLLEEEA

SEQ ID NO: 1138 - protein, 165 aa, Escherichia coli
MLKPEMIEKLNEQMNLELYSSLLYQQMSAWCSYHTFEGAAAFLRRHAQEEMTHMQRLFDYLTDTGNLPRINTVESPFAEYSSLDELFQETYKHEQLITQKINELAHAAMTNQDYPTFNFLQWYVSEQHEEEKLFKSIIDKLSLAGKSGEGLYFIDKELSTLDTQN

SEQ ID NO: 1139 - protein, 347 aa, Emericella nidulans
MPSTTSRAAFEAVFPSLAEAMLDHARKYNLPQNAQEWFSKAIHTNVPGGKLNRGLSVPDTGVALLQKELSEEQYKDLATLGWLTELLQAFFLVSDDLMDGSITRRGQPCWYRHQGVGLIAINDAFLLESGIYVILKKQFRSHPAYVDFIELFHETTWQTELGQLCDLITAPEDKVDLNNFSMEKYMFIVTYKTAYYSFYLPVALALHYLQLATPENLRQAHDILIPLGQYFQVQDDYLDAYGDPEVIGKIGTDIQDNKCSWLVNQALQRCSAEQRKVLDAAYGRKDAEQEAKVKAIFRELDLESVYKEYEEKIVGELKTKIAAVNESEGLKKEVFEAFLGKIYKRSK

SEQ ID NO: 1140 - protein, 353 aa, Oryza sativa
MAAAVVANGASGDSSKAAFAEIYSRLKEEMLEDPAFEFTDESLQWIDRMLDYNVLGGKCNRGISVIDSFKMLKGTDVLNKEETFLACTLGWCIEWLQAYFLVLDDIMDNSQTRRGQPCWFRVPQVGLIAVNDGIILRNHISRILQRHFKGKLYYVDLIDLFNEVEFKTASGQLLDLITTHEGEKDLTKYNLTVHRRIVQYKTAYYSFYLPVACALLLSGENLDNFGDVKNILVEMGTYFQVQDDYLDCYGDPEFIGKIGTDIEDYKCSWLVVQALERADENQKHILFENYGKPDPECVAKVKDLYKELNLEAVFHEYERESYNKLIADIEAHPNKAVQNVLKSFLHKIYKRQK

SEQ ID NO: 1141 - protein, 355 aa, Zea mays
MATAEVVVANGSGGADTKTAFKEIYSKLKQEMLEDPAFEFTDESLQWIDRMLDYNVLGGKCNRGLSVVDSYKILKGVDVLSKEETFLACTLGWCIEWLQAYFLVLDDIMDNSQTRRGQPCWFRVPQVGLIAVNDGIILRNHISRILQRHFKGKPYYVDIIDLFNEVEFKTASGQMLDLITTHEGEKDLTKYNLTVHRRIVQYKTAYYSFYLPVACALLLAGENLENFVDVKNILVEMGTYFQVQDDYLDCFGDPEFIGKIGTDIEDYKCSWLVVQALERAAENQKSILFENYGKSDPACVAKVKDLYKELKLEEVFHEYERESYNKLIADIEAQPSKAVQTVLKSFLHKIYKRDK

SEQ ID NO: 1142 - protein, 266 aa, Arabidopsis thaliana
MTADSQSDYAFLESIRRHLLGESEPILSESTASSVTQSCVTGQSIKPVYGRNPSFSKLYPCFTESWGDLPLKENDSEDMLVYGILNDAFHGGWEPSSSSSDEDRSSFPSVKIETPESFAAVDSVPVKKEKTSPVSAAVTAAKGKHYRGVRQRPWGKFAAEIRDPAKNGARVWLGTFETAEDAALAYDRAAFRMRGSRALLNFPLRVNSGEPDPVRIKSKRSSFSSSNENGAPKKRRTVAAGGGMDKGLTVKCEVVEVARGDRLLVL

SEQ ID NO: 1143 - protein, 241 aa, Arabidopsis thaliana
MASSSSSSYRFQSGSYPLSSSPSLGNFVERIKDACHFLVSAVLGTIISAILTFFFALVGTLLGALTGALIGQETESGFIRGAAIGAISGAVFSIEVFESSLDLWKSDESGFGCFLYLIDVIVSLLSGRLVRERIGPAMLSAVQSQMGAVDTAFDDHTSLFDTGGSKGLTGDLVEKIPKMTITGNNNTDASENTDSCSVCLQDFQLGETVRSLPHCHHMFHLPCIDNWLLRHGSCPMCRRDI

SEQ ID NO: 1144 - protein, 271 aa, Triticum sp.
MLLLNPASEAAAAALDSIRQQLLEEPMAPARPAYCRSASFGSLVADQWSESLPFRPNDADDMVVYGALRDAFSCGWLPDGSFAAVKPEPLPSPDSYDGCCLGSFLASPPGLDAPWAEEAEVAATASRGKHFRGVRQRPWGKFAAEIRDPAKNGARVWLGTFDSAEDAAVAYDRAAYRMRGSRALLNFPLRIGSEIAAAAGQKRPSPQPASPDSPPPSSSAPGSSKRRKRGEAAAESMSMALVPPPPVQAPVQLTLPVQPWLATGAVQQLVS

SEQ ID NO: 1145 - protein, 348 aa, Arabidopsis thaliana
MASEDWDLFAVVRSCSSSVSTTNSCAGHEDDIGNCKQQQDPPPPPLFQASSSCNELQDSCKPFLPVTTTTTTTWSPPPLLPPPKASSPSPNILLKQEQVLLESQDQKPPLSVRVFPPSTSSSVFVFRGQRDQLLQQQSQPPLRSRKRKNQQKRTICHVTQENLSSDLWAWRKYGQKPIKGSPYPRNYYRCSSSKGCLARKQVERSNLDPNIFIVTYTGEHTHPRPTHRNSLAGSTRNKSQPVNPVPKPDTSPLSDTVKEEIHLSPTTPLKGNDDVQETNGDEDMVGQEVNMEEEEEEEEVEEDDEEEEDDDDVDDLLIPNLAVRDRDDLFFAGSFPSWSAGSAGDGGG

SEQ ID NO: 1146 - protein, 249 aa, Arabidopsis thaliana
MACGGAIISDYAPLVTKAKGRKLTAEELWSELDASAADDFWGFYSTSKLHPTNQVNVKEEAVKKEQATEPGKRRKRKNVYRGIRKRPWGKWAAEIRDPRKGVRVWLGTFNTAEEAAMAYDVAAKQIRGDKAKLNFPDLHHPPPPNYTPPPSSPRSTDQPPAKKVCVVSQSESELSQPSFPVECIGFGNGDEFQNLSYGFEPDYDLKQQISSLESFLELDGNTAEQPSQLDESVSEVDMWMLDDVIASYE

SEQ ID NO: 1147 - protein, 251 aa, Glycine max
MYGRSDSYESDLALLDSIRRHLLGESELIFGAPNFGSGRSSSFSSLDSCLSDDWGELPFKEDDSEDMVLYGVLRDAVNVGWVPSLDAGSPESVSSGFPAVKLEPDVMPALINPCPPPAPAVEEKKVVPPKGKHYRGVRQRPWGKFAAEIPDPAKNGARVWLGTFETAEDAALAYDRAAYRMRGSRALLNFPLRVNSGEPDPVRVTSKRSSSPESMAAAAPKRKKVMVVGTVQEQVGSQVVECTRGEQLLVS

SEQ ID NO: 1148 - protein, 585 aa, Saccharomyces cerevisiae
MLHRHGSKQKNFENIAGKVVHDLAGLQLLSNDVQKSAVQSGHQGSNNMRDTSSQGMANKYSVPKKGLPADLSYQLIHNELTLDGNPHLNLASFVNTFTTDQARKLIDENLTKNLADNDEYPQLIELTQRCISMLAQLWHANPDEEPIGCATTGSSEAIMLGGLAMKKRWEHRMKNAGKDASKPNIIMSSACQVALEKFTRYFEVECRLVPVSHRSHHMLDPESLWDYVDENTIGCFVILGTTYTGHLENVEKVADVLSQIEAKHPDWSNTDIPIHADGASGGFIIPFGFEKEHMKAYGMERWGFNHPRVVSMNTSGHKFGLTTPGLGWVLWRDESLLADELRFKLKYLGGVEETFGLNFSRPGFQVVHQYFNFVSLGHSGYRTQFQNSLFVARAFSFELLNSSKLPGCFEIVSSIHESIENDSAPKSVKDYWEHPQAYKPGVPLVAFKLSKKFHEEYPEVPQAILSSLLRGRGWIIPNYPLPKATDGSDEKEVLRVVFRSEMKLDLAQLLIVDIESILTKLIHSYEKVCHHIELASEQTPERKSSFIYEMLLALASPQDDIPTPDEIEKKNKLKETTTRNYRGTC

SEQ ID NO: 1149 - protein, 492 aa, Oryza sativa
MVLSHGVSGSDESVHSTFASRYVRTSLPRFRMPEQSIPKEAAYQIINDELMLDGNPRLNLASFVTTWMEPECDKLIQASVNKNYVDMDEYPVTTELQNRCVNMIAHLFNAPLGDSETAVGVGTVGSSEAIMLAGLAFKRRWQNKMKAAGKPCDKPNIVTGANVQVCWEKFARYFEVELKEVKLSDGYYVMDPAKAVDMVDENTICVAAILGSTLNGEFEDVKLLNDLLTKKNAETGWDTPIHVDAASGGFIAPFLYPELEWDFRLPLVKSINVSGHKYGLVYAGIGWCIWRSKEDLPEELIFHINYLGADQPTFTLNFSKGSSQVIAQYYQLIRLGFEGYKNIMENCQENAMVLKQGLEKTGRFNIVSKDNGVPLVAFSLKDSARHNEFEISDFLRRFGWIVPAYTMPPDAQHVTVLRVVIREDFSRTLAERLVLDVEKVLHELDALPARVVANGGDAAAASASEREMEKQREVISLWKRAVLAKKKTNGVC

SEQ ID NO: 1150 - protein, 497 aa, Zea mays
MVLSHASSGRDDDDAVASTFASRYVRERLPRYRMPERSIPREAAQQIISDELMLDGNPRLNLASFVTTWMEPECDKLIMDSINKNYVDMDEYPVTTELQNRCVNMIAHLFNAPIKEDETAIGVGTVGSSEAIMLAGLAFKRKWQNKRKEQGKPCDRPNIVTGANVQVCWEKFARYFEVELKEVKLSEGYYVMDPVKAVEMVDENTICVAAILGSTLTGEFEDVKQLNDLLTEKNKETGWDVPIHVDAASGGFIAPFLYPELEWDFRLPLVKSINVSGHKYGLVYPGVGWVIWRSKDDLPEELIFHINYLGTDQPTFTLNFSKGSCQIIAQYYQLIRLGFEGYRNIMENCQENAAILREGIAATGRFDVLSKDAGVPLVAFSLRDSSRFSVFDVSENLRRFGWIVPAYTMPADAEHVAVLRVVVREDFSRSLAERLVSDVRKILRELDARATHAVRVATATAEQSGDGVVAKKSVLEIEREVAARWMNAVNKKKTGVC

SEQ ID NO: 1151 - protein, 332 aa, Oryza sativa
MSSRMAGSAILRHVGGVRLFTASATSPAAAAAAAARPFLAGGEAVPGVWGLRLMSTSSVASTEAAAKAEAKKADAEKEVVVNSYWGIEQSKKLVREDGTEWKWSCFRPWETYTADTSIDLTKHHVPKTLLDKIAYWTVKSLRFPTDIFFQRRYGCRAMMLETVAAVPGMVGGMLLHLRSLRRFEQSGGWIRTLLEEAENERMHLMTFMEVANPKWYERALVITVQGVFFNAYFLGYLLSPKFAHRVVGYLEEEAIHSYTEFLKDLEAGKIDNVPAPAIAIDYWRLPANATLKDVVTVVRADEAHHRDVNHFASDIHYQGMELKQTPAPIGYH

SEQ ID NO: 1152 - protein, 351 aa, Emericella nidulans
MSTTGPIRVAAIPKHYLQFTVRTYTRSMASAGLRYSNPPLVKKCYDQPTGKRFISSTPQSQIKDYFPPPDAPKIVEVKTAWAHPVYSEEEMRAVTVGHREAKNWSDWVALGSVRLLRWGMDLVTGYKHPAPGQEDIKKFQMTEKEWLRRFVFLESVAGVPGMVGGMLRHLRSLRRMKRDNGWIETLLEEAYNERMHLLTFLKMAEPGWFMRLMVLGAQGVFFNGFFLSYLISPRTCHRFVGYLEEEAVLTYTRAIKDLESGRLPHWEKLEAPEIAVKYWKMPEGNRTMKDLLLYVRADEAKHREVNHTLGNLKQAVDVNPFAVEWKDPSKPHPGKGIKHLKTTGWEREEVV

SEQ ID NO: 1153 - protein, 207 aa, Arabidopsis thaliana
MRGVSELEVGKSNLPAESELELGLGLSLGGGAWKERGRILTAKDFPSVGSKRSAESSSHQGASPPRSSQVVGWPPIGLHRMNSLVNNQAMKAARAEEGDGEKKVVKNGELKDVSMKVNPKVQGLGFVKVNMDGVGIGRKVDMRAHSSYENLAQTLEEMFFGMTGTTCRETVKPLRLLDGSSDFVLTYEDKGIGCLLEMFHGECLSTR

SEQ ID NO: 1154 - protein, 833 aa, Saccharomyces cerevisiae
MNNAANTGTTNESNVSDAPRIEPLPSLNDDDIEKILQPNDIFTTDRTDASTTSSTAIEDIINPSLDPQSAASPVPSSSFFHDSRKPSTSTHLVRRGTPLGIYQTNLYGHNSRENTNPNSTLLSSKLLAHPPVPYGQNPDLLQHAVYRAQPSSGTTNAQPRQTTRRYQSHKSRPAFVNKLWSMLNDDSNTKLIQWAEDGKSFIVTNREEFVHQILPKYFKHSNFASFVRQLNMYGWHKVQDVKSGSIQSSSDDKWQFENENFIRGREDLLEKIIRQKGSSNNHNSPSGNGNPANGSNIPLDNAAGSNNSNNNISSSNSFFNNGHLLQGKTLRLMNEANLGDKNDVTAILGELEQIKYNQIAISKDLLRINKDNELLWQENMMARERHRTQQQALEKMFRFLTSIVPHLDPKMIMDGLGDPKVNNEKLNSANNIGLNRDNTGTIDELKSNDSFINDDRNSFTNATTNARNNMSPNNDDNSIDTASTNTTNRKKNIDENIKNNNDIINDIIFNTNLANNLSNYNFNNNAGSPIRPYKQRYLLKNRANSSTSSENPSLTPLISNLIMTAKFQKFLLMTKKKKKPDFRPFTSRDPNNQTSENTFDPNRFTMLSDDDLKKDSHTNDNKHNESDLFWDNVHRNIDEQDARLQNLENMVHILSPGYPNKSFNNKTSSTNTNSNMESAVNVNSPGFNLQDYLTGESNSPNSVHSVPSNGSGSTPLPMPNDNDTEHASTSVNQGENGSGLTPFLTVDDHTLNDNNTSEGSTRVSPDIKFSATENTKVSDNLPSFNDHSYSTQADTAPENAKKRFVEEIPEPAIVEIQDPTEYNDHRLPKRVKK

SEQ ID NO: 1155 - protein, 912 aa, Zea mays
MNPDNFTHKTNEAIVGAHEIAVEAGHAQLTPLHLAAVLAADKGGILRQAITGASGGDGAAGDSFERVLNNSLKKLPSQSPPPDSVPASTALIKVIRRAQSAQKKRGDSHLAVDQLLLGLLEDSQISDCLKEAGVSAARVRAELEKLRGGEGRRVESASGDTNFQALKTYGRDLVEQAGKLDPVIGRDEEIRRVVRILSRRTKNNPVLIGEPGVGKTAVVEGLAQRIVRGDVPSNLLDVRLIALDMGALVAGAKYRGEFEERLKAVLKEVEEAEGKVILFIDEIHLVLGAGRTEGSMDAANLFKPMLARGQLRCIGATTLEEYRKYVEKDAAFERRFQQVFVAEPSVPDTVSILRGLKEKYEGHHGVRIQDRALVVAAQLSARYIMGRHLPDKAIDLVDEACANVRVQLDSQPEEIDNLERKRIQLEVELHALEKEKDKASKARLIEVRKELDDLRDKLQPLTMKYRKEKERIDEIRKLKQRREELQFTLQEAERRMDLARVADLKYGALQEIDAAISKLESETGENLMLTETVGPEQIAEVVSRWTGIPVTRLGQNDKERLVGLADRLHQRVVGQTEAVSAVAEAVLRSRAGLGRPQQPTGSFLFLGPTGVGKTELAKALAEQLFDDENLLVRIDMSEYMEQHSVARLIGAPPGYVGHEEGGQLTEQVRRRPYSVILFDEVEKAHVAVFNTLLQVLDDGRLTDGQGRTVDFRNTVIIMTSNLGAEHLLAGMVGKNSMKVARDLVMQEVRRHFRPELLNRLDEIVIFDPLSHEQLRKVARLQMKDVAVRLAERGIALAVTDAALDIILSLSYDPVYGARPIRRWIEKRVVTQLSKMLIQEEIDENCTVYIDAAPGKDELVYRVDRSGGLVNAETGMKSDILIQVPNSSTRSDAAQAVKKMRIMEEDEDGMDEE

SEQ ID NO: 1156 - protein, 908 aa, Saccharomyces cerevisiae
MNDQTQFTERALTILTLAQKLASDHQHPQLQPIHILAAFIETPEDGSVPYLQNLIEKGRYDYDLFKKVVNRNLVRIPQQQPAPAEITPSYALGKVLQDAAKIQKQQKDSFIAQDHILFALFNDSSIQQIFKEAQVDIEAIKQQALELRGNTRIDSRGADTNTPLEYLSKYAIDMTEQARQGKLDPVIGREEEIRSTIRVLARRIKSNPCLIGEPGIGKTAIIEGVAQRIIDDDVPTILQGAKLFSLDLAALTAGAKYKGDFEERFKGVLKEIEESKTLIVLFIDEIHMLMGNGKDDAANILKPALSRGQLKVIGATTNNEYRSIVEKDGAFERRFQKIEVAEPSVRQTVAILRGLQPKYEIHHGVRILDSALVTAAQLAKRYLPYRRLPDSALDLVDISCAGVAVARDSKPEELDSKERQLQLIQVEIKALERDEDADSTTKDRLKLARQKEASLQEELEPLRQRYNEEKHGHEELTQAKKKLDELENKALDAERRYDTATAADLRYFAIPDIKKQIEKLEDQVAEEERRAGANSMIQNVVDSDTISETAARLTGIPVKKLSESENEKLIHMERDLSSEVVGQMDAIKAVSNAVRLSRSGLANPRQPASFLFLGLSGSGKTELAKKVAGFLFNDEDMMIRVDCSELSEKYAVSKLLGTTAGYVGYDEGGFLTNQLQYKPYSVLLFDEVEKAHPDVLTVMLQMLDDGRITSGQGKTIDCSNCIVIMTSNLGAEFINSQQGSKIQESTKNLVMGAVRQHFRPEFLNRISSIVIFNKLSRKAIHKIVDIRLKEIEERFEQNDKHYKLNLTQEAKDFLAKYGYSDDMGARPLNRLIQNEILNKLALRILKNEIKDKETVNVVLKKGKSRDENVPEEAEECLEVLPNHEATIGADTLGDDDNEDSMEIDDDLD

SEQ ID NO: 1157 - protein, 857 aa, Escherichia coli
MRLDRLTNKFQLALADAQSLALGHDNQFIEPLHLMSALLNQEGGSVSPLLTSAGINAGQLRTDINQALNRLPQVEGTGGDVQPSQDLVRVLNLCDNVAQKRGDNFISSELFVLAALESRGTVADILKAAGATTANITQAIEQMRGGESVNDQGAEDQRQALKKYTIDLTERAEQGKLDPVIGRDEEIRRTIQVLQRRTKNNPVLIGEPGVGKTAIVEGLAQRIINGEVPEGLKGRRVLALDMGALVAGAKYRGEFEERLKGVLNDLAKQEGNVILFIDELHTMVGAGKADGAMDAGNMLKPALARGELHCVGATTLDEYRQYIEKDAALERRFQKVFVAEPSVEDTIAILRGLKERYELHHHVQITDPAIVAAATLSHRYIADRQLPDKAIDLIDEAASSIRMQIDSKPEELDRLDRRIIQLKLEQQALMKESDEASKKRLDMLNEELSDKERQYSELEEEWKAEKASLSGTQTIKAELEQAKIAIEQARRVGDLARMSELQYGKIPELEKQLEAATQLEGKTMRLLRNKVTDAEIAEVLARWTGIPVSRMMESEREKLLRMEQELHHRVIGQNEAVDAVSNAIRRSRAGLADPNRPIGSFLFLGPTGVGKTELCKALANFMFDSDEAMVRIDMSEFMEKHSVSRLVGAPPGYVGYEEGGYLTEAVRRRPYSVILLDEVEKAHPDVFNILLQVLDDGRLTDGQGRTVDFRNTVVIMTSNLGSDLIQERFGELDYAHMKELVLGVVSHNFRPEFINRIDEVVVFHPLGEQHIASIAQIQLKRLYKRLEERGYEIHISDEALKLLSENGYDPVYGARPLKRAIQQQIENPLAQQILSGELVPGKVIRLEVNEDRIVAVQ

SEQ ID NO: 1158 - protein, 872 aa, Synechocystis PCC6803
MQPTDPNKFTEKAWEAIAKTPEIAKQHRQQQIETEHLLSALLEQNGLATSIFNKAGASIPRVNDQVNSFIAQQPKLSNPSESIYLGRSLDKLLDNAEIAKSKYGDDYISIEHLMAAYGQDDRLGKNLYREIGLTENKLAEIIKQIRGTQKVTDQNPEGKYESLEKYGRDLTELAREGKLDPVIGRDEEVRRTIQILSRRTKNNPVLIGEPGVGKTAIAEGLAQRIINHDVPESLRDRKLISLDMGALIAGAKYRGEFEERLKAVLKEVTDSQGQIILFIDEIHTVVGAGATQGAMDAGNLLKPMLARGALRCIGATTLDEYRKYIEKDAALERRFQEVLVDEPNVLDTISILRGLKERYEVHHGVKIADSALVAAAMLSNRYISDRFLPDKAIDLVDEAAAKLKMEITSKPEELDEVDRKILQLEMERLSLQRENDSASKERLEKLEKELADFKEEQSKLNGQWQSEKTVIDQIRTVKETIDQVNLEIQQAQRDYDYNKAAELQYGKLTDLQRQVEALETQLAEQQTSGKSLLREEVLESDIAEIISKWTGIPISKLVESEKEKLLHLEDELHSRVIGQDEAVTAVAEAIQRSRAGLSDPNRPTASFIFLGPTGVGKTELAKALAKNLFDTEEALVRIDMSEYMEKHAVSRLMGAPPGYVGYEEGGQLTEAIRRRPYSVILFDEIEKAHGDVFNVMLQILDDGRLTDAQGHVVDFKNTIIIMTSNLGSQYILDVAGDDSRYEEMRSRVMDVMRENFRPEFLNRVDETIIFHGLQKSELRSIVQIQIQSLATRLEEQKLTLKLTDKALDFLAAVGYDPVYGARPLKRAVQKYLETAIAKGILRGDYKPGETIVVDETDERLSFTSLRGDLVIV

SEQ ID NO: 1159 - protein, 861 aa, Xylella fastidiosa
MRMDKLTSRFQNALADAQSLAVGRDHTIIEPVHVFSALLDQQGGSTRPLLMQAGVNVPLLRERLTEILEALPKVSGQTVNVSPSNELSRLFHRTDKLAQQHGDQFMASEWFVLAVVDDSGGLGQALRAAGAEKKKIEAAIDKLRGGETVQTENAEEQRQALEKYTIDLTARAESGKLDPVIGRDEEIRRTIQVLQRRTKNNPVLIGEPGVGKTAIVEGLAQRIVNGEVPEGLRSKRLLSLDLGALIAGAKFRGEFEERLKGVLNDLAKNEGRVILFIDELHTMVGAGKADGAMDAGNMLKPALARGELHCIGATTLDEYRKYIEKDAALERRFQKVFVGEPTVEDTIAILRGLKEKYALHHGVEITDPAIVAAATLSNRYITDRQLPDKAIDLMDEAASRIRMEIDSKPEELDRLERRLIQLKIQREMLKKEKDEASKQRLADLERDIEVLDREFSDLEEVWRSEKAALQGATKIKESIEQAKLDLEAAQRRQDYAKMSEIQYGVLPALEKQLVAASQAEQHDFTLVQEKVTAEEIAEVVSRWTGIPVSKMLEGERDKLLRMEADLGRRVVGQEEAIKVVSDAVRRSRTGLSDPNRPSGSFLFLGPTGVGKTELCKALAEFLFDSQDAMVRIDMSEFMEKHSVARLIGAPPGYVGYEEGGYLTELVRRRPYSLILLDEVEKAHSDVFNILLQVLDDGRLTDGQGRTVDFRNTVIVMTSNLGSHQIQELSGDDSPEVYTQMKAAVMEVVQAHFRPEFINRLDDIVVFHPLDKAQIKQIARIQLQGLEKRLAESELKLDLDDRALELLGNVGFDPVYGARPLKRAIQSQLENPLAQQILAEAFVSGDTVQVGVDGGKLVFAKV

SEQ ID NO: 1160 - protein, 364 aa, Glycine max
MVKSNENGSGSVSVPPFLKKCYDMVEDRNTDSIIRWSDGGDSFVISDITQFSVTLLPTYFKHNNFSSFIRQLNIYGFRKIDTDCWEFANENFVRGQKHLLKNIRRRKHPHSADQQKALPQQDNCDEPSQEAPYHGLWKEVENLKLDKNSLTQELVKLRQHQESAENKLLLLSDRLQGMEKHQQQMLSFLVMVVQSPGFMVQLLHPKENNWHLAESWNILDQDKQDDKPVASDGMIIKYKPPVGEKLKPVVPLSPGFEKQTEPELSAEGLKDLCVSSEFLKVLLDEKLSPLENHSPFLLPDLPDDGSWEQLFLGSPFMGNIQDSNKESEGHTNGGMEMEPTISETPNENSRTFESMIVEMEKTRE

SEQ ID NO: 1161 - protein, 300 aa, Glycine max
MAPPLEHNGVSTSGDSQRSIPTPFLTKTYQLVDDHTIDDVISWNDSGSSFIVWNTTAFAKDLLPKYFKHNNFSSFVRQLNTYGFRKVVPDRWEFSNEYFRRGEKRLLCEIQRRKILSASPPPAGATATVAVPSPLPLSAIPTAKPIVSPSNSAEEQVLSSNSSPARAPVELLDENERLRKENILLTKELVKMRSLCNNIFNLMSNYANAQADGSSAAAAKRCSGEDAVEEMNPKLFGVAIGKKRAREEEGHGAKYDTALSLHQPFHADVKSEALDLPGRGENKKTPWLNQCHRANQRVCN

SEQ ID NO: 1162 - protein, 380 aa, Zea mays
MASVAELKEKHAAATASVNSLRERLRQRRETLLDTDVARYSKSQGRVPVSFNPTDLVCCRTLQGHSGKVYSLDWTPEKNWIVSASQDGRLIVWNALTSQKTHAIKLHCPWVMACAFAPNGQSVACGGLDSACSIFNLNSQADRDGNMPVSRILTGHKGYVSSCQYVPDQETRLITSSGDQTCVLWDVTTGQRISIFGGEFPSGHTADVQSVSINSSNTNMFVSGSCDTTVRLWDIRIASRAVRTYHGHEDDVNSVKFFPDGHRFGTGSDDGTCRLFDMRTGHQLQVYSREPDRNSNELPTVTSIAFSISGRLLFAGYSNGDCYVWDTLLAEVVLNLGNLQNSHDGRISCLGMSSDGSALCTGSWDKNLKIWAFSGHRKIV

SEQ ID NO: 1163 - protein, 506 aa, Glycine max
MSGGGEEGATLEFTPTWVVAAFCTVIVAISLAAERLLHYGGKFLKAKDQKPLYEALQKIKEELMLLGFISLLLTVTQNGITKICVRPSLTLHMLPCNLHDAPANHESHFQTFFPGTARRLLSGEHSTPESASKIGYCSRKHKVPLLSVEALHHLHIFIFVLAVVHVSFSVLTVVFGGARIRQWKHWEDSIAKQNYETDRVLKPKVTQVHQHDFIRGRFAGFGKDSAIVGWLLSFLKQFYGSVTKSDYVTLRHGFIMTHCRTNPKFNFHKYMIRALEDDFKQVVGISWYLWLFVVIFLLLNINGWHTYFWIAFIPVILLLAVGTKLEHIITQLAHEVAEKHAAIEGDLVVQPSDDHFWFHRPRVVLFLIHFILFQNAFEIAFFFWIWVTYGFDSCIMGQVRYIVPRLVIGVFIQVLCSYSTLPLYAIVTQMGTHYKRAIFNDHLQQNIVGWAQKAKKRKGLKADGNPGQGSSQESANTGIQLGSIFKKATAPGDSSSAPKADGISSV

SEQ ID NO: 1164 - protein, 598 aa, Glycine max
MYSSKFRKLFCSVLFSWLCFGGLAMAAGESSSSSRDLDQTPTWAVAAVCTVFILVSIALEKSLHKVGTWLGQKKKKALLEALEKVKAELMILGFISLLLTFGQSYIVRICIPEKLADNMLPCPYKYKEDKKASDSEEEHRRKLLSYERRYLAADTTSFKCSREGHEPLLSVNGLHQLHILVFFLAVIHVLYSAITMMLGRLKIRGWKAWEAETSTHNYEFANAASRFRLTHETSFVRAHSSFLTRIPIFFYIRCFFRQFYRSVNKTDYLTLRNGFITVHLAPGSKFNFQKYIKRSLEDDFKVVVGVSPILWASVVVYLLINVNGWHTVLWAALIPVVIILAVGTKLQAILANMALEITERHAVVQGMPLVQGSDKYFWFGQPQLVLHLIHFALFQNAFQITYILWIWYSFGLRNCFRTDYKLAVVKVALGILMLCLCSYITLPLYALVTQMGSRMKTAIFDEQTNKALKKWHMAAKKKQGGAVTLGKSSARIMDGSPIGNSSTVHSTGPTLHRFKTTGHSTRSSSTAYEDQDQDHEYESDGVELSPLASQTTSFIVRVDHGDQQQAEHRQDSEGETNSSSEGEFSFVKPDPVEIRTTT

SEQ ID NO: 1165 - protein, 380 aa, Oryza sativa
MGSSCSRSHSLSEAETTKNAKSADIDRRILQETKAEQHIHKLLLLGAGESGKSTIFKQIKLLFQTGFDEAELRSYTSVIHANVYQTIKILYEGAKELSQVESDSSKYVISPDNQEIGEKLSDIDGRLDYPLLNKELVLDVKRLWQDPAIQETYLRGSILQLPDCAQYFMENLVRLAEAGYVPTKEDVLYARVRTNGVVQIQFSPVGENKRGGEVYRLYDVGGQRNERRKWIHLFEGVNAVIFCAAISEYDQMLFEDETKNRMMETKELFDWVLKQRCFEKTSFILFLNKFDICEKKIQKVPLSVCEWFKDYQPIAPGKQEVEHAYEFVKKKFEELYFQSSKPDRVDRVFKIYRTTALDQKLVKKTFKLIDESMRRSREGT

SEQ ID NO: 1166 - protein, 109 aa, Glycine max
MASETASSADEETVVVVSAAAGAGGTDKRGKHRILAELKRLDQESKFLQEELEELEKTENVSTICTELLQNIDTRPDPLLPEVHGPVNLLWDRWFEGPQDPQACRCWIL

SEQ ID NO: 1167 - protein, 509 aa, Zea mays
MAAEQGRSLAETPTWSVATVTTLMVAACFLVERSLSRFAKWLRKTKRKAMLAALEKIREELMLLGVISLLLSQTARFISEICVPSSLFTSRFYICSESDYQDLLRNTDANQTALDKNMFGGQRLHVCGEGHEPFVSYEGLEQLHRFLFILGITHVLYSFVTVVLSMIKIYSWRKWETLAGPIAAEELKARRTKVMRRQSTFVFNNASHPWSKNKILIWMLCFLRQFKGSIIRSDYLALRLGFVTYHKLPHSYDFHKYMVRSMEDDYNGTIGISWPLWAYAIVCILINVHGINIYFWLSFVPVILVLLVGTELQHVIAQLALEVAEATAPYVGSQLKLRDDLFWFGKPRVLWWLIQFISFQNAFELATFLWSLWELSAQTCFMKHYYMVAIRLISGLLVQFWCSYSTLPLNVIISQMGSKFKKSLVSENVRESLHSWCKRVKDRSRHNPLFSRNGTLTTRSVCSLDTTYETDHETNTVCTLSRTASATSLDDQLTVVTVDDEPSCIEKDV

SEQ ID NO: 1168 - protein, 370 aa, Zea mays
MSVLTCVIESMGSSCSRSHSFDEAEAAENAKSADIDRRILQETKAEQHIHKLLLLGAGESGKSTIFKQIKLLFQTGFDEAELRSYTSVIHANVYQTIKILYEGAKELAQVEPDSSKYVLSPDNQEIGEKLSEIGARLEYPSLNKERVQDVRKLWQDPAIQETYSRGSILQVPDCAQYFMENLDKLSEEDYVPTKEDVLHARVRTNGVVETQFSPLGESKRGGEVYRLYDVGGQRNERRKWIHLFEGVNAVIFCAAISEYDQMLFEDETKNRMMETKELFDWVLKQRCFEVPLSVCEWFKDYQPTAPGKQEVEHAYEFVKKKFEELYFQSSKPDRVDRVFKIYRTTALDQKLVKKTFKLIDESMRRSREGT

SEQ ID NO: 1169 - protein, 334 aa, Zea mays
MAGAQESLSLVGTMRGHNGEVTAIATPIDNSPFIVSSSRDKSLLVWDLTNPVHSTPESGATADYGVPFRRLTGHSHFVQDVVLSSDGQFALSGSWDGELRLWDLSTGLTTRRFVGHEKDVLSVAFSVDNRQIVSASRDKTIKLWNTLGECKYTIGGDLGGGEGHNGWVSCVRFSPNTFQPTIVSGSWDRTVKVWNLTNCKLRCTLDGHGGYVNAVAVSPDGSLCASGGKDGVTLLWDLAEGKRLYSLDAGSIIHSLCFSPNRYWLCAATQDSVKIWDLESKHVVQDLKPDIQISKNQILYCTSLSWSADGSTLYTGYTDGSIRVWKISGYGYAG

SEQ ID NO: 1170 - protein, 162 aa, Zea mays
MRGQANGVEDRRQRGDDHEADNDGEEAEEEEGDDEGRHRGQGPPQQRRHQAQRPNSGPQQQQQPRPPPPLARNVGYVGKHRLSAAIARLDQELQSLQEELDELETMESASAACQEVVTSTEGKPDPLLPVTSGPENSSWDRWFQRVRSRSNKWWASKGPDFS

SEQ ID NO: 1171 - protein, 867 aa, Oryza sativa
MAGAGAVGGSNWEEMVRRMLPPGTTIPEAPANLDYSIALEYDGPPVSYELPRIDPVDLPAIPTAQPVSGPLVPGRSNGVVAPVVRPVFMPPVHRKQDAHRAEPPPVAAQGRRRRSSESVDSAPQNEGFSDDDDSCSVSQESAHNFHGQRGGRTAAQEGRRAQVVTFGVTEDSRYESKEFDDVSEQYVAVTKKEKRGRTCSRCGKRKWESKESCIVCDARFCSYCVLRAMGSMPEGRKCITCIGQPIDESKRSKLGKGSRILSRLLSPLEVRQILKAEKECQANQLRPEQLIINGFPLNPDEMASLLSCQRPPQKLKPGRYWYDKESGLWGKEGEKPDRVVSTNLTFNGKLQPNASNGNTQVYMNGREITKIELRVLKIAQVQCPRDTHFWVYHDGGYEEEGQNNIKGKIWESPVTRFACALFSLPVPPANSDEPKDEAPYSARTVPDYLDQKRIQKLLILGSPGAGTSTIFKQAKLLYDTRFTQEELDSIKLMIQSNMFKYLGILLEGRERFEEEALAGSNNPSSEDENTQHDGNKSNGSDSCIYSINAKLKKFSDWLLDIIAMGDLDAFFPAATREYAPIVEEMWKDPAIQATYKRKDELHFLPDVAEYFLSRAIEVSSNEYEPSEKDIIYAEGVTQGNGLAFIEFTLDDRSPMSEMYTDNHEPHSQTLNKYQLIRVSAKGMNEGCKWVEMFEDVSMVIFSVALSDYDQLGAPSSGGNSPLVNKMIQSRDLFEATIRQPCFRDMPFVLVLNKFDLFEEKIGRVPLSTCEWFSDFCPLRTHHNNQSLAHQAFYYVAMKFKELYAACTDRKLFVWQARARDRLTVDEAFKFIREVLKWEDEKDGGGYYPDESFYSTTELSSSRLIRQE

SEQ ID NO: 1172 - protein, 103 aa, Glycine max
MASETASSADEETVVVVSAAAGAGGTDKRGKHRILAELKRLDQESKFLQEELEELEKTENVSTICTELLQNIDTRPDPLLPEVHGPVNLLWDRWFEGPQDPQA

SEQ ID NO: 1173 - protein, 1039 aa, Synechocystis PCC6803
MATIHGNWQPSHGENGGKLFLWADTWGHPLPETIGDRHPFALDLPDLLQAWSNLPLAFPKADGVTEAALTLHLPSHRQQKIPLPFVTGQDPVAMDAKYLHWRSWQVTGVNLTPSQTLTLLQSIPLGGQALANLGSEFYFYGQLHRWCLDLVLRGKFVPGLEQRGEDGNYYAQWIPILDSIQDQTHLAQFSQRVPACALANLTDSQEPQMLVVDLLQKLLQAQIGAVSPSLANVKEVWLNDWLRGLTHGGQTSLGTGKALQRLATSLDHWYLPVQNYLGQKNNQALAQRQWRGALRLQPPADDGGGTWQLDYGLQALDDGEFWLPAASLWAMAGDRLVWQGRRVDQGAESLLRGLGVAAQIYEPIAASLTERCPTGCGLDAIQAYEFILAIAHQLRDRGLGVILPPGLERGGTAKRLGVKVVGEVQRQRGQRLTLQSLINYDLQLMMGSGDNARLLTAKDFEALLAQKSPLVVLDGEWITLQPADVRAAKVILQQQQSAPPLTVEDALRLSIGDLQTVSKLPVTQFAARGILQELIDTLRNPEGVKAIADPPGFQGTLRPYQARGVGWLAFLERWGLGACLADDMGLGKTPQLLAFLLHLAAEDMLVKPVLIVCPTSVLSNWGHEINKFAPQLKTLLHHGDRRKKGQPLVKQVKDQQIVLTSYALLQRDFSSLKLVDWQGIVLDEAQNIKNPQAKQSQAARQLPAGFRIALTGTPVENRLTELWSILEFLNPGFLGNQSFFQRRFANPIEKFGDRQSLLILRNLVRPFILRRLKTDQTIIQDLPEKQEMTVFCDLSQEQAGLYQQLVEESLQAIADSEGIQRHGLVLTLLTKLKQVCNHPDLLLKKPAITHGHQSGKLIRLAEMLEEIISEGDRVLIFTQFASWGHLLKPYLEKYFNQEVLYLHGGTPAEQRQALVERFQQDPNSPYLFILSLKAGGTGLNLTRANHVFHVDRWWNPAVENQATDRAFRIGQTRNVQVHKFVCTGTLEEKINAMMADKQQLAEQTVDAGENWLTRLDTDKLRQLLTLSATPVDYQAEASD

SEQ ID NO: 1174 - protein, 181 aa, coliphage T4
MTIEKEIEGLIHKTNKDLLNENANKDSRVFPTQRDLMAGIVSKHIAKNMVPSFIMKAHESGIIHVHDIDYSPALPFTNCCLVDLKGMLENGFKLGNAQIETPKSIGVATAIMAQITAQVASHQYGGTTFANVDKVLSPYVKRTYAKHIEDAEKWQIADALNYAQSKTEKDVYDAFQAYELT

SEQ ID NO: 1175 - protein, 201 aa, Zea mays
MSRHPEVKWAQRIDKVYITVQLPDAKDAKVNLEPDGVFTFSGSVGTNLYELKLDLNDKVNVEASKISVGVRSIFCIVEKAEAKWWKKLVRDDQRAPHFVKVDWDKWVDEDDDGADVNLDGMDFSNFGGMGGMGGMGGMGDMAGLGGLGGMGGMGGMGGMGMDDFEDDSDEEEVSKPQAAGHAAEAEKTESAEAKTESAQSS

SEQ ID NO: 1176 - protein, 553 aa, Zea mays
MDEDFEMPPAGADEMMGDDEMGDFGGDEGPVMKVGEEKEVGKEGLKKKLLKEGEGWETPEVGDEVEVHYTGTLLDGTKFDSSRDRGEPFKFKLGQGQVIKGWDQGIKTMKKGENAIFTIPPELAYGASGSPPTIPPNATLQFDVELLSWTSVKDICKDGGIFKKILKEGEKWENPKDPDEVLVKYEARLEDGTVVSKSEGVEFTVKDGYFCPALAKAVKTMKKAEKVLLTVKPQYGFGEKGRPAAGEEGAVPPNASLLIDLELISWKTVTEIGDDKKILKKVLKEGEGYERPNEGAVVEVKIIGKLQDGAVFTKKGHDEEPFKFKTDEEEVIAGLDRAVLNMKKGEVALVTIPPEYAFGSTESKQDLAVVPPNSTVIYEVELISFVKDKESWDLNNEEKIEAAGKKKEEGNALFKSGKYARASKRYEKAAKYIEYDTSFSEDEKKQSKQLKISCNLNNAACKLKLKDYKEAAKLCTKVLELDSQNVKALYRRVQAYIQLADLELAEADIKKALEIDPDNRDVKLEYKILKEKIKEYNKKDAKFYSNMFAKMTK

SEQ ID NO: 1177 - protein, 709 aa, Saccharomyces cerevisiae [sequence omitted]

SEQ ID NO: 1178 - protein, 589 aa, Saccharomyces cerevisiae
MSLTADEYKQQGNAAFTAKDYDKAIELFTKAIEVSETPNHVLYSNRSACYTSLKKFSDALNDANECVKINPSWSKGYNRLGAAHLGLGDLDEAESNYKKALELDASNKAAKEGLDQVHRTQQARQAQPDLGLTQLFADPNLIENLKKNPKTSEMMKDPQLVAKLIGYKQNPQAIGQDLFTDPRLMTIMATLMGVDLNMDDINQSNSMPKEPETSKSTEQKKDAEPQSDSTTSKENSSKAPQKEESKESEPMEVDEDDSKIEADKEKAEGNKFYKARQFDEAIEHYNKAWELHKDITYLNNRAAAEYEKGEYETAISTLNDAVEQGREMRADYKVISKSFARIGNAYHKLGDLKKTIEYYQKSLTEHRTADILTKLRNAEKELKKAEAEAYVNPEKAEEARLEGKEYFTKSDWPNAVKAYTEMIKRAPEDARGYSNRAAALAKLMSFPEAIADCNKAIEKDPNFVRAYIRKATAQIAVKEYASALETLDAARTKDAEVNNGSSAREIDQLYYKASQQRFQPGTSNETPEETYQRAMKDPEVAAIMQDPVMQSILQQAQQNPAALQEHMKNPEVFKKIQTLIAAGIIRTGR

SEQ ID NO: 1179 - protein, 385 aa, Saccharomyces cerevisiae
MSSVNANGGYTKPQKYVPGPGDPELPPQLSEFKDKTSDEILKEMNRMPFFMTKLDETDGAGGENVELEALKALAYEGEPHEIAENFKKQGNELYKAKRFKDARELYSKGLAVECEDKSINESLYANRAACELELKNYRRCIEDCSKALTINPKNVKCYYRTSKAFFQLNKLEEAKSAATFANQRIDPENKSILNMLSVIDRKEQELKAKEEKQQREAQERENKKIMLESAMTLRNITNIKTHSPVELLNEGKIRLEDPMDFESQLIYPALIMYPTQDEFDFVGEVSELTTVQELVDLVLEGPQERFKKEGKENFTPKKVLVFMETKAGGLIKAGKKLTFHDILKKESPDVPLFDNALKIYIVPKVESEGWISKWDKQKALERRSV

SEQ ID NO: 1180 - protein, 153 aa, Saccharomyces cerevisiae
MVVLNPNNWHWVDKNTLPWSKDYLNGKLTSLSTVSSDGKSKIELTQVSSITGDSNVSQRKGKPICYFDLQLSMNVKVTNLDTNKDDEDDDGILADGKLEIPEFMHDESDIPILSQGFDAFDGLVRSEFVPKVVETLLKYQDDLIKEHSKDIQV

SEQ ID NO: 1181 - protein, 213 aa, Oryza sativa
MSRHPEVKWAQRIDKVYITVQLADAKDAKVNLEPEGVFSFSATAGTDGNLYESKLELNDKVNVEESKISVGVRSIFCIVEKAEAKWWKKLVRDDQKAPHFVKVDWDKWVDEDDDGADVNVDGMDFSNFGGMGGMGGMGGMGDMMGGMGGMGGMGGMAEMMGGMGGMGGMGGMGGMDEFEDESDDEEEVSKPQDAEKAAEAGKSQESDAKAETS

SEQ ID NO: 1182 - protein, 165 aa, Zea mays
MSSSGPLLATGTHHTGRQPEVLWAQRSEKIFLTISLPDAKDVVLKTDPKGLFNFSAVVHGEPFSFTLELFDSILSEGSKTKTKMGLRNIICSIQKEKKGWWKRLLKSEEKHPYIKVDWNKWCDEDEESEFSGDSDGGFDEANEGDESDDDDGMLYLPDLEKLRGK

SEQ ID NO: 1183 - protein, 173 aa, Oryza sativa
MSRHPSTKWAQRSDKVFLTIELPDARDVKLNLKPEGQFIFSAKGPADDTPYELDLELFDAVNVEESKAAVAARSICYLIKKAESKWWPRLLKKEGKPPVFLKVDWDKWQDEDDEDIGLGDFGDMDFSKLGMGGPDDDLEDDDEDDTADSANKDDEDIKAEGSGEQEAAGEAKP

SEQ ID NO: 1184 - protein, 176 aa, Zea mays
MSRHPITKWAQRSDRVFLTIELPDAQDVKLNLKPEGHFNFSAKGSDDLRYEFDIELFDAVNVEESKAAIAPRTICYLIKKAKSGWWPRLLKQEGKPPVFLKVDWDKWQDEDDEDAGFNDFGGMDFSKLDIGGADDDDIGDDEDDVVESANKDEEGGKTEESKEEEAAPAAAEEVKP

SEQ ID NO: 1185 - protein, 374 aa, Oryza sativa
MALLMDPGAGGPLTESEKADLDAIAAIKESAAAEYKEKGNRLVKMGRSHYADAVDCYTKAIAQMEPLPPPPVPSPDASVLFANRAHVNLLLGNHRRALDDAARAVQLSPSNVKAYYRAAKAAIALGLLPEAAAFCRRGIEQDPANEELKKLLAQVDAQQSEQDRHRAKVAQAVSAAKDIVAAIEKRGLKLGKAAYQELTGVKKPKLDEQGVLHWPVLLLYPEVMSSDFIEDFPETDTFVPHLDVMFSESSPPLPWDDKHAYTRDAVELYYQAGVGTVLSKSEILKILLEGTMDSKSLPESLLDEEDGENDDGKSSTITSSDKGSVKWINVKEGKTLQEVLQHKDFIIPAIPVFFVVSRKSTFYRKFKAGNWSLP

SEQ ID NO: 1186 - protein, 353 aa, Zea mays
MAKYGEGDKRWIVEERADGTNVHNWHWAERDCIEWSRARLSSLLAGLTVLDGEDGLTLRTVALDNLDGEAYVNIRKGKVIPGYELSLTLSWEAEAASESGAVKVAGTAEVPYLADENADEDPDLHITVRGDETPLALRAKDAFLSRGKPMVLEKIREFVAAMAKGGPAKDELDSKKTPAKVAAAAPGAAPAKKEEVVAPAPAAGKKKAKGKDKEGFKTIKMTETFYCRSKDIYEILMDENRWKGFTQSNAKISREVGGEFSLFDGCITGVNEDLQEGKLIAQKWRFGSWPDGLYSSVRLMLDEPESGVTVIKLKQTGVPEEDKYGNSTVVENTERGWRDLIFQRIRGMFGFGI

SEQ ID NO: 1187 - protein, 581 aa, Zea mays
MADEAKAKGNAAFSAGRFEEAARHFTDAIALAPDNHVLYSNRSAALASLHRYSDALADAQKTVDLKPDWAKGYSRLGAAHLGLGDAASAVAAYEKGLELDPSNEGLKAGLQDAKKAAAAPPRRGSSGPDAIGQMFQGPELWSKIASDPSTRAYLNEPDFMHMMREVQRNPSSISMYLSDPRMMQVLSLMLNVKIQRPEASEPSQSTPPPPKQQQQQQTPPSETKARDVEPEPEAEPMDLTDEEKDRKQTKAAAQKEKELGNAAYKKKDFEVAIQHYTKALELDDEDISYLTNRAAVYIEMGKYDECIKDCDKAVERGRELRADFKMISRALTRKGTALVKLAKTSKDFDIAIETFQKALTEHRNPDTLKKLNEAEKAKKELEQQEYYDPKLADEEREKGNEFFKEQKYPEAIKHYTEALKRNPKDPRVYSNRAACYTKLGAMPEGLKDAEKCLELDPTFTKGYTRKGAIQFFMKEYDKAVETYQAGLKHDPNNQELLDGVKRCVEQINKANRGEISQDELQERQNKAMQDPEIQNILTDPIMRQVLIDFQENPSAAQEHLKNPGVMQKIQKLVSAGIVQMR

SEQ ID NO: 1188 - protein, 399 aa, Emericella nidulans
MDASKLRELRDFVEACKKNPSLLADPNLSFFRDYLQSLGAKIPAAAPSFESPKRSSMDDIDDDGDDDDDLDMRDPTPERDELDEEIVESDLELEGEIVQSDHDDPPQKMGNPSVEVTEENRDASQEAKGKAMEAISEGKLEDAIEHLTNAIVLNPLSAIMYGTRASVFIKMKKPAAAIRDANAALEINPDSAKGYKTRGMAYAMLGKWEEAAHDLHTASNMDYDEEINAVLKKVEPNAHKIVEHRRKYERLRKEREEKRAQRDRLRQRAEAQAAYDKAKRKEQSSSRSSGGASPRGFPGGMPGGGFPRGMPGGGFPGGGMPGGFPGGGMPGGFPGGVPGNVDMSKILNDPDLMAAFSDPEVMAALQDVMNNPANFAKHQANPKVGPIIAKMMAKFNGSQ

SEQ ID NO: 1189 - protein, 273 aa, Oryza sativa
MSPAADSAASKRQAELLKQEGNAFFKKDRISAAIDAYTGAIALCPKVAVYWTNRALCYKRRNEWVRAEEDCRTAIQLDSHSVKAHYMLGLALLNKDELAEGIKELEKSLELGRGAHPASYMVEEIWQELSKAKYIEWENLSSERVRQLHKLKEACKEALRNYNSLDNPPAYVPEEQLNELEEVFRNARKSDIPTEVPDHLCCKITLDIFRDPVITPSGITYERAVILDHLHRVGKFDPVTRETLEPHQLVPNLAIKEAVHAFLSEHGWAYRMR

SEQ ID NO: 1190 - protein, 275 aa, Zea mays
MAPAAPYGGAESQRQADLLKQEGNAFFRKERLSAAIDAYTGAITLCPNVAVYWTNRALCYRKRNEWTRVEEDCRTAIQLDSQSVKAHYMLGLSLVNSQRLSEGIKSLEKSLELGRGAHPASYMVEEIWQELSKAKYIEWESLSRDRTCQLQKLKVACKEALTSYNSLDNPAAGAPVEQLNELEEVFKKAAKTDTPAEVPDHLCCKITLDIFRDPVITPSGITYERAVLLDHLQTVGRFDPVTREALEPHQLVPNLAIKEAVHAFLSEHGWAYKIR

SEQ ID NO: 1191 - protein, 808 aa, Zea mays
MRKWALSSALLLLFLLTTLPDPAKKLQVNAEESSDDLANPPKVEEKLGAVPHGLSTDSEVAQREAESISRKTLRSSAEKFEFQAEVSRLMDIIINSLYSNKDIFLRELISNASDALDKIRFLSLTDKEVLGEGDTAKLEIQIKLDKEKKILSIRDRGIGMTKEDLINNLGTIAKSGTSAFVEKMQSGGDLNLIGQFGVGFYSVYLVADYVEVVSKHNDDKQYVWESKADGSFAISEDTWNEPLGRGTEIRLHLRDEAKEYLEEDKLKDLVKKYSEFINFPIYLWSTKEVDVEVPADEDETSEEEDSSPETTEEETEEDEEKEKKPKTKTIKETTSEWELLNDMKAVWLRSPKEVTDEEYSKFYHSLAKDFGDDKPMGWSHFTAEGDVEFKALLFIPPKAPHDLYESYYNSNKSNLKLYVRRVFISDEFDDLLPKYLSFLRGIVDSDTLPLNVSREMLQQHSSLKTIKKKLIRKALDMIRKLAEEDPDEYSNKDKTDEEKNEMEEKKGQYAKFWNEFGKSIKLGIIEDATNRNRLAKLLRFESTKSDGKLASLDEYISRMKPGQKDIFYLTGSSKDQLEKSPFLERLTKKNYEVIFFTDPMDEYLMQYLMDYEDRKFQNVSKEGLKLGKDSRLKDLKESFKELTEWWKKALESESVDSVKVSSRLHDTPCVVVTSKYGWSANMEKIMQAQTLSDSSKQAYMRGKRVLEINPRHPIIKELRDKVAQDNESEELKQTARLVYQTALMESGFNLPDPKEFASSIYKSVHKSLDLSPDAAVEEEDEAEEQPEVEEKEPAAKEGSEPSFDKDEL

SEQ ID NO: 1192 - protein, 811 aa, Oryza sativa
MRKWALSSALLLLLLLTTLPDPAKKLQVNADDSTDELVDPPKVEEKIGGVPHGLSTDSEVVQREAESISRKTLRSSAEKFEFQAEVSRLMDIIINSLYSNKDIFLRELISNASDALDKIRFLALTDKEVLGEGDTAKLEIQIKLDKEKKILSIRDRGIGMTKEDLIKNLGTIAKSGTSAFVEKMQTGGDLNLIGQFGVGFYSVYLVADYVEVISKHNDDKQHVWESKADGSFAISEDTWNEPLGRGTEIRLHLRDEAKEYVEEDKLKDLVKKYSEFINFPIYLWATKEVDVEVPADEDESSESSEEEESSPESTEEEETEESEEKKPKTKTVKETTTEWELLNDVKAIWLRSPKEVTEEEYTKFYHSLAKDFGDDKPLSWSHFTAEGDVEFKALLFVPPKAPHDLYESYYNSNKSNLKLYVRRVFISDEFDELLPKYLSFLKGLVDSDTLPLNVSREMLQQHSSLKTIKKKLIRKALDMIRKLAEEDPDEYSNKDKTDEEKSAMEEKKGQYAKFWNEFGKSVKLGIIEDATNRNRLAKLLRFESTKSEGKLASLDEYISRMKPGQKDIFYITGSSKEQLEKSPFLERLTKKNYEVIYFTDPVDEYLMQYLMDYEDKKFQNVSKEGLKLGKDSKLKDLKESFKELTDWWKKALDTESVDSVKISNRLSDTPCVVVTSKYGWSANMEKIMQSQTLSDASKQAYMRGKRVLEINPRHPIIKELRDKVAQDSESESLKQTAKLVYQTALMESGFNLPDPKDFASSIYRSVQKSLDLSPDAAVEEEEEVEEAEVEEKESSNIKEEAEPSSYDKDEL

SEQ ID NO: 1193 - protein, 787 aa, Zea mays
MAPALSGTLGASSVAALRPCAGRRAPSAASSVAPRGSGVVRCSRGLRWDAHRSRGRLLRVRCDAAVAEKPAEEEAAGEKFEYQAEVSRLMDLIVHSLYSHKEVFLRELVSNASDALDKLRFLGVTDSSLLADGGELEIRIKPDLDAGTITITDTGVGMTKDELKDCLGTIAQSGTSKFLKALKENKDLGADNGLIGQFGVGFYSAFLVAEKVVVSTKSPKSDKQYVWEAVADSSSYVIKEETDPEKMLTRGTQITLFLRPDDKYEFADPSRIQGLVKNYSQFVSFPIYTWQEKSRTVEVEEDEEPKEVEEATKGEKKKKTITEKYWDWELANETKPIWMRNPKEIENTEYNEFYKKTFNEFLDPLAHTHFTTEGEVEFRSVLYVPGMAPLSNEEIMNPKTKNIRLYVKRVFISDDFDGELFPRYLSFVKGVVDSNDLPLNVSREILQESRIVRIMRKRLVRKTFDMIEEIAEKEDKEDYKKFWESFGKFVKLGCIEDTGNHKRLAPLLRFHSSKNEGDLISLDQYVESMPESQKAIYYIATDSLQSAKTAPFLEKLVQKDIEVLYLIEPIDEVAIQNLQTYKEKKFVDISKEDLELGDEEEETKETKQEFTLLCDWVKQQLGDKVAKVQISKRLSSSPCVLVSGKFGWSANMERLMKAQTLGDTSSLEFMRGRRIFEINPDHPIIKDLSAACKNEPESTEARRAVELLYEAALISSGYTPESPAELGGKIYEMMAIALGGRWGRSDMEEAEASTGEASAEADSSEVTVAEVIEPSEVRPESDPWRDQ

SEQ ID NO: 1194 - protein, 716 aa, Sorghum bicolor
MASADVHMAGGGAETETFAFQAEINQLLSLIINTFYSNKEIFLRELISNASDALDKIRFESLTDKSKLDAQPELFIRLVPDKATKTLSIIDSGVGMTKSDLVNNLGTIARSGTKEFMEALAAGATDVSMIGQFGVGFYSAYLVADKVVVTTKHNDDDQYVWESQAGGSFTVTLDTTGERLGRGTKITLFLKDDQLEYLEERRLKDLVKKHSEFISYPIYLWTEKTTEKEISDDEDDEDKKEGDVEEVDDDDGDKDDKDSKTTKKKKKVKEVTHEWVQINKQKPIWLRKPEEITREEYASFYKSLTNDWEDHLAVKHFAVEGQLEFKAILFVPRRAPFDLFDTRKKLNNIKLYVRRVFIMDNCEELIPEWLGFVKGVVDSDDLPLNISRETLQQNKILKVIRKNLVKKCIEMFFEIAENKDDYAKFYDAFSKNIKLGIHEDSQNRAKLADLLRYHSTKSGDEMTSLKDYVTRMKEGQKDIYYITGESKKAVENSPFLERLKKKGYEVLFMVDAIDEYAVGQLKEYDGKKLVSATKEGLKLDDDDEEAKKRREERKKQFEDLCKVIKDILGDRVEKVVVSDRIVDSPCCLVTGEYGWTANMERIMKAQALRDSSMSAYMSSKKTMEINPDNGIMEELRKRAEADRNDKSVKDLVLLLFETALLTSGFSLDDPNTFAARIHRMLKLGLNIDEDAAADEDADMPALEEGAAEESKMEEVD

SEQ ID NO: 1195 - protein, 699 aa, Oryza sativa
MASETETFAFQAEINQLLSLIINTFYSNKEIFLRELISNSSDALDKIRFESLTDKSKLDAQPELFIHIVPDKASNTLSIIDSGVGMTKSDLVNNLGTIARSGTKEFMEALAAGADVSMIGQFGVGFYSAYLVAERVVVTTKHNDDEQYVWESQAGGSFTVTRDTSGEQLGRGTKITLYLKDDQLEYLEERRLKDLVKKHSEFISYPISLWTEKTTEKEISDDEDEEEKKDAEEGKVEDVDEEKEEKEKKKKKIKEVSHEWNVMNKQKPIWLRKPEEITKEEYAAFYKSLTNDWEEHLAVKHFSVEGQLEFKAILFVPKRAPFDLFDTRKKQNNIKLYVRRVFIMDNCEELIPEWLSFVKGIVDSEDLPLNISREMLQQNKILKVIRKNLVKKCVELFFEIAENKEDYNKFYEAFSKNLKLGIHEDSTNRTKIAELLRYHSTKSGDELTSLKDYVTRMKEGQSEIYYITGESKKAVENSPFLEKLKKKGYEVLYMVDAIDEYAVGQLKEFEGKKLVSATKEGLKLDESEDEKKRQEELKEKFEGLCKVIKEVLGDKVEKVVVSDRVVDSPCCLVTGEYGWTANMERIMKAQALRDSSMAGYMSSKKTMEINPENAIMDELRKRADADKNDKSVKDLVMLLFETALLTSGFSLEDPNTFGTRIHRMLKLGLSIDEDESAEADADMPPLEDDAGESKMEEVD

SEQ ID NO: 1196 - protein, 652 aa, Oryza sativa
MMDGAAPLLPETSPESRQQRDPERGKRRTPVLPAVVASAVVLLGLAALFLVYGFHDGGDGRAAVLAPGTVEVAASSSRGVVEGVSEKSTTPALRLGGGAVRDYAWTNSMLSWQRTAFHFQPPNNWMNGPLYYKGWYHLFYQWNPDSAVWGNITWGHAVSRDLIHWLHLPLAMVPDHWYDINGVWTGSATQLPDGRIVMLYTGATEESVQVQNLAEPADPNDPLLREWSKAEANPVLVPPPGIGLTDFRDPTTAWRNPADSAWRITIGSKDRDHAGLALVYKTEDFLHYDLLPTLLHVVKGTGMWECVDLYPVSTSPAVEDGLETSTPPGPGVKHVLKASLDDDRNDYYAIGTYDGETDTWTPDNADIDVGIGLRYDYGKFYASKTFYDPVGRRRVLWGWIGETDSERADILKGWASLQSIPRTVMLDTKTGSNLLQWPVVEVENLRMRGKSFDGLDVSPGSVVPLDVGKATQLDIEAVFEVDTSAADGVVTEAGAAAYSCGTGGGAVGRGLMGPFGLLVLADDQLSERTAVFFYLVKGVDGNLTTFFCQDELRSSKANDLVKRVYGSLVPVLDGENLSIRILVSLSSNVDHSIVEGFAQGGRTCITSRVYPTKAIYESAKIFLFNNATNVRVTAKSLKIWELNSAYIRPYVD

SEQ ID NO: 1197 - protein, 911 aa, Zea mays
MIQMNMKQPLVLPAHRGNVIGSRLASSPSPVAAAAAAASRRRGVVSSPRSRLQRHMRLPRISCSATEEASGAVSAVTVEKMLTVTASVQAAPAIGQMYFQRALDDAGDFFGKTLLMELVSSEVDAKTGLEKPRVTAFAHKTLREGHYEAEFKVPASFGPVGAVLLENEHHKEIFIREIKLVTGSDSSTAVTFGCNSWVHSKFDNPEKRIFFTLKSYLPSDTPKGLEDLRKKDLQALRGDGHGERKASERVYDYDVYNDLGDPDKNPAHQRPVLGGSKRYPYPRRCRTGRPRTRKDPEAEVRHGHNYVPRDEQFSEVKQLTFGATTLRSGLHALLPAIRPMLIKRELRFPHFPAIDDLYSDGIPLPAQTGLGAIRSIVPRVVKLVEDTTEHVLRFELPDMIERDRFSWFKDEEFARQTIAGLNPLCIQLLTEFPIRSKLDPEVYGPAESAITKEILEKHMSGGAAMTVEQALAAKRLFILDYHDVFLPYVHRVRELPDTTLYGSRTVFFLTDLGTLMPLAIELVRPKSPTQPQWKRVFTHGPDATDAWLWKLAKAHVVTHDTGYHQLVSHWLRMHCCVEPYIIAANRQLSRLHPVYRLLHPHFRYTMEINALAREALINADGIIEESFWPGRYAVELSSAAYGATWQFDTEALPNDLVKRGLAVRRDDGELELTIKDYPYAHDGLMVWNTIRQWAADYVNVYYKSDEAVAADPELKAFWDEVRNVGHGDKKDEPWWPVLDTRDSLAETLTTIMWVTSGHHSAVNFGQYHFGGYFPNRPTTIRKSMPVEEEAGRDEEMKKFLKQPETTLLDMLPTQMQAIRVMTTLDILSSHSPDEEYMGELAEPSWLEEPMVKAAFEKFGGRMKEIEGFIDECNNNPELRNRCGAGIVPYELLKPFSKPGVTGRGIPNSISI

SEQ ID NO: 1198 - protein, 482 aa, Zea mays
MASSDHGSTTAPKDVPGSYGLPLVGAVRDRLDFYYFQGQDKYFESRVERYGSTVVRMNVPPGPFMARDPRVVAVLDAKSFPVLFDMDKVEKKDLFTGTYMPSTSLTGGYRVCSYLDPSEPTHTKVKQLLFSLLLSRKDDVIPTFRSNFSSLLATVEAELAKGGKAEFNKLNDVTSFDFIGEAYFGVRPSATDLGKGGPTKAAKWLIWQLHPLVTLGLPMVLEEPLLHTFHLPPFLVKGDYRALYKYFSTVAKQALDTAEGLGLSREEACHNLLFATTFNSYGGLKVLFPGLLANVASGGEKLHERLVAEIRGAVADAGGKVTLAAVERMELAKSVVWESLRLDPPVKFQYGHAKKDLLVESHDAVFQVRKGEMLFGYQPCATKDPRVFGDTAGDFVPDRFLGEEGSKLLQYVYWSNGRETENPSVDNKQCPGKNFVVLVGRLLLVELFLRYDTFTAEVGKELLGTSVIFTGVTKATSGPGSE

SEQ ID NO: 1199 - protein, 591 aa, Zea mays
MGGEAEGGERRLGRVLSFGIPDTALGLVMGYVEDPWDRDAISLVCRHWCRVDALSRKHVTVAMAYSTTPERLFRRFPCLESLKLKAKPRASMFNLISDDWGGSASPWIRQLSATFHFLKKLHLRRMIVSNEDINILVRAKAHMLVALKLDRCSGFSTPSIALVARSCRKLETLFLEESTIDEKENDEWIRELATSNSVLETLNFFLTDLRASPEYLTLLVRNCQRLKTLKISECFMPDLVSLFRTAQTLQEFAGGSFEEQGQPVASRNYENYYFPPSLHHLSLLYMGTNDMQILFPYATALKKLDLQFTFLSTEDHCQIVQRCSNLETLEVRDVIGDRGLQVVAQTCKKLHRLRVERGDDDQGGLEDEQGRISQVGLMAIAQGCPELTYWAIHVSDITNAALEAVGTCSKNLNDFRLVLLDREAHITELPLDNGVRALLRGCTKLRRFAFYVRPGALSDVGLGYVGEFSKSIRYMLLGNVGESDNGIIQLSKGCPSLQKLEVRGCLFSEHALALAALQLKSLRYLWVQGFRSSPTGTDIMAMVRPFWNIEYIVPDQDEPCPEHKRQILAYYSLAGRRTDCPPSVTLLYPAF

SEQ ID NO: 1200 - protein, 598 aa, Zea mays
MGGEVPEPRRLSRALSFGCGGVPEEALHLVFGYMDDPRDREAASLVCRLWHRIDALSRKHVTVGFCYAVEPARLLARFPRLESLALKGRPRAAMYGLIPEDFGAYAAPWVAELAAPLDCLKALHLRRMTVTDEDIAVLVHARGHMLQALKLDKCSGFSTDALRLVARSCRSLRTLFLEECIIEDEGSEWLHELAVNNSVLVTLNFYMTELKVEPADLELLAKNCKSLISLKMGDCDLSDLIGFFQTSKALQEFAGGAFFEVGEYTKYEKVIFPPRLCFLGGLTFMGKNEMPVIFPYSTMLKKLDLQFTFLTTEDHCQLIAKCPNLSVLEVRNVIGDRGLEVVAATCKKLRRLRIERGDDDPGQEEQGGVSQIGLTAVAVGCRELEYIAAYVSDITNGALESIGTFCKNLYDFRLVLLDKQKKITDLPLDNGVRALLRNCVKLRRFAFYLRPGGLSDVGLGYIGLYSGNIQYMLLGNVGESDNGLIQFATGCTNLRKLELRGCCFSERALAVAVLQMPSLRYIWVQGYRASRTGQDLMLMARPYWNIEFAPPIPESAYRVMADGQPCVDTHAQVLAYYSLAGRRPDCPQWLVTLHPASL

SEQ ID NO: 1201 - protein, 660 aa, Zea mays
MSREAQKLDCTAAGGGIGVLSLDLLGQVLEHLREPRDRKTCRLVSRAFERAEAAHRRALRVLRREPLPRLLRAFPALERLDLSACASLDDASLAAAVADAGGGLAGLRSVCLARANGVGWRGLEALVAACPKLAAVDLSHCVSAGDREAAALAAASELRDLRLDKCLAVTDMGLAKVAVGCPKLEKLSLKWCREISDIGIDLLAKKCPELRSLNISYLKVGNGSLGSISSLERLEELAMVCCSGIDDEGLELLSKGSDSLQSVDVSRCDHVTSEGLASLIDGRNFLQKLYAADCLHEIGQRFLSKLARLKETLTLLKLDGLEVSDSLLQAIGESCNKLVEIGLSKCSGVTDGGISSLVARCSDLRTIDLTCCNLITNNALDSIADNCKMLECLRLESCSLINEKGLKRIATCCPNLKEIDLTDCGVDDAALQHLAKCSELRILKLGLCSSISDRGIAFISSNCGKLVELDLYRCNSITDDGLAALANGCKRIKLLNLCYCNKITDTGLGHLGSLEELTNLELRCLVRVTGIGISSVAIGCKNLIELDLKRCYSVDDAGLWALARYALNLRQLTISYCQVTGLGLCHLLSSLRCLQDIKMVHLSWVSIEGFEMALRAACGRLKKLKMLCGLKTVLSPELLQMLQACGCRIRWVNKPLVYKD

SEQ ID NO: 1202 - protein, 317 aa, Zea mays
MAATVSSFPVVNMEKLETEERATAMEVIRDGCENWGFFELLNHGISHELMDEVERLTKAHYATFREAKFQEFAARTLEAGEKGADVKDVDWESTFFVRHLPASNLADLPDVDDRYRQVMEQFASEIRKLSERLLDLLCENLGLEPGYLKAAFAGSDGPTFGTKVSAYPPCPRPDLVDGLRAHTDAGGIVLLFQDDQVSGLQLLRGGEWVDVPPMRHAIVANVGDQLEVITNGRYKSVMHRVLTRPDGNRMSVASFYNPGADAVIFPAPALVGAAEEDRAEAAYPSFVFEDYMNLYVRHKFEAKEPRFEAMKSAIATA

SEQ ID NO: 1203 - protein, 487 aa, Oryza sativa
MVSQVVAEEKPQLLSKKAGCNSHGQDSSYFLGWQEYEKNPFDPVSNPSGIIQMGLAENQLSFDLLEEWLEKNPHALGLRREGGGASVFRELALFQDYHGLPAFKNALARFMSEQRGYKVVFDPSNIVLNAGATSANEALMFCLADHGDAFFIPTPYYPGFDRDLKWRTGAEIVPVHCASANGFRVTRAALDDAYRRAQKRRLRVKGVLITNPSNPLGTASPRADLETIVDFVAAKGIHLISDEIYAGTAFAEPPAGFVSALEVVAGRDGGGAGVSDRVHVVYSLSKDLGLPGFRVGAIYSANAAVVSAATKMSSFGLVSSQTQYLLAALLGDRDFTRSYVAENKRRIKERHDQLVDGLREIGIGCLPSNAGLFCWVDMSHLMRSRSFAGEMELWKKVVFEVGLNISPGSSCHCREPGWFRVCFANMSAKTLDVAMQRLRSFVDSATGGGDNAALRRAAVPVRSVSCPLAIKWALRLTPSIADRKAER

SEQ ID NO: 1204 - protein, 371 aa, Zea mays
MGSGGANTAPLLTPYKMGKFDVTHRVVLAPLTRQRSYGNVPQPHAILYYQQRATKGGLLIAEATGVSDTAQGYKDTPGIWTHEQVEAWKPIVDGVHQKGGIFFCQIWHVGRVSNSTFQPNGQAPISSTDKPLKPQVRANGIDVATFAVPRRLETDEIPLVVNDFRVAARNAIEAGFDGVEIHGAHGYLIDQFLKDGVNDRTDKYGGSLENRCRFALEVTQAVVDEIGADKVGIRLSPFASYSEAPDSDPEALGMYMANALNEFGILYCHMVEPRMVKLGEKFETPYSLRPIRDAFRGTFIVAGGYGREDGNRAISTGYADLVAFGRLFLANPDLPRRFEVDAPLNKYNRDTFYIPDPVVGYTDYPFLSSDV

SEQ ID NO: 1205 - protein, 359 aa, Zea mays
MTRCRAPDAIPGPALAEYYAQRSTEGGLLISEGTIISPSGPGFPRVPGIYNQEQTDAWRKVVDAVHAKGAIFFCQLWHVGRASHQVYQPGAAAPISSTDKPISSRWRILMPDGSYGKYPTPRRLATSEIPEIVEQYRQAAVNAIKAGFDGIEIHGAHGYLIDQFLKGGINDRTDEYGGSLSNRCRFLLEVTRAVVSAIGADRVAVRVSPAIDHLDAYDSNPLQLGLAVVERLNALQQEAGRLAYLHVTQPRYTAYGQTESGQHGSAEEESRLMRAVRGAYRGTFMCSGGYTRELGVEAIESGDADLVSYGRLFIANPDLVERFRRDAPLNKYVRKTFYTPDPVVGYTDYTFLGQPKARM

SEQ ID NO: 1206 - protein, 373 aa, Zea mays
MVQQAAKEVIPLLTPYKMGQFELSHRVVLAPLTRCRSYGNVPQPHAAVYYSQRATRGGLLIAEATGVSATAQGFPESPGIWTQEQVEAWKPIVDAVHRKGAIFVCQIWHVGRVSTNELQPNGDAPISSTDKQISPDAKSGTAYSKPRRLRTDEVPGIVDDFRRAARNAIQAGFDAVEIHGAHGYLLEQFMKDSCNDRTDQYGGSLENRCRLAVEVVDAVVREVGARRVGIRLSPFVDFVDCVDSDPVALGHYMVQQLNRHSGLLYCHMVEPRITAHGRRQIPHGLLPFRKAFHGTFIAAGGYDREEGNKVVAEGYADLVAYGKLFLANPDLPRRFELDVALNKYDRSTFYTQDPIVGYTDYPFFEEEDGKNER

SEQ ID NO: 1207 - protein, 504 aa, Zea mays
MLPSFVSPTASAAASVTPPPRPIPGSYGPPVLGPLRDRLDYFWFQSQDEFFRKRAAAHRSTVFRTNIPPTFPFFVGVDPRVVAIVDAAAFTALFDPDLVDKRDILIGPYNPGAGFTGGTRVGVYLDTQEEEHARVKTFAMDLLHRSARTWSADFRASVGAMLDAVDAEFGKDDGSDKKPSASYLVPLQQCIFRFLCKAFVGADPSADWLVDNFGFTILDIWLALQILPTQKIGLVQPLEELLIHSFPLPSFLIWPGYYVLYRFIEKHGAEAVAYAEAQHGIGKKDAINNMLFVLGFNAFGGFSVFLPFLVAKVGGAPALRERLRDEVRRAMVGKGKDGEFGFATVREGMPLVRSTVYEMLRMQPPVPLQFGRARRDFVLRSHGGAAYQVSAGEVLCGYQPLAMRDPEVFERPEEFVPERFLGDDGARLLQHLFWSNGPETAQPGPGNKQCAAKEVVVDTACMLLAELFRRYDDFEVEGTSFTKLVKRQASPSVAQAAAAAGAQQ

SEQ ID NO: 1208 - protein, 370 aa, Glycine max
MKVAQVLHMNGGVGHASYANNSLLQQKVICLTKPIREEAITSLYCNTVPRSLAVADLGCSSGPNTLLVVSEFIKIVEKLCRELNHKSPEYKVFLNDLPGNDFNNIFKSLDSFKKKLCDEMESGIGPCYFSGVPGSFYGRVFPNQSLHFVHSSYSLHWLSKVPEGVDNNRGNVYIGSTSPTNVARAYYEQFQRDFSLFLKCRAEELVKGGRMVLTFLGRRSDDPSSKDGGYVWELMATALNDMVLQGIIKEEQLDTFNIPLYTPSPSEVKLEVLKEGSFASNRLEVSEVNWNAFDDWNALEFESERSDTLSDGGYNVAQCMRAVAEPMLVSHFGEAIIEEVFSRYQQILTDRMSKEQTKCINVTVLLTRKA

SEQ ID NO: 1209 - protein, 382 aa, Zea mays
MKVERDLHMSRGDGEDSYASNSRLQEKSILKTRPVLHKAVAAAHALSLSSGGPGGGAMVVADLGCSSGPNTLLVVSEVLAAVAMVAGGSAQPQHVQFFLNDLPGNDFNLVFRSLDLLKNKKLAAKDRREESLLPPYYVAGLPGSFYTRLFPDHCVHLFHSSYCLMWRSKVPDELAGGAVLNEGHMYIWETTPQAVVALYRRQFQEDMSLFLRLRHRELVPGGHMVLAFLGRKKSKDVLRGEVSYTWGLLAQALQSLVKQGRVKKDKLDSFNLPFYAPSMDEVRDVITRSQAFDITHIQLFESNWDPHDDDDVEMKMEEDVAAVQSGVNVARSIRAVIGPLIARHFGEHILDDLFELHAKNVAVHLQKVKTKYPVIVVSLQAK

SEQ ID NO: 1210 - protein, 382 aa, Zea mays
MSMRIERDLHMATGNGETSYTKNSRIQEKAMFQMKSVLEEATRAVCTALLPQTMVVADLGCSSGPNTLRFVTEVTRIIAHHCKLEHNRRHDHPLQLQFFLNDLPGNDFNNLFQLIEQFNKSSTTHKGDAATEALQPPCYISGLPGSYYTRIFPSESVHLFHSLFCLQWRSQAPEQLKGTQKSCLDIYITKTMSPSMVKLFQQQFQKDFSLFLRLRYEELVSGGQMVLTFIGRKHEDVFTGESNHLYGLLAQSLKSLVDEGLVEKEKLESFYLPIYSPSVGEVEAIVKQLGLFNMNHVKVFEINWDPYDDSEGDDVHNNIESGENVAKCLRAVMEPLVASQFGERILDKLFKEYARRVAKHLENEKTKHAVLVLSIKKAIIHV

SEQ ID NO: 1211 - protein, 911 aa, Zea mays
MAFKGLPRDSRGSLEVFNPDAPVSDRATTSPFLLPPAVASHPSLLAAGDGGDADVGRATQRAAEWGLVLQTDEHTGRPQGVVARPSGSNRTSESGNSIDERAAAAGAGRALPRVSEELRAALSAFQQTFVVSDATRPDHPILYASAGFFNMTGYSSNEVVGRNCRFLQGSGTDPVEISKIRQALAAGSNYCGRILNYKKDGTPFWNLLTVAPIKDEDGRVLKFIGMQVEVSKYTEGNKDTALRPNGLPESLIKYDARQKDHARSSVSELLLALKDPRSLSESRNNTLKRKSQESAGSALVPGKRSSETGSRRNSHSGMRNSLQKISEVPEGGNKTRKSGLRSFMGLIGMGHGNVEKNILKPREDPLLDSDDERPDSFDDDFRKKEMRKGIDLATTLERIEKNFVITDPRLPDNPIIFASDSFLRLTEYCREEILGRNCRFLQGPETDRGTVKKIRDAIDNQTEVTVQLINYTKSGKKFWNLFHLQPMRDQKGDVQYFIGVQLDGTERVREAAAKDGAILVKKTADNIDEAAKELPDANLRPEDLWANHSKPVLPKPHMKDTASWRAIQKVLENGESIDLKHFRPVRPLGSGDTGSVHLVELLGTGEYFAMKAMDKSVMLNRNKVHRATAERQILDMLDHPFLPTLYASFQTKTHICLIVDYCAGGELFMLLDRQPMKVLKEDAVRFYAAEVVTALEYLHCQGIIYRDLKPENILLHRDGHISLTDFDLSCLTSCRPQVFLPHDIDKKKKRRKSRSNPIFFAEPMRASNSFVGTEEYIAPEIITGAGHTSAVDWWALGILLYEMLYGYTPFRGKTRQRTFANILHKDIRFPASIQVSLAARQLIYRLLHRDPANRLGSYEGAMEIKQHPFFRGINWALVRAATPPELEAPLQDTLEATLPPPAADAAHTDMF

SEQ ID NO: 1212 - protein, 229 aa, Zea mays
MAAARRLSLPLVLLVVLAVAGRAAAQDYDFFYLVLQWPGAYCDTKQSCCYPKSGKPAADFGIHGLWPNRDDGTYPQNCSPDNAFNPSKVSDLMSSLRAKWPTLACPSNDGLRFWGHEWEKHGTCAADVFDEHGYFQAALRLRDQLGVLGALTSAGVKPDGGYYTLSQIKGAIRQGTGFEPYVECNRDEAGNSQLYQLYFCVDAAGDSFVDCPVLPSGRPCGNRIEFPAF

SEQ ID NO: 1213 - protein, 701 aa, Zea mays
MRLSSSLQDLPTFTRIDALERGSSVGSDLSSGRPKPVRMLQRDGAVASFSKERTPPSSPTNRKKCMRAAGCAIALILLVFFAYGSWRYFHVFLSEGRSEYYVVLDCGSTGTRVYVYEWHINHNDANAFPIVLKPLGNAPKKKSGKLTRLYQRMETEPGLSKLVHNESGLKKAIEPLLQMAEKLIPRHAHKHTPLFLYATAGVRKLPSADSEWLLDKSWDILNNSSFLCSRDRVKIISGMDEAYYGWIALNHNMDMLGTSSSKMTYGSLDLGGSSLQVTFENDKSVQDETSIRLSIGSVEHHLSAYSLTGYGLNDAFDKSVAHLVKRLGGVASNGKVQVKHPCLQTGFKEDYICSYCHPLKQDGSPSVGEKNSGKEKQGIAVELVGAPQWNECSALAKVTVNLSEWSSASPGLDCNIHPCALASNFPRPYGQFFAISGFYVVFKFFNLTADATLGDVQKRGQEFCEKPWKVAKSSVPPQPFVEQYCFRAPYISSLLREGLQIKDSQVIIGSGSITWTHGVALLEAGQALSSRLDIQGYRILHREINPNILIVLFLISIVLVICAILCVSNSIPRSFRKSYLPIHRHNSGGSSVLGMGLPFKHLLWNPISSGDGRTKTPLSPTVAGSDPHPFAGLGGSSVELMESSRQSLGAYHSYSVGSLGQMQFSSGVRNPSRGQTTLQSRRSQSREDLSSSLADIHFPKV

SEQ ID NO: 1214 - protein, 467 aa, Saccharomyces cerevisiae
MFKSVVYSILAASLANAGTIPLGKLADVDKIGTQKDIFPFLGGAGPYYSFPGDYGISRDLPEGCEMKQLQMVGRHGERYPTVSLAKTIKSTWYKLSNYTRQFNGSLSFLNDDYEFFIRDDDDLEMETTFANSDDVLNPYTGEMNAKRHARDFLAQYGYMVENQTSFAVFTSNSKRCHDTAQYFIDGLGDQFNITLQTVSEAESAGANTLSACNSCPAWDYDANDDIVNEYDTTYLDDIAKRLNKENKGLNLTSTDASTLFSWCAFEVNAKGYSDVCDIFTKDELVHYSYYQDLHTYYHEGPGYDIIKSVGSNLFNASVKLLKQSEIQDQKVWLSFTHDTDILNFLTTAGIIDDKNNLTAEYVPFMGNTFHRSWYVPQGARVYTEKFQCSNDTYVRYVINDAVVPIETCSTGPGFSCEINDFYDYAEKRVAGTDFLKVCNVSSVSNSTELTFYWDWNTTHYNASLLRQ

SEQ ID NO: 1215 - protein, 533 aa, Glycine max
MAGELGVLNALDVAKTQWYHFTAIVIAGMGFFTDAYDLFCISLVTKLLGRLYYTEPGAPKPGSLPPRVQASVTGVALCGTLAGQLFFGWLGDKMGRKRVYGLTLILMVVCSLASGLSFGSTPEGVMASLCFFRFWLGFGIGGDYPLSATIMSEYANKKTRGAFIAAVFAMQGFGILAGGVVALIVSYAYDQKYKLPSYEQNPEASLDPAFDYVWRIVLMFGAVPAALTYYWRMKMPETARYTALVAKNAKQAAADMSKVLQVELEAEEEKVKKLTENESNKYGLFTKEFVKRHGLHLLGTTTTWFLLDIAFYSQNLFQKDIFSAIGWIPPAKEMNAIHEVYKIARAQTLIALCSTVPGYWFTVALIDYMGRFAIQLLGFFFMTVFMFALAIPYDHWSEKENRIGFVVMYSFTFFFANFGPNSTTFVVPAEIFPARLRSTCHGISAAAGKAGAIVGAFGFLYAAQSKDPSKTDAGYPTGIGIKNSLIMLGVINFIGMLFTLLVPESKGKSLEELSGENGENDAEHAVSARTVPV

SEQ ID NO: 1216 - protein, 541 aa, Zea mays
MARGGDGLQVLSALDAAKTQWYHFTAIIVAGMGFFTDAYDLFCISLVTKLLGRIYYTDTSKDNPGSLPPNVAAAVNGVAFCGTLAGQLFFGWLGDKLGRKSVYGMTLMLMVICSVASGLSFGHTPTGVMATLCFFRFWLGFGIGGDYPLSATIMSEYANKKTRGAFIAAVLAMQGFGILAGGIVTLVISAAFRAGYPAPAYRDDHFNSTVPQADYVWRIILILGAAPAMLTYYWRMKMPETARYTALVAKNAKQAAADMSRVLQTEIVDEQEKLDEMVTAESNTFGLFSREFARRHGLHLVGTSTTWFLLDIAFYSQNLFQKDIFTSINWIPKANTMSALEEVFRISRAQTLIALCGTVPGYWFTVALIDVVGRFAIQLLGFFMMTVFMLGLAIPYHHWTTPGNHIGFVVMYAFTFFFANFGPNSTTFIVPAEIFPARLRSTCHGISAASGKAGAIIGAFGFLYAAQNQDKSKADAGYPAGIGVRNSLFVLAASNLLGFILTFLVPESKGKSLEEMSGEADDAEDDAVGTRAVRPSGTQMV

SEQ ID NO: 1217 - protein, 429 aa, Xylella fastidiosa
MSDLDKVTLNAGETSLVLPVLKPTLGNGCVDIAKLTKETGLFTYDSGFTATASCKSAITYIDGEKGVLLYRGYPIEQLAEHSSFLEVAYLLMNGELPRKDEFAKFDDEITHHTMMHESLKNFLGGFHYDAHPMAMLAASVASLSAFYHDTLDLNDLEQRRLAAIRLIAKVPTLAAAAHRYSIGWPIRYPRNNLGYVERFLHMMFEVPSEPLQLNPVVTKALDLLFILHADHEQNASTSTVRLVGSTGANPYASVAAGITALWGPAHGGANEAVLKMLEEIGDAKNVDLVIAKAKTKDKNSPFRLMGFGHRVYKHFDPRAKIIREMAHTVLGELGVNDPLLEVALKLEEAALKDDYFVQRKLYPNVDFYSGIIYKAINIPLEMFTVMFAIARTAGWVSHWLEQQVDPEMKISRPRQIYTGHGERDYKDAR

SEQ ID NO: 1218 - protein, 427 aa, Escherichia coli
MADTKAKLTLNGDTAVELDVLKGTLGQDVIDIRTLGSKGVFTFDPGFTSTASCESKITFIDGDEGILLHRGFPIDQLATDSNYLEVCYILLNGEKPTQEQYDEFKTTVTRHTMIHEQITRLFHAFRRDSHPMAVMCGITGALAAFYHDSLDVNNPRHREIAAFRLLSKMPTMAAMCYKYSIGQPFVYPRNDLSYAGNFLNMMFSTPCEPYEVNPILERAMDRILILHADHEQNASTSTVRTAGSSGANPFACIAAGIASLWGPAHGGANEAALKMLEEISSVKHIPEFVRRAKDKNDSFRLMGFGHRVYKNYDPRATVMRETCHEVLKELGTKDDLLEVAMELENIALNDPYFIEKKLYPNVDFYSGIILKAMGIPSSMFTVIFAMARTVGWIAHWSEMHSDGMKIARPRQLYTGYEKRDFKSDIKR

SEQ ID NO: 1219 - protein, 472 aa, Oryza sativa
MAFFRGLTAVSRLRSRVAQEATTLGGVRWLQMQSASDLDLKSQLQELIPEQQDRLKKLKSEHGKVQLGNITVDMVLGGMRGMTGMLWETSLLDPDEGIRFRGLSIPECQKVLPTAVKDGEPLPEGLLWLLLTGKVPTKEQVDALSKELASRSSVPGHVYKAIDALPVTAHPMTQFTTGVMALQVESEFQKAYDKGMSKSKFWEPTYEDCLNLIARLPAVASYVYRRIFKGGKTIAADNALDYAANFSHMLGFDDPKMLELMRLYITIHTDHEGGNVSAHTGHLVGSALSDPYLSFAAALNGLAGPLHGLANQEVLLWIKSVIGETGSDVTTDQLKEYVWKTLKSGKVVPGFGHGVLRKTDPRYTCQREFALKYLPEDPLFQLVSKLYEVVPPILTELGKVKNPWPNVDAHSGVLLNHFGLSEARYYTVLFGVSRSIGIGSQLIWDRALGLPLERPKSVTMEWLENHCKKVAA

SEQ ID NO: 1220 - protein, 503 aa, Zea mays
MDRADPARGRLAVLSSHLRGAGAEEAAGLERSPVSAPAPGPRAGALAVVDGRTGKRHEVKVSEDGTVRATDFKKITTGKDDKGLKIYDPGYLNTAPVRSSICYIDGDEGILRYRGYPIEELAESSSFVEVAYLLMYGNLPTQSQLAGWEFAISQHSAVPQGLLDIIQSMPHDAHPMGVLASAMSTLSVFHPDANPALQGQDLYKSKQVRDKQIVRVLGKAPTIAAAAYLRLAGRPPVLPLNTLSYSENFLYMLDSLGDRTYKPNPRLARALDILFILHAEHEMNCSTAAVRHLASSGVDVFTALSGGVGALYGPLHGGANEAVLKMLNEIGSMENIPDFIVGVKNRKRKMSGFGHRVYKNYDPRAKVIRKLADEVFSIVGRDPLIEVAIALEKAALSDEYFIKRKLYPNVDFYSGLIYRAMGFPTEFFPVLFAIPRMGGWLAHWKESLDDPDTKIIRPQQVYTGFWLRHYTPVRERVLSSQSEELGQVATSNATRRRRAGSAL

SEQ ID NO: 1221 - protein, 513 aa, Glycine max
MSKTTTSSEQTARNRLATLAAHLLPSDATSAAAILHPHRLSAPTGDLPPANLKGTLTVVDERTGKKYQIEVTPDGTVRASDFKKISSGKNDKGLKLYDPGYLNTAPVISRISYIDGDAGILRYRGYPIEDLAEKSTFTEVSYLILYGNLPSESQLAEWEFALSQHSAVPQGVLDMIESMPHDAHPMGMLVNAMSALSVFHPDANPALKGLDIYNSKQVRDKQIARVIGKITTIAAAINLRLAGRPPVLPSNKLSYTENFLYMLDSFGNRSYKPNPRLTRALDIIFVLHAEHEMNCSTSAVRHLSSSGVDVYTAIAGAVGALYGPLHGGANEAVLKMLSEIGTVENIPAFIEGVKARKRKLSGFGHRVYKNYDPRAKVLRKLTEEVFSIVGRDPLIEIAVALEKIALSDEYFIKRKLYPNVDFYSGLIYRAMGFQPEFFTVLFAIPRMAGYLAHWRESLDDPDTKIMRPQQVYVGEWLRHYAPINQRTASSNTDKLGQLAVSNASKRRLAGSGA

SEQ ID NO: 1222 - protein, 339 aa, Oryza sativa
MARRSSSRACAAMATAAVFALLAATATASGLVRVEHPAKSDGSLSLLVVGDWGRKGTYNQSRVAEQMGKVGEKLNIDFVISTGDNFYEDGLTGVDDQAFEESFTDIYTAKSLQKPWYLVLGNHDYRGDVLAQLSPVLRKIDQRFICMRSFIVNAEIVDFFFIDTTPFQLKYWTRPKDHHYDWRGVAPRQKYITNLLKDMDEAMKKSTAKWKIAVGHHTIRSVSDHGDTKELLQLLLPVLKVNGIDFYINGHDHCLEHISSRDSPIQYFTSGGGSKAWRGVLQPNSDKLQFFYDGQGFMSLQINQDQADFIFYDVSGNILYKWSKSKANYLQPSTYITEA

SEQ ID NO: 1223 - protein, 348 aa, Zea mays
MAPPAHDRLRRLVLLLVVATAAAALLLAPTTADAALPRVQHTPTKADGSLAILVVGDWGRRGQFNQTLVAQQMGVVGQKLDIDFVISTGDNIYDDGIANTSDPLFKESFSNIYTANSLQKPWYLVLGNHDYTGNALAQLDPAIRKVDSRYTAIAKSFIVNSGVADFFLVDTTPFIVHYWNNTKFDWRGVAPRDTYIANLLKDLKCALTASKAPWKIVVGHHPISSACGHGNNTELEELLLPVLRTHGVDMYLNGHDHCLQRVSSRDSRLQLLTSGGGSKAWAGKFKPTLDKVEFLYDGQGFMSMRLSRTEARLAFFDVAGSVLHCWTMHAQKLKTTTTTTAAAAAAGH

SEQ ID NO: 1224 - protein, 256 aa, Oryza sativa
MKLAVVAVAALLLAAGVASADEFDFFYLVQQWPGSFCDTQAGCCFPDTGKPAAEFGIHGLWPNYAKCRPAAGAVADDDDGVVEMVVDGGAAVERHHRRRQKCWPEYCDDGNKLRPWEIKDLVAELDANWPTLSCKGGKSFEFWSYEWKKHGTCSGMGQHGYFAAALELKKRHDLAAVLAGAGIVPSDDESYSLGSIRDAIAAATGAVPNLECNRDAAGETQLFQVYQCVDRSGKKLVDCQLPMQGKCRDKVKLPTF

SEQ ID NO: 1225 - protein, 278 aa, Zea mays
MTMATKAACVLAVWVLVASGLCDLGSARAPLGSKPQREFDYFALSLQWPGTICASTRHCCATNGCCRSEPLQTFTIHGLWPDYDDGTWPSCCRRTQFEMDKILPLKEVLDKYWPSLYCSKSGTCFSGKGLFWAHEWEKHGTCSAPVVQDELQYFTLALDLYSKYNVTEMLSSGGIQVSNGKEYALSDVIDTIKHAFGGSPQIVCKRGSIEELRLCFDKELKPRDCLTTSLANGSVSKSKHCPRYITLPTYDPLVLANSTVEIMTQFDEFDVPAALYTA

SEQ ID NO: 1226 - protein, 252 aa, Zea mays
MASCRMALLLGLLLLVVASPAIADDDSGIYYQLALMWPGAYCEQTSAGCCKPTTGVSPARDFYITGFTVLNATTDAAVTGCSNKVPYDPNLITGIQGLNQYWSNIRCPSNNGQSSWKNAWKKAGACSGLSEKDYFETALSFRSRINPLVRLKAKGIEPDFGLYGLKAITKVFKSGINATPVIQCSKGPFDKYMLFQLYFCAAGNGTFIDCPAPQQYTCSKEILFHPFKKWMLKQQLNQDDDPFQLPGVAMDN

SEQ ID NO: 1227 - protein, 229 aa, Zea mays; identical to SEQ ID NO: 1212

SEQ ID NO: 1228 - protein, 449 aa, Zea mays
MRKFNLMQSQKSRVLGAMSSSLPILPNPLKGSFPRPHNPQHIPMLRQLPDDSMPLCIDTHQSVSLHPRAGVIGVPYSGYTASPLDSVSNLDSQTMAAPFISQSSNFEALQSLSDNTPETHTKAAWFTSSMDVSPLNTDNIAASDVNQIHSIRPAMTSDESATQNDWWADIMNDDWKDILDATATDSHSKAMIQISNSATSLPAVNQSASSHSREICPVASPPNSSNASVAKQRMRWTPELHECFVDAVNQLGGSEKATPKGVLKLMKVDGLTIYHVKSHLQKYRTARYKPDLSEGTSEKRTATEELVLDLKTSMDLTEALRLQMEVQKRLHEQLEIQRKLQLRIEEQGKYLQMMFEKQSQSSTEKVQDPSSRDTTAKPSSNQSQSTNKDSGATMDPNGTGDIARTAELGERSSELGVKQKLVEIESGTEVATGDRSKIYQEKRRKLQDS

SEQ ID NO: 1229 - protein, 416 aa, Zea mays
MERLSTNQLYSSGVPVTVPTSLPCIPVSLDESFPRLPDAQSVLMERELRSTPLPPHQTTVAPIRGLFHSNTGSVGPLCSPPSVRFSSHSNPEQYPNHNSYNSQVPSTASSSTLNYGSQYGGFEPSITDFPRDIEPTWCPDPVESILGYSGDVPAGNNLTGTTAIGASDDLTKQTEWWTEFMNEDWKDMVDNPTSTETQPVGQPVQSSNSVHQSATQQTVSSQSVEPLAVVAPSPTAGSNTGKARMRWTPELHERFVDAVNILGGSETTPKGVLKLMKADNLTIYHVKSHLQKYRTARYRPELSEGSSEKKVASKEDIPSIDLKGSFDLTEALRLQLELQKRLHEQLEIQRSLQLRIEEQGKCLQMMLEQQCIPGAEKAQDASTAADELRSPSEIPESSTLKEVPENSQNGSTKQTK

SEQ ID NO: 1230 - protein, 1131 aa, Sorghum bicolor
MSSSRPAHSSSSSSRTRQSSQARILAQTTLDAELNAEYEESGDSFDYSKLVEAQRSTPSEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMEALCNTVVKEVFELTGYDRVMAYKFHEDEHGEVFAEITKPGIEPYLGLHYPATDIPQAARFLFMKNKVRMICDCRAKSVKIIEDEALSIDISLCGSTLRAPHSCHLQYMENMNSIASLVMAVVVNENEEDDEPGPEQPPQQQKKKRLWGLIVCHHESPRYVPFPLRYACEFLAQVFAVHVNKEFELEKQIREKSILRMQTMLSDMLFKEASPLSIVSGSPNIMDLVKCDGAALLYGDKVWRLQTAPTESQIRDIAFWLSEVHGDSTGLSTDSLQDAGYPGAASLGDMICGMAVAKITSKDILFWFRSHTAAEIKWGGAKHDPSDKDDNRRMHPRLSFKAFLEVVKMKSLPWSDYEMDAIHSLQLILRGTLNDALKPVQASGLDNQIGDLKLDGLAELQAVTSEMVRLMETATVPILAVDGNGLVNGWNQKVAELSGLRVDEAIGRHILTLVEDSSVSIVQRMLYLALQGKEEKEVRFELKTHGSKRDDGPVILVVNACASRDLHDHVVGVCFVAQDMTVHKLVMDKFTRVEGDYKAIIHNPNPLIPPIFGADQFGWCSEWNVAMTKLTGWHRDEVIDKMLLGEVFDSSNASCLLKSKDDFVRLCIIINSALAGEEAENAPFGLFDRNGKYIECLLSVNRKVNADGVVTGVFCFIHVPSDDLQHALHVQQASEQTAQRRLKAFSYMRHAINKPLSGMLYSRETLKSTGLNEEQMRQVHVADSCHRQLNKILADLDQDNITDKSSCLDLDMAEFVLEDVVVSAVSQVLIGCQGKGIRVACNLPERFMKQKVYGDGIRLQQILSDFLFVSVKFSPVGGSVDISSKLTKNSIGENLHLIDFELRIKHQGAGVPAEILSQMYEEDNKEPSEEGLSLLVSRNLLRLMNGNIRHIREAGMSTFILTAELAAAPSAVGQ

SEQ ID NO: 1231 - protein, 1171 aa, Oryza sativa
MASGSRATPTRSPSSARPAAPRHQHHHSQSSGGSTSRAGGGGGGGGGGGGGAAAAESVSKAVAQYTLDARLHAVFEQSGASGRSFDYTQSLRASPTPSSEQQIAAYLSRIQRGGHIQPFGCTLAVADDSSFRLLAYSENTADLLDLSPHHSVPSLDSSAVPPPVSLGADARLLFAPSSAVLLERAFAAREISLLNPLWIHSRVSSNPFYAILHRIDVGVVIDLEPARTEDPALSIAGAVQSQKLVVRAISRLQALPGGDVKLLCDTVVEHVRELTGYDRVMVYRFHEDEHGEVVAESRRSNLEPYIGLHYPATDIPQASRFLFRQNRVRMIADCHAAPVRVIQDPALTQPLCLVGSTLRSPHGCHGQYMANMGSIASLVMAVIISSGGDDDHNIARGSIPSAMKLWGLVVCHHTSPRCIPFPLRYACEFLMQAFGLQLNMELQLAHQLSEKHILRTGTLLCDMLLRDSPTGIVTQSPSIMDLVKCDGAALYYHGKYYPLGVTPTEVQIKDIIEWLTMCHGDSTGLSTDSLADAGYSGAADLGDAVSGMAVAYITPSDYLFWFRSHTAKEIKWGGAKHHPEDKDDGQRMHPRSSFKAFLEVVKSRSLPWENAEMDAIHSLQLILRDSFRDSAEGTSNSKAIVNGQVQLGELELRGIDELSSVAREMVRLIETATVPIFAVDTDGCINGWNAKVAELTGLSVEEAMGKSLVNDLIFKESEETVNKLLSRALRGDEDKNVEIKLKTFGPEQSKGPIFVIVNACSTRDYTKNIVGVCFVGQDVTGQKVVMDKFINIQGDYKAIVHNPNPLIPPIFASDENTCCSEWNTAMEKLTGWSRGEVVGKLLVGEVFGNCCRLKGPDALTKFMIVLHNAIGGQDCEKFPFSFFDKNGKYVQALLTANTRSRMDGEAIGAFCFLQIASPELQQAFEIQRHHEKKCYARMKELAYIYQEIKNPLNGIRFTNSLLEMTDLKDDQRQFLETSTACEKQMSKIVKDASLQSIEDGSLVLEKGEFSLGSVMNAVVSQVMIQLRERDLQLIRDIPDEIKEASAYGDQYRIQQVLCDFLLSMVRFAPAENGWVEIQVRPNIKQNSDGTDTMLFPFRFACPGEGLPPEIVQDMFSNSRWTTQEGIGLSICRKILKLMGGEVQYIRESERSFFHIVLELPQPQQAASRGTS

SEQ ID NO: 1232 - protein, 1178 aa, Sorghum bicolor
MASGSRATPTRSPSSARPEAPRHAHHHHHHHSQSSGGSTSRAGGGGGGGGGGGGTAATATATATESVSKAVAQYTLDARLHAVFEQSGASGRSFDYSQSLRAPPTPSSEQQIAAYLSRIQRGGHIQPFGCTLAVADDSSFRLLAFSENAADLLDLSPHHSVPSLDSAAPPPVSLGADARLLFSPSSAVLLERAFAAREISLLNPLWIHSRVSSKPFYAILHRIDVGVVIDLEPARTEDPALSIAGAVQSQKLAVRAISRLQALPGGDIKLLCDTVVEHVRELTGYDRVMVYRFHEDEHGEVVAESRRDNLEPYLGLHYPATDIPQASRFLFRQNRVRMIADCHATPVRVIQDPGMSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPWENAEMDAIHSLQLILRDSFRDAAEGTSNSKAIVNGQVQLGELELRGINELSSVAREMVRLIETATVPIFAVDTDGCINGWNAKIAELTGLSVEEAMGKSLVNDLIFKESEEIVEKLLSRALRGEEDKNVEIKLKTFGSEQSNGAIFVIVNACSSRDYTQNIVGVCFVGQDVTGQKVVMDKFINIQGDYKAIVHNPNPLIPPIFASDENTSCSEWNTAMEKLTGWSRGEVVGKFLIGEVFGSFCRLKGPDALTKFMVVIHNAIGGQDYEKFPFSFFDKNGKYVQALLTANTRSKMDGKSIGAFCFLQIASAEIQQAFEIQRQQEKKCYARMKELAYICQEIKNPLSGIRFTNSLLQMTDLNDDQRQFLETCSACEEQMSKIVKDATLQSIEDGSLVLEKSEFSFGDVMNAVVSQAMLLLRERDLQLIRDIPDEIKDASAYGDQFRIQQVLADFLLSMVRSAPSENGWVEIQVRPNVKQNSDGTDTELFIFRFTYPGEGLPADIVQDMFSNSQWSTQEGVGLSTCRKILKLMGGEVQYIRESERSFFLIVLELPQPRPAADREIS

SEQ ID NO: 1233 - protein, 1137 aa, Oryza sativa
MSSSRSNNRATCSRSSSARSKHSARVVAQTPMDAQLHAEFEGSQRHFDYSSSVGAANRSGATTSNVSAYLQNMQRGRFVQPFGCLLAVHPETFALLAYSENAAEMLDLTPHAVPTIDQREALAVGTDVRTLFRSHSFVALQKAATFGDVNLLNPILVHARTSGKPFYAIMHRIDVGLVIDLEPVNPVDLPVTATGAIKSYKLAARAIARLQSLPSGNLSLLCDVLVREVSELTGYDRVMAYKFHEDEHGEVIAECKRSDLEPYLGLHYPATDIPQASRFLFMKNKVRMICDCSATPVKIIQDDSLTQPISICGSTLRAPHGCHAQYMASMGSVASLVMSVTINEDEDDDGDTGSDQQPKGRKLWGLMVCHHTSPRFVPFPLRYACEFLLQVFGIQINKEVELAAQAKERHILRTQTLLCDMLLRDAPVGIFTQSPNVMDLVKCDGAALYYQNQLWVLGSTPSEAEIKNIVAWLQEYHDGSTGLSTDSLVEAGYPGAAALGDVVCGMAAIKISSKDFIFWFRSHTAKEIKWGGAKHEPIDADDNGRKMHPRSSFKAFLEVVKWRSVPWEDVEMDAIHSLQLILRGSLQDEDANKNNNAKSIVTAPSDDMKKIQGLLELRTVTNEMVRLIETATAPILAVDITGSINGWNNKAAELTGLPVMEAIGKPLVDLVIDDSVEVVKQILNSALQGIEEQNLQIKLKTFNHQENNGPVILMVNACCSRDLSEKVVGVCFVAQDMTGQNIIMDKYTRIQGDYVAIVKNPSELIPPIFMINDLGSCLEWNEAMQKITGIKREDAVDKLLIGEVFTHHEYGCRVKDHGTLTKLSILMNTVISGQDPEKLLFGFFNTDGKYIESLMTATKRTDAEGKITGALCFLHVASPELQHALQVQKMSEQAAMNSFKELTYIRQELRNPLNGMQFTRNLLEPSDLTEEQRKLLASNVLCQEQLKKILHDTDLESIEQCYTEMSTVDFNLEEALNTVLMQAMPQSKEKQISIDRDWPAEVSCMHLCGDNLRLQQVLADFLACTLQFTQPAEGPIVLQVIPRMENIGSGMQIAHLEFRLVHPAPGVPEALIQEMFRHSPGASREGLGLYISQKLVKTMSGTVQYLREAESSSFIVLVEFPVAQLSTKRCKASTSKF

SEQ ID NO: 1234 - protein, 1135 aa, Sorghum bicolor
MSSPLNNRGTCSRSSSARSRHSARVVAQTPVDAQLHAEFESSQRNFDYSSSVSAAIRPSVSTSTVSTYHQTMQRGLYIQPFGCLLAVHPDTFTLLAYSENAPEMLDLTPHAVPTIDQRDALAVGADVRTLFRSQSSVALHKAATFGEVNLLNPILVHARTSGKPFYAILHRIDVGLVIDLEPVNPVDVPVTAAGALKSYKLAAKAISRLQSLPSGNLSLLCDVLVREVSELTGYDRVMAYKFHEDEHGEVISECRRSDLEPYLGLHYPATDIPQASRFLFMKNKVRMICDCSATLVKIIQDDSLAQPLSLCGSTLRASHGCHAQYMANMGSVASLVMSVTISNDEEEDVDTGSDQQPKGRKLWGLVVCHHTSPRFVPFPLRYACEFLLQVFGIQLNKEVELAAQAKERHILRTQTLLWDMLLRDAPVGIFTQSPNVMDLVKCDGVALYYQNQLLLLGSTPSESEIKSIATWLQENHDGSTGLSTDSLVEAGYPGAAALREVVCGMAAIKISSKDFIFWFRSHTTKEIKWGGAKHEPVDADDNGRKMHPRSSFKAFLEVVKWRSVPWEDVEMDAIHSLQLILRGSLQDEDANRNNVRSIVKAPPDDTKKIQGLLELRTVTNEMVRLIETATAPVLAVDIAGNINGWNNKAAELTGLPVMEAIGRPLIDLVVVDSIEVVKRILDSALQGIEEQNLEIKLKAFHEQECNGPIILMVNSCCSRDLSEKVIGVCFVGQDLTTQKMIMDKYTRIQGDYVAIVKNPSELIPPIFMINDLGSCLEWNKAMQKITGIQREDVIDKLLIGEVFTLHDYGCRVKDHATLTKLSILMNAVISGQDPEKLLFGFFDTDGKYIESLLTVNKRINAEGKITGAICFLHVASPELQHALQVQKMSEQAATNSFKELTYIHQELRNPLNGMQFTCNLLEPSELTEEQRKLLSSNILCQDQLKKILHDTDLESIEQCYMEMNTVEFNLEEALNTVLMQGIPLGKEKRISIERDWPVEISRMYLYGDNLRLQQVLADYLACALQFTQPAEGPIVLQVIPKKENIGSGMQIAHLEFRIVHPAPGVPEALIQEMFRHNPEVSREGLGLYICQKLVKTMSGTVQYLREADTSSFIILIEFPVAQLSSKRSKPSTSKF

SEQ ID NO: 1235 - protein, 213 aa, Oryza sativa
MATEEDASTMAAAEADPKPAATPSYPEMILAAIEALDDRNGSNKTAISQHIEGKYEGLLPPAHPSLLTAHLARMKQTGELAFSKNNYFRGDDPSLPPKRGRGRPPKPKDAAAAAAAPAPAPAAPAASSPRPRGRPPKPKDPLAEAVAKATSGMPRARGRPPKKAKVEQEDPIGAPAAASAPAAAAEAAPPVKRGRGRPPKVRPAAPVGEPAAA

SEQ ID NO: 1236 - protein, 737 aa, Oryza sativa
MQQHQGGGSQYGAVPPDMGPFSPTHHASAPAPLPLSTATAAALSQPPPPQQQQQQPRTSYDELAAATSAGAGGFPDDDMLGDAGGSGGGGGSGAAGNRWPREETLALIRIRSEMDATFRDATLKGPLWEEVSRKLAELGYKRSAKKCKEKFENVHKYYKRTKEGRAGRQDGKSYRFFTELEALHAAAPQTPQPQQQQQQQLPPVTSSAPAMHAFAPPVPAPPPMSAMPPPPGPIQPAPISSAAPAVPLELPPQPPINLQGLSFSSMSGSESDDESEDDEMTAETGGSQDRLGKRKQAPAAKGWRLSSRGSSSKSSTGRRRCSGGFWRLWRSERRTHGREEAWRRQEVARLNREQEQLAQERAAAASRDAAIISFLQRIGGQSVQVPPAATVIQMPTPVQLQTPPPVKQPARQHQPQPTPPPPQAAPIPAAPLQQQPPQPQHKETIHHEAVTPRRAPPTSGSSLELVPAAEQHVESGLGGGEGGSASSSRWPKTEVQALIQLRMELDMRYQETGPKGPLWEEISSGMRRLGYNRSSKRCKEKWENINKYFKKVKESNKKRPEDSKTCPYFHQLDVIYRRKHLTGGGGGGASAANVAATAIEHQNPNRHEIEGKNINDNDKRKNGGGGGAQVPTSNGDTAPTTATFDVDSGMKKPEDIVRELSEQPPREFTTDETDSDDMGDDYTDDGEEGEDDGKMQYRIQFQRPNPGGANTAPPPATTPASAVPTSTPTSTFLAMVQ

SEQ ID NO: 1237 - protein, 328 aa, Synechocystis PCC6803
MSENFAVATPVRVGIVGTGYAAQRRAEVFRGDRRSQLVSFWGNSEANTAKFADTFGVRPQQSWQALINDPEIDLVLIATINQLHGAIAEAALQAGKHVVLEYPLALTYAMGKKLQQLAREKGKLLHVEHIELLGGVHQAIRQNLGKIGEVFYARYSTIMGQNPAPQRWTYHHQQFGFPLVAALSRISRFTDLFGTVQQVDAQCRFWDQPNPEYFRACLATAYLQFNNGLKAEVIYGKGEVFHQNERIFTLHGDRGTLIFVGETGRLIQGQTETEITVGSRRGLFRQDTEAVLDYLTTGKPLYVDLEASLYALEVADLCAQACGYKVEN

SEQ ID NO: 1238 - protein, 1128 aa, Oryza sativa
MSSSRPTQCSSSSSRTRQSSRARILAQTTLDAELNAEYEEYGDSFDYSKLVEAQRTTGPEQQARSEKVIAYLHHIQRAKLIQPFGCLLALDEKTFNVIALSENAPEMLTTVSHAVPSVDDPPKLRIGTNVRSLFTDPGTTALQKALGFADVSLLNPILVQCKTSGKPFYAIVHRATGCLVVDFEPVKPTEFPATAAGALQSYKLAAKAISKIQSLPGGSMEVLCNTVVKELFDLTGYDRVMAYKFHEDDHGEVFAEITKPGLEPYLGLHYPATDIPQAARFLFMKNKVRMICDCRARSIKIIEDESLHLDISLCGSTLRAPHSCHLQYMENMNSIASLVMAVVVNENEDDDEVGADQPAQQQKRKKLWGLLVCHHESPRYVPFPLRYACEFLAQVFAVHVNKEFELERQVREKSILRMQTMLSDMLLRESSPLSIVSGTPNIMDLVKCDGAALLYGGKVWRLQNAPTESQIRDIAFWLSDVHRDSTGLSTDSLHDAGYPGAAALGDMICGMAVAKINSKDILFWFRSHTAAEIRWGGAKHDPSDKDDSRRMHPRLSFKAFLEVVKMKSLPWNDYEMDAIHSLQLILRGTLNDDIKPTRAASLDNQVGDLKLDGLAELQAVTSEMVRLMETATVPILAVDSNGLVNGWNQKVAELTGLRVDEAIGRHILTVVEESSVPVVQRMLYLALQGKEEKEVKFEVKTHGSKRDDGPVILVVNACASRDLHDHVVGVCFVAQDMTVHKLVMDKFTRVEGDYKAIIHNPSPLIPPIFGADEFGWCSEWNAAMTKLTGWHRDEVINKMLLGEVFDSTNASCLVKNKDAFVSLCILINSALAGDETEKAPFSFFDRNGKYIECLLSVNRKVNADGVITGVFCFIQVPSHELQHALHVQQASQQNALTKLKAYSYMRHAINNPLSGMLYSRKALKNTGLNEEQMKEVNVADSCHRQLNKILSDLDQDSVMNKSSCLDLEMVEFVLQDVFVAAVSQVLITCQGKGIRVSCNLPERYMKQTVYGDGVRLQQILSDFLFVSVKFSPVGGSVEISCSLTKNSIGENLHLIDLELRIKHQGKGVPADLLSQMYEDDNKEQSDEGMSLAVSRNLLRLMNGDVRHMREAGMSTFILSVELASAPAK

SEQ ID NO: 1239 - protein, 222 aa, Zea mays
METMSALARTAPPLAGTIRRPSCALRPTASLSFAAASTTPRGRLGLGLSTAPAGSGRAARARAVPRRIVASSEVEQSYIMIKPDGVQRGLVGEIISRFEKKGFLLKGLKLFQCPKDLAQEHYKDLKDKPFFPKLIDYITSGPVVCMAWEGDGVVASARKLIGATNPLQAEPGTIRGDLAVQTGRNVVHGSDSPDNGKREIELWFKEGEVCQWESVQAPWLIE

SEQ ID NO: 1240 - protein, 238 aa, Zea mays
MSAASKKLFQAARSLVLSASNRSVLAAEGRTAALATLTNFGRKTLPTAYLSYHKQGSHHAASGWGAIAAAVPAAVYMLQDQEAHAAEMERTFIAIKPDGVQRGLISEIMSRFERKGYKLVAIKLIVPSKEFAEKHYHDLKERPFFSGLCDFLSSGPVLAMVWEGEGVIKYGRKLIGATDPQKSEPGTIRGDLAIVVGRNIIHGSDGPETAKDEIALWFEPKELVSYTSNAEKWIYGVN

SEQ ID NO: 1241 - protein, 149 aa, Zea mays
MESTFIMIKPDGVQRGLIGEIISRFEKKGFYLKALKLVNVERSFAEKHYAGSRLQALLPGLVDYIISGPVVAMVWEGKSVVTTGRKIIGATNPLASEPGTIRGDFAVDIGRNVIHGSDSIESANKEIALWFPEGPADWQSSQHPWIYEK

SEQ ID NO: 1242 - protein, 149 aa, Zea mays
MEQTFIMIKPDGVQRGLIGDIISRFEKKGFYLKGMKFMNVERSFAQQHYADLSDKPFFPGLVEYIISGPVVAMVWEGKDVVLTGRRIIGATRPWEAAPGTIRGDYAVEVGRNVIHGSDSVENGKKEIALWFPEGVAQWKSNLHPWIYEA

SEQ ID NO: 1243 - protein, 625 aa, Oryza sativa
MKREYQEAGGSSGGGSSADMGSCKDKVMAGAAGEEEDVDELLAALGYKVRSSDMADVAQKLEQLEMAMGMGGVSAPGAADDGFVSHLATDTVHYNPSDLSSWVESMLSELNAPLPPIPPAPPAARHASTSSTVTGGGGSGFFELPAAADSSSSTYALRPISLPVVATADPSAADSARDTKRMRTGGGSTSSSSSSSSSLGGGASRGSVVEAAPPATQGAAAANAPAVPVVVVDTQEAGIRLVHALLACAEAVQQENFAAAEALVKQIPTLAASQGGAMRKVAAYFGEALARRVYRFRPADSTLLDAAFADLLHAHFYESCPYLKFAHFTANQAILEAFAGCHRVHVVDFGIKQGMQWPALLQALALRPGGPPSFRLTGVGPPQPDETDALQQVGWKLAQFAHTIRVDFQYRGLVAATLADLEPFMLQPEGEADANEEPEVIAVNSVFELHRLLAQPGALEKVLGTVHAVRPRIVTVVEQEANHNSGSFLDRFTESLHYYSTMFDSLEGGSSGQAELSPPAAGGGGGTDQVMSEVYLGRQICNVVACEGAERTERHETLGQWRNRLGRAGFEPVHLGSNAYKQASTLLALFAGGDGYRVEEKEGCLTLGWHTRPLIATSAWRVAAA

SEQ ID NO: 1244 - protein, 178 aa, Zea mays
MAGATTPASGALVRLCLPSLLLFLYRCEAVEMERTLAMIKPDGLSGKYTEAIKEVILDSGFHIVKETEVQLDAERASVFYAEHSQRSFFDSLVKYITSGPVLAMVLERPDAVAQWRTLIGPTDAKKAKTSHPNSIRAMCGLDSEKNCVHGSDSPESADREISFFFGEAESVTVEHDEL

SEQ ID NO: 1245 - protein, 752 aa, Zea mays
MDSSGEELLKKIRELEVGQAQLKQEMSKLIPGAGERRRSQSVSPRRGVPVPPPPPAKAKAGAPGRRLSGGFEGGQRAWARGSASFPHSSPLQREGRAGAGDASTSARLPERQYSRVLQSMGQSVHILDLDGRIIYWNQSAENLFGYPASEALGQDALMLLVDSHDHNAVNNIFQRISMGESWTGKFPVKNKQGHRFSAVATNTPFYDEDGSLMGFICVSSDSRQLEQIFCKPPTSARSQSESSMTSCDGSCSNTSHRINSLNRSSFDSNLPLQSTLASKITNLATKVTNKVRSRVRTDENDDGGSGESHCLDRGAKEEPTSSGTSTPRGDAPHGPFATEENSPGKSTNPNSDESEGKVGLHKILGSKAEALLNKKGISWPWKGRENEGPDERNHVILPWLHGGQENGVNHQKVSDSSISPDAQGAEHNQPSKNEASGSWSSFNNNSTGSASSTGSTNSSALYKVDHEADCLDYEILWEDLVIGEQIGQGSCGTVYHALWYGSDVAVKVFSKQEYSEEVILTFRQEVSLMKKLRHPNILLFMGAVMSPQRLCIVSEFLPRGSLFRLLQRSATKLDVRRRVHMALDIVRGMNYLHHSSPPIIHRDLKSSNLLVDKNWIVKVADFGLSRLKRETFLTTKTGKGTPQWMAPEVLRNEPSDEKSDVYSYGVILWELVTQKIPWENLNSMQVIGAVGFMNQRLDIPSEVDPQWKSIILSCWESDPQQRPSFQELLERLRELQRHYAIQHRNTKNSIEE

SEQ ID NO: 1246 - protein, 170 aa, Zea mays
MAPQGRRATRRYGGVPEMGGASASASSGAGADERPKGEDGKQGQVAAGAQPPAGGKKRGRTAGDKEQNRLKRLLRNHVSAQQARERKKAYLTELEAKAKGLELRNAELEQRVSTLQNENNTLRQVIDVSGKEFKFTWASGRGELCDIYEERQSGEDGNGLLLECGSTWRK

SEQ ID NO: 1247 - protein, 545 aa, Zea mays
MPIKFALENMSTQASNRSYRYPDRTQLPYHNGNPMHVGGNGNYCVQQNHDDVNYISSDDGSQSSSSRVQDFQAQFCTLDSSSANCVYPAHSSTSSQSISGSPLSQQESHSDHAYGSSPSASCITQVPTWTLKDLENVMLGPDSDIGSPDSSFLLDTALHGNNWRELLGIQTGDLRQVIVACGKAVDENAVYMDALMSELREMVSVSGEPMQRLGAYMLEGLIARLSFTGHALYKSLKCKEPVATSSELLSYMHLLYEICPFFKFGYMSANGAIAEAVKGEDIIHIIDFQIAQGSQWMTMIQALASRPGRRPYLRITGIDDSNSAHARGGGLDMVGQRLHRMAQSCGLPFEFNAVPAASHEVVFEDLCLRSGEAIVVNFAYQLHHTPDESVGIENHRDRILRMVKSLSPKVVTLVEQEANTNTAPFFLRYMETLDYYTAMFEAIDVACPRDDKKRISTEQHCVARDIVNLIACEGAERIERHEPFGKWRARLVMAGFRPYPLSPVVNRTIKTLLDSYHSHYRLEERDGILYLGWKNRKLVVSSAWC

SEQ ID NO: 1248 - protein, 594 aa, Zea mays
MDTLFRLVSLQASEQQQQQQSASYNSRSTTSSGSRSSSHQTNASYNYYYHSNSSGGGGGGQYYYGQQHPQQHQHQQYYLEPYQQEECGNTHHLYMDEDFSSSSSSRQHFHSHGAVVQPPTSSTATPTAPTPSLSTSSTAAGAAHALFEAADLSFPPDLNLDFSSPASSSGGGAASSAAVGGGGGGRWASQLLLECARAVAGRDSQRVQQLMWMLNELASPYGDVEQKLASYFLQGLFARLTASGPRTLRTLAAASDRNTSFDSTRRTALRFQELSPWSSFGHVAANGAILESFLEAAAASPEPQRLHILDLSNTFCTQWPTLLEALATRSADDTPHLSITTVVSSAPSAPTAAVQRVMREIGQRMEKFARLMGVPFSFRAVHHAGDLAGLDLDALDLRDGGATTALAINCVNSLRGVVPGGARRRDAFAASLRRLDPRVVTVVEEEADLVAFDPGAPEESGDTEAAFLKVFGEGLRFFSAYMDSLEESFPKTSNERLALERGAGRAIVDLVSCPASESMERRETAASWARRMRSSGFSPVAFSEDVADDVRSLLRRYREGWSMRDAGLDDSAAGAGVFLAWKEQPLVWASAWRP

SEQ ID NO: 1249 - protein, 542 aa, Zea mays
MSARDSNHSYKCSDDSQMPYYNNSAPVGENGRIHMAENSLGHHYSSSDIGSQRINNSNPQVFEAQYCTLESSSANGVYPAQSSTSSHSISPLSGSPLSQHDSHSDHTYSSPPSASCLTEVAGLLIKQKELENSIVGPGLDISSDCSRSLLQAHVPVRPDNWRQLLGINGGDLMQVVIACGKAVAENDVFATELLISELGHLVSVSGDPMQRLGAYMLEGIVARLSSSGSMLYKSLKCKEPTSSELMSYMHLLYEICPFYKFGYMSANGAIAEAIKGENFVHIIDFQIAQGSQWVTLLQALAARPGGPPYIRITGIDDSNSAYARGGGLDIVGRTLCDVANSCGLPFEFNAVPAASHEVELQHLAIRHGEIIAVNFAYQLHHVPDESVSTENHRDRIIRMIKSINPRVVTLVEQESNTNTAPFFPRYMETLNYYTAMFESIDVALPRDDRRRMSAEQHCVARDIVNLIACEGAERVERHELFGKWKSRFAMAGFRPYPLSSVVNNTINTLLHTYNSYYRLEERDGVLYLGWKNRVLVVSSAWC

SEQ ID NO: 1250 - protein, 630 aa, Zea mays
MKREYQDAGGSGGDMGSSKDKMMAAAAGAGEQEEEDVDELLAALGYKVRSSDMADVAQKLEQLEMAMGMGGVGGAGATADDGFVSHLATDTVHYNPSDLSSWVESMLSELNAPPAPLPPATPAPRLASTSSTVTSGAAAGAGYFDLPPAVDSSSSTYALKPIPSPVAAPSADPSTDSAREPKRMRTGGGSTSSSSSSSSSMDGGRTRSSVVEAAPPATQASAAANGPAVPVVVVDTQEAGIRLVHALLACAEAVQQENFSAAEALVKQIPMLASSQGGAMRKVAAYFGEALARRVYRFRPPPDSSLLDAAFADLLHAHFYESCPYLKFAHFTANQAILEASAGCRRVHVVDFGIKQGMQWPALLQALALRPGGPPSFRLTGVGPPQPDETDALQQVGWKLAQFAHTIRVDFQYRGLVAATLADLEPFMLQPEGDDTDDEPEVIAVNSVFELHRLLAQPGALEKVLGTVRAVRPRIVTVVEQEANHNSGTFLDRFTESLHYYSTMFDSLEGAGAGSGQSTDASPAAAGGTDQVMSEVYLGRQICNVVACEGAERTERHETLGQWRSRLGGSGFAPVHLGSNAYKQASTLLALFAGGDGYRVEEKDGCLTLGWHTRPLIATSAWRVAAAAAP

SEQ ID NO: 1251 - protein, 561 aa, Zea mays
MSFVRQADPSVSCAETTYIHKFVPPGPVFPAQRFVSGTDLLHHGPQPYNAEGYKQSGFNGTAPHAFQSFYNTDSYAESHFNEAPYSPAIFDISQQNSQSLSDNQASDLVEFDEDEMRVKLQELEHALLDDGDEIFFDLSGSINDEWNDNIKTNNEWVNTMKNIVSPDSPKEASPESSICCLDNNVGEARNPKQLLFDCAEAISENSIDEAQSIIAELRQKVAIQGEPSQRLAAYLVEGLAATLQSSGKGIYRALRCKEAPTLYQLSAMQILFEICPCFRLGFMAANYAILEACKGEDVVHIIDFDINQGSQYITLIQFLKNNSNKPRLLRITGVDDPESVHRAVGGLNVVGQRLEKLAEDCEVRFEFRAVAANIEDLTPGMLGRRPGEALIVNFAFLLHHLPDESVSIMNQRDRLLRMVKGLRPKLVTLVEQDANTNTTPFPSRFREVYDYYSALFDSLDATLPRESPDRMNVERQCLAREIVNILACEGPDRVERYEVAGKWRARMAMAGFVSSPFNSGAIDGIRSLLKSYCDKYRFEKVQDGLHFGWGDKTLVFSSAWQ

SEQ ID NO: 1252 - protein, 185 aa, Zea mays
MEDGSAPRRSTPPARRSRSAEFHNFSERRRRDKINEKLKALQELLPNCNKTDKVSMLDEAIDYLKSLQLQLQMLVMGKGMSPVVPLELQQYMHYITADPAQLPPLRPSGQQHRQFQITQANPQRQSNVESDFLSQMQNLHSSEPPQNFLRPPKLQLYTPEQRGGLPSTSHNTGWISGSSSYNFME

SEQ ID NO: 1253 - protein, 554 aa, Zea mays
MADTPTSRMVHPFGDVPRQTPKQFLYSGNPQHLCHPYQSAPDTHVVPQRCYTVRSQSHSPNNAGSQDHETHKQYTLESSAASGCSRHGSPSSQSVHAGSGSPVSHDDSHSGSTNGHGSPVSASCVTGEDPTDLKQKLKDLEAVMLGTSETDPEIVNSLEISAANQLSLEPEEWEHMVSMPRGNLKELLIACARAVERNNSYAIDLMIPELRKMVSVSGEPLERLGAYMVEGLVARLAASGSSIYKALKCKEPRSSDLLSYMHFLYEACPYFKFGYMSANGAIAEAIKGEDRIHIIDFHIAQGAQWVSLLQALAARPGGPPFVRVTGIDDSVSAYARGGGLELVGRRLTHIAGLYKVPFQFDAVAISGSEVEEEHLGVVPGEAVAVNFTLELHHIPDETVSTANHRDRILRLVKGLSPKVLTLVEQESNTNTAPFAQRFAETLDYYTAIFESIDLALPRDDRERINIEQHCLAREIVNLVACEGEERVERHEVFGKWKARLMMAGFSPSPLSALVNATIKTLLQSYSPDYKLAERDGVLYLGWKNRPLIVSSAWH

SEQ ID NO: 1254 - protein, 570 aa, Zea mays
MDLHQLLKYRLTGANVYYEFPTENNLANTPWPASPLKSEFSSSSYTPLSSQLECDNLSALSNTPDNQSSTETISAQPISPLEVDSSFKQAAILRENTQVRPDPLYTTSRHNMQHALREIETVLMAPDADDAATSTKHEIEEHKPAQLMRQRSRTWSHESRQPSPGVVRTQLASGYPTASYEFRPEKRLRELREDPQSMVKQLLTKCAEALSEERIEEFLNLVQQARGVVSITGEPIQRLGAYLLEGLVARHANSGTNIYRALKCREPESNELLSYMKILYNICPYSKFGYMAANGAIAEALRNEDRIHIIDFQIAQGTQWITLIQALAARPGGPPHVRITGIDDPVSEYARGEGLDLVGKMLKSMSEEFRIPLEFTPLPGIYATQVTKEMLDIRSGEALAVNFTLQLHHTPDESVDVNNPRDGLLRMVKGLSPKVTTLVEQESHTNTTPFLMRFTETLDYYSAMFESIDTNLPRDNKERINVEQHCLAKDIVNIIACEGKDRVERHELLGKWRSRLTMAGFRPYPLSSYVNSVIRKLLACYSDKYTLEEKDGAMLLGWKNRKLISASAWH

SEQ ID NO: 1255 - protein, 1121 aa, Zea mays
MEGAAAAEVGGGGEDVQIKGAKESGQPAAAAQQPPPLPSGSEALEMPATPLPRDMDWSEHFSFFTSPGGFAGSSEGARGLASVGLSNSESRPDSVTQRGVDHGAEERVEELTLKNCISADAAQPEASAGGSTSGGDRPAVIKGLWGNFTRMARRTSYLASRENAALSYGDIASSRAGDASSRENLATSLANNIISRNNDVSGNEAPTSRVGYVNNEFKTPFHSQQILLSPWSNQDNALKVSSFSNRILDQMRSKTVAPPSGVLGSPLKSKSKGKGVAYQRAREEIRVQANARPRDPLDKIPTIPTSIHDSVARVDMLFSTSGDVSKSHSEGTSLRELIKPGRQTMSKFEKLHLFKQILDLVDNCHAQGFTLQHLRPSYFTILSSNQVKYIGSYTTQDLPTSIKQEFAREDLVSRKRAFGHRIDYQDSNGHGNLMLKHQKVGEQGLVAVRRLANTFLTDKIRDNQIEDNDPGISRQENFSYTTREHFKFVESYGSNMSSAQHVSSSGTQQPAFELRNIEESWYKSPEELSQFKGTPPSNIYSLGVLLFELFCCSETWEMHCAAMSNLRQRILPPNFLSESPKEAGFCLWLLHPDPCSRPKAKEILGCDLINEGRDLSLLDKSPVSISEDDTESSLLLNFLSQLKEEKEMQAAKLSAELGSLQTDITEIDRRHSAGMRLSLEDMDVLPSSSLPGASVSALQGALLSGLLPASCKSSIYEERVMRNLVQLENAYYSMRSSVDTCETNVIKRPDNEALRVRENFHQRHSDSDAKGEKTDRLGCFFDGLCKYARHNRFEVRGILKNADVLSSPNVICSLSFDRDEEYFAAAGVSKKIKIFEFDALLNDRVDIHYPLVEMPSKSKLSCVCWNSYIKNYLASTDYDGTVQLWDAGSGQGFTQFTEHRKRAWSVSFSQVDPTKLASGSDDCCVKVWSINQKNSIDTIRNVANVCCVQFSPYSSRMLAFGSADYKIYCYDLRNTRIPWCTISGHGKAVSYVRFLDPETLISASTDNTLKIWDLNQTNCSGLSADSCSLTLNGHSNEKNFVGLSVHDGYITCGSETNEVFSYYKDFPMPITSHRFGSIDPITGQVTNEDNQQFVSSVCWRGKSNMVVAANSSGSIKVLELV

SEQ ID NO: 1256 - protein, 228 aa, Zea mays
MRGSGGRGTKRSRTAEVHNLSERRRRDRINEKMRALQELIPNCNKIDKASMLDEAIEYLKTLQLQVQMMAMGSGLCIPPMLLPRAMQLQIPSIAHFHHLGMGLGYGMGVLDMNSTAAVPFQPIPGAHYTCPMIPGTPPQGLGIGMPGTNTMPVFGVPGQAIHPSASSVQPFPSLAGLPVRPNLAPQVPAVMANMVQEQQQGVATQQQQSLNNEAQQKANTGDPQILQK

SEQ ID NO: 1257 - protein, 285 aa, Glycine max
MTVEKEDLGLSLSLSFPQNPPTHLHLNLVSSSPSSHNPQKPSWNDPFTSSAGSSFLRGIDVNRLPSVVDCEEEAGVSSPNSTVSSVSGKRSEREEANGEENDTDRACSRGIISDEEDAETSRKKLRLSKDQSIILEESFKEHNTLNPKQKLALAKQLGLRARQVEVWFQNRRARTKLKQTEVDCEFLKRCCENLTVENRRLQKEVQELRALKLSPQFYMHMTPPTTLTMCPSCERVAVPPSSAVDPAMRHHHVPPTQPRAFPIGPWATAAATIPHRPFDALRRRS

SEQ ID NO: 1258 - protein, 637 aa, Zea mays
MLGRAAALSAPRWRGGVPDLRAALRSGGNLLFALFVAAVLAFTLLAAFHSPDDPLLHPSSHQLTDFLTSATSTSTFLTDDSVLRTGEDFNSSSTGAAGEVAAGGVEVVAEAVPFIKLSEVGAEAEKTEPETERAVTVDTDAATGEGAAVAEETAVAEAVSCDTEAPVDCTGDRELFNLLMRAAIERFPDLHFYRFGRPVAVPGSPMECDLAWRFRPAADAIGTGRTTYYKDYRRFTLTRDVNTCSLVVDTVGEYHSGVGAKRNGRRKGKKGKKGKQDAPVTDFVPVKTQIRLDENTANNEAAGAAAEPVFVVGEAVNDSLPVVASESDFSRGKYLIYIGGGERCKSMNHFIWGFLCALGEAQFLNRTLVMDLNVCLNARYTSSGKDEERDFRLYFDFEHLKQSASVIDQSQFWQDWGQWHKKDRLKNFYTEDIRMTPMKLRDIKDTLIMRKFGNVEPDNYWSRVCEGETEGIIKRPWHFLWKSRRLMEIVSAIASRMNWDFDSVHVVRGEKAQNTQLWPNLDRDTSPDSLLMALNDKVGAGRYLYIATNEPDKSFFNPLKEKYKTHFLDDFKYLWDENSEWFTETKELSNGQPVEFDGYMRIAVDTEVFLRGKRHVETFNELTRDCKDGVNTCSASS

SEQ ID NO: 1259 - protein, 593 aa, Glycine max
MAVDSEVPRAERSAKALQFIEEVTKNTDSVQERVLTEILTQNAETEYLKRFGLNGATDRDTFKSKVPVVTYEDLQPDIQRIANGDSSPILCSHPISEFLTSSGTSAGERKLMPTIHEEMDRRQLLYSLLMPVMNQYVSDLDKGKALHFLFIKAEAKTPGGLVARPVLTSYYKSEQFRKRPFDPYNVLTSPNEAILCPDSFQSMYTQMLCGLIMRHEVLRVGAVFASGLLRAIRFLQLNWEQLSHDILTGTLNPKITEPSIKERMSKILKPDPQLAAFIKNECSVENWERIIVRIWPNTKYLDVIVTGAMAQYIPTLDYYSGGLPKPCTMYASSECFFGLNLKPMSEPSDVSYTILPNMGYFEFLPHDDSSPVTLSKDSPPRLVELADVELGKYYELIITTYSGLCRYRVGDILQVTGFHNSDPQFRFVRRKNVLLSIDSDKTDEAELQKAIENASELLKEFNTSVVEYTSFADTKSIPGHYVIYWELMMKDSSHPPTNQVLNQCCLVMEESLNSVYRQGRVADNSIGPLEIRVVKNGTFEELMDYAISRGASINQYKVPRCVSFTPIMELLDSRVVSFHFSPAAPHWTPERRR

SEQ ID NO: 1260 - protein, 788 aa, Zea mays
MEPSRGGVGGGGRRWGEAEGDAAEEGRRGEDGGEVSLREWLDRPGRAVEAAECVHVFRQVAEAVAVAHAQGVAVGSARPSCFVVSPPFARVAFIESASGSDASGSCSGSDASEDADGDPDPDPDASPPLRRRDSAVPGEERAGRSFPLKSVLAMELSWYTSPEDADDSAATFASDVYRLGVLLFELFYTFETMEDKMRAMANLRHRVLPPQLLFKWPKEASFCQLLMHPVPETRPKMSEVLQSEFLNQSRNSLEEHEAALRLREEIEEQELLLDFLQQLQKRKQDIADSLQGTIAFLSSDINEVPHQQSAIGHCENFLSDWDKEVCSGTVEEQSDCGSRKRFRPELQGVDMEENNRSVEECSRTVPSSELIQESVLSKSSRLMKNFKKLETAYFLTRSKLMKQVGSQISSCDRVVKNTTGSAVGTEGSSLDDFSLERQYGTRQRGWVNSFLEGLCKYLSFSKLKVQAELKHCDLLNSSNLVCSVGFDRDREFFATAGVNKKIKVFEYNMIVNEHRDIHYPVVEMSNRSKLSCICWNSYMKSHIASSDFEGIVQVWDVTRSQVFVGMREHERRVWSVDFSIVDPTKLVSGSDDGSVKLWDMNQAGSIGTIRTRANVCSVQFQPDTARSIAIGSADHKIYCYDLRNIRAPYCTLVGHTKTVSYVKYLDASTILSASTDNSLKLWDLSMNPGRIIDSPVQTFTGHTNTKNFVGLSISDGYIATGSETNEVFVYHKEFPMPVLAYKFSVTDPISGQEIDDQSQFISCVCWRGQSSTLLSANSSGNIKILEMD

SEQ ID NO: 1261 - protein, 2470 aa, Saccharomyces cerevisiae
MEPHEEQIWKSKLLKAANNDMDMDRNVPLAPNLNVNMNMKMNASRNGDEFGLTSSRFDGVVIGSNGDVNFKPILEKIFRELTSDYKEERKLASISLFDLLVSLEHELSIEEFQAVSNDINNKILELVHTKKTSTRVGAVLSIDTLISFYAYTERLPNETSRLAGYLRGLIPSNDVEVMRLAAKTLGKLAVPGGTYTSDFVEFEIKSCLEWLTASTEKNSFSSSKPDHAKHRALLIITALAENCPYLLYQYLNSILDNIWRALRDPHLVIRIDASITLAKCLSTLRNRDPQLTSQWVQRLATSCEYGFQVNTLECIHASLLVYKEILFLKDPFLNQVFDQMCLNCIAYENHKAKMIREKIYQIVPLLASFNPQLFAGKYLHQIMDNYLEILTNAPAKKIPHLKDDKPQILISIGDIAYEVGPDIAPYVKQILDYIEHDLQTKFKFRKKFENEIFYCIGRLAVPLGPVLGKLLNRNILDLMFKCPLSDYMQETFQILTERIPSLGPKINDELLNLVCSTLSGTPFIQPGSPMEIPSFSRERAREWRNKSILQKTGESNDDNNDIKIIIQAFRMLKNIKSRFSLVEFVRIVALSYIEHTDPRVRKLAALTSCEIYVKDNICKQTSLHSLNTVSEVLSKLLAITIADPLQDIRLEVLKNLNPCFDPQLAQPDNLRLLFIALHDESFNIQSVAMELVGRLSSVNPAYVIPSIRKILLELLTKLKFSTSSREKEETASLLCTLIRSSKDVAKPYIEPLLNVLLPKFQDTSSTVASTALRTIGELSVVGGEDMKIYLKDLFPLIIKTFQDQSNSFKREAALKALGQLAASSGYVIDPLLDYPELLGILVNILKTENSQNIRRQTVTLIGILGAIDPYRQKEREVTSTTDISTEQNAPPIDIALLMQGMSPSNDEYYTTVVIHCLLKILKDPSLSSYHTAVIQAIMHIFQTLGLKCVSFLDQIIPTILDVMRTCSQSLLEFYFQQLCSLIIIVRQHIRPHVDSIFQAIKDFSSVAKLQITLVSVIEAISKALEGEFKRLVPLTLTLFLVILENDKSSDKVLSRRVLRLLESFGPNLEGYSHLITPKIVQMAEFTSGNLQRSAIITIGKLAKDVDLFEMSSRIVHSLLRVLSSTTSDELSKVIMNTLSLLLIQMGTSFAIFIPVINEVLMKKHIQHTIYDDLTNRILNNDVLPTKILEANTTDYKPAEQMEAADAGVAKLPINQSVLKSAWNSSQQRTKEDWQEWSKRLSIQLLKESPSHALRACSNLASMYYPLAKELFNTAFACVWTELYSQYQEDLIESLCIALSSPLNPPEIHQTLLNLVEFMEHDDKALPIPTQSLGEYAERCHAYAKALHYKEIKFIKEPENSTIESLISINNQLNQTDAAIGILKHAQQHHSLQLKETWFEKLERWEDALHAYNEREKAGDTSVSVTLGKMRSLHALAEWEQLSQLAARKWKVSKLQTKKLIAPLAAGARGGSGEWDMLDEYISVMKPKSPDKEFFDAILYLHKNDYDNASKHILNARDLLVTEISALINESYNRAYSVIVRTQIITEFEEIIKYKQLPPNSEKKLHYQNLWTKRLLGCQKNVDLWQRVLRIRSLVIKPKQDLQIWIKFANLCRKSGRMRLANKALNMLLEGGTILVYQIRSKPPPPVVYAQLKYIWATGAYKEALNHLIGFTSRLAHDLGLDPNNMIAQSVKLSSASTAPYVEEYTKLLARCFLKQGEWRIATQPNWRNTNPDAILGSYLLATHFDKNWYKAWHNWALANFEVISMVQEETKLNGGKNDDDDDTAVNNDNVRIDGSILGSGSLTINGNRYPLELIQRHVVPAIKGFFHSISLLETSCLQDTLRLSTLLFNFGGIKEVSQAMYEGFNLMKIENWLEVLPQLISRIHQPDPTVSNSLLSLLSDLGKAHPQALVYPLTVAIKSESVSRQKAALSIIEKIRIHSPVLVNQAELVSHELIRVAVLWHELWYEGLEDASRQFFVEHNIEKMFSTLEPLHKHLGNEPQTLSEVSFQKSFGRDLNDAYEWLNNYKKSKDINNLNQAWDIYYNVFRKITRQIPQLQTLDLQHVSPQLLATHDLELAVPGTYFPGKPTIRIAKFEPLFSVISSKQRPRKFSIKGSDGKDYKYVLKGHEDIRQDSLVMQLFGLVNTLLKNDSECFKRHLDIQQYPAIPLSPKSGLLGWVPNSDTFHVLIREHRDAKKIPLNIEHWVMLQMAPDYENLTLLQKIEVFTYALDNTKGQDLYKILWLKSRSSETWLERRTTYTRSLAVMSMTGYILGLGDRHPSNLMLDRITGKVIHIDFGDCFEAAILREKYPEKVPFRLTRMLTYAMEVSGIEGSFRITCENVMRVLRDNKESLMAILEAFALDPLIHWGFDLPPQKLTEQTGIPLPLINPSELLRKGAITVEEAANMEAEQQNETRNARAMLVLRRITDKLTGNDIKRFNELDVPEQVDKLIQQATSIERLCQHYIGWCPFW

SEQ ID NO: 1262 - protein, 2513 aa, Arabidopsis thaliana
MSTSSQSFVAGRPASMASPSQSHRFCGPSATASGGGSFDTLNRVIADLCSRGNPKEGAPLAFRKHVEEAVRDLSGEASSRFMEQLYDRIANLIESTDVAENMGALRAIDELTEIGFGENATKVSRFAGYMRTVFELKRDPEILVLASRVLGHLARAGGAMTSDEVEFQMKTAFDWLRVDRVEYRRFAAVLILKEMAENASTVFNVHVPEFVDAIWVALRDPQLQVRERAVEALRACLRVIEKRETRWRVQWYYRMFEATQDGLGRNAPVHSIHGSLLAVGELLRVYSLMLEFVCRNTGEFMMSRYREVAEIVLRYLEHRDRLVRLSITSLLPRIAHFLRDRFVTNYLTICMNHILTVLRIPAERASGFIALGEMAGALDGELIHYLPTIMSHLRDAIAPRKGRPLLEAVACVGNIAKAMGSTVETHVRDLLDVMFSSSLSSTLVDALDQITISIPSLLPTVQDRLLDCISLVLSKSHYSQAKPPVTIVRGSTVGMAPQSSDPSCSAQVQLALQTLARFNFKGHDLLEFARESVVVYLDDEDAATRKDAALCCCRLIANSLSGITQFGSSRSTRAGGRRRRLVEEIVEKLLRTAVADADVTVRKSIFVALFGNQCFDDYLAQADSLTAIFASLNDEDLDVREYAISVAGRLSEKNPAYVLPALRRHLIQLLTYLELSSADNKCREESAKLLGCLVRNCERLILPYVAPVQKALVARLSEGTGVNANNNIVTGVLVTVGDLARVGGLAMRQYIPELMPLIVEALMDGAAVAKREVAVSTLGQVVQSTGYVVTPYKEYPLLLGLLLKLLKGDLVWSTRREVLKVLGIMGALDPHVHKRNQQSLSGSHGEVPRGTGDSGQPIPSIDELPVELRPSFATSEDYYSTVAINSLMRILRDASLLSYHKRVVRSLMIIFKVLPELFHTVRTSDENLKDFITWGLGTLVSIVRQHIRKYLPELLSLVSELWSSFTLPGPIRPSRGLPISYGEYFASLTDNQVLHLLEHLCLALNDEFRTYLPVILPCFIQVLGDAERFNDYTYVPDILHTLEVFGGTLDEHMHLLLPALIRLFKVDAPVAIRRDAIKTLTRVIPCVQVTGHISALVHHLKLVLDGKNDELRKDAVDALCCLAHALGEDFTIFIESIHKLLLKHRLRHKEFEEIHARWRRREPLIVATTATQQLSRRLPVEVIRDPVIENEIDPFEEGTDRNHQVNDGRLRTAGEASQRSTKEDWEEWMRHFSIELLKESPSPALRTCAKLAQLQPFVGRELFAAGFVSCWAQLNESSQKQLVRSLEMAFSSPNIPPEILATLLNLAEFMEHDEKPLPIDIRLLGALAEKCRVFAKALHYKEMEFEGPRSKRMDANPVAVVEALIHINNQLHQHEAAVGILTYAQQHLDVQLKESWYEKLQRWDDALKAYTLKASQTTNPHLVLEATLGQMRCLAALARWEELNNLCKEYWSPAEPSARLEMAPMAAQAAWNMGEWDQMAEYVSRLDDGDETKLRGLASPVSSGDGSSNGTFFRAVLLVRRAKYDEAREYVERARKCLATELAALVLESYERAYSNMVRVQQLSELEEVIEYYTLPVGNTIAEERRALIRNMWTQRIQGSKRNVEVWQALLAVRALVLPPTEDVETWLKFASLCRKSGRISQAKSTLLKLLPFDPEVSPENMQYHGPPQVMLGYLKYQWSLGEERKRKEAFTKLQILTRELSSVPHSQSDILASMVSSKGANVPLLARVNLKLGTWQWALSSGLNDGSIQEIRDAFDKSTCYAPKWAKAWHTWALFNTAVMSHYISRGQIASQYVVSAVTGYFYSIACAANAKGVDDSLQDILRLLTLWFNHGATADVQTALKTGFSHVNINTWLVVLPQIIARIHSNNRAVRELIQSLLIRIGENHPQALMYPLLVACKSISNLRRAAAQEVVDKVRQHSGALVDQAQLVSHELIRVAILWHEMWHEALEEASRLYFGEHNIEGMLKVLEPLHDMLDEGVKKDSTTIQERAFIEVGNFNPGFLAYRHELKEAHECCCNYKITGKDAELTQAWDLYYHVFKRIDKQLASLTTLDLESVSPELLLCRDLELAVPGTYRADAPVVTISSFSRQLVVITSKQRPRKLTIHGNDGEDYAFLLKGHEDLRQDERVMQLFGLVNTLLENSRKTAEKDLSIQRYSVIPLSPNSGLIGWVPNCDTLHHLIREHRDARKIILNQENKHMLSFAPDYDNLPLIAKVEVFEYALENTEGNDLSRVLWLKSRSSEVWLERRTNYTRSLAVMSMVGYILGLGDRHPSNLMLHRYSGKILHIDFGDCFEASMNREKFPEKVPFRLTRMLVKAMEVSGIEGNFRSTCENVMQVLRTNKDSVMAMMEAFVHDPLINWRLFNFNEVPQLALLGNNNPNAPADVEPDEEDEDPADIDLPQPQRSTREKEILQAVNMLGDANEVLNERAVVVMARMSHKLTGRDFSSSAIPSNPIADHNNLLGGDSHEVEHGLSVKVQVQKLINQATSHENLCQNYVGYVPLHFYTPKPRLL

SEQ ID NO: 1263 - protein, 259 aa, Glycine max
MSVEKERETQVYLAKLAEQAERYEEMVECMKKVAKLDLDLTVEERNLLSVGYKNVIGARRASWRIMSSIEQKEESKGNEHNVKLIKSYCQKVEEELSKICGDILTIIDQHLIPSSGSAEASVFYYKMKGDYFRYLAEFKTDQERKEAAEQSLKGYEAASATANTDLPSTHPIRLGLALNFSVFYYEIMNSPERACHLAKQAFDEAIAELDTLSEESYKDSTLIMQLLRDNLTLWTSDLPEDGGEDNIKAEEAKPSEPEH

SEQ ID NO: 1264 - protein, 261 aa, Glycine max
MTASKDRENFVYIAKLAEQAERYEEMVESMKNVANLDVELTVEERNLLSVGYKNVIGARRASWRILSSIEQKEETKGNELNAKRIKEYRQKVELELSNICNDVMRVIDEHLIPSAAAGESTVFYYKMKGDYYRYLAEFKSGNEKKEAADQSMKAYESATAAAEADLPPTHPIRLGLALNFSVFYYEILNSPERACHLAKQAFDEAISELDTLNEESYKDSTLIMQLLRDNLTLWTSDIPEDGEDAQKVNGTAKLGGGEDAE

SEQ ID NO: 1265 - protein, 262 aa, Glycine max
MAASAPTPREEFVYMAKLAEQAERYEEMVEFMEKVSASAESEELTVEERNLLSVAYKNVIGARRASWRIISSIEQKEESRGNEDHVAVIRDYRSKIEAELSNICDGILKLLDTRLVPSAASGDSKVFYLKMKGDYHRYLAEFKTGADRKEAAESTLSAYKAAQDIANTELPPTHPIRLGLALNFSVFYYEILNSPDRACSLAKQAFDEAIAELDTLGEESYKDSTLIMQLLRDNLTLWTSDMQDDGADEIKEAAPKGDGEQN

SEQ ID NO: 1266 - protein, 709 aa, Oryza sativa
MPFSYAAAASGSASSSRKPVPVAAAAARRPAPSPAAAAAPAPSPSNPSAVSDSDPSSYSSSGEETDLTASDPAAASVISSYLSVAGDGADLSKVGIFLSSAARRRSPPCLICFDPIRPSDPVWSCSASCFALLHLHCIQSWAHQSSSAAPSPTWGCPKCRFPYPKSQTPTSYLCFCSKTVDPAPDPWILPHSCGDVCGRRLNADRDSGCEHNCLLLCHPGPCPPCPAIVPNAMCFCGSHRETRRCSHQRYSCSGKCNKRLGCGIHRCPVDCHDGPCPPCAVRGKHKCECGETMEERLCSERVFQCKRECGGMLQCGKHSCERGCHAGKCGGCPLQGRRTCPCGKKDYPSLDCDAEAATCGSTCEKVLGCGRHKCPERCHRGSCVETCRLVITKSCRCGGLKKEQVPCYQELTCERKCQRLRNCGRHACRRRCCEGDCAPCPEPHKCHYGACPPCKLICGEELSCGHRCKLRCHGPIAPPNPEFTLKPIKRKKGKHIDSTPGTPCPPCQEVVLVPCFGHHLGQERAILCSKRRQFPCQNLCENYRIVPICAQKYVTLVNVRCACNNLKKEWICQDVLKEYRQSGRDPKQIPKNQYAVGLLACGEDCVKKVKAADSELHLRKIQEIKTPAVEVENVPKRRKRRNRGQESVESSKFQEIKAVALKFLLVIFLCIIVVAGLYLLWKGVYRLSDWMNDMEEQRARQRHLKPGRL

SEQ ID NO: 1267 - protein, 379 aa, Oryza sativa
MVEVEEVSNKMQVQMRLHPAAAAEEEDADLPLPALFDKASHLHSLASSSSLDQEGIRKGVDLLRRCDEMVSKVGLFSSNETKDDISTANLKYLLVPYYLGEMTERVAQEDRIPVLKASQDHLKEFISICEALELISEDELEISRQKNLIPWQIEEHRRLHGSSAKRLQKQSSRIKERKERRRRHESSCLSAPIELGGDLLRMMEKEREGMVSYYLIGSIEGFDLLDMLKKEEEIVPAVKEGKRRMVMHLLVKCLMNVQKGLKHGTIMLPTVHHTPNQLIQSLVQLTSERERMAAQVFQPSYRLPTMSIEEAGLREMKMMEKWQERTAKMIQESNSAWHKDGSRSAQEDEDAEEEKARGWDDWKDDNPRGAGNKKLTPCG

SEQ ID NO: 1268 - protein, 227 aa, Oryza sativa
MAEEHETRPPSAGRPPSSGRGRADDADEREEGEIADDDSGHAPPQANPAAPHPLEHAWTFWFDNPQGKSKQATWGSSIRPIHTFSTVEDFWSLYNNIHHPSKLVVGADFHCFKNKIEPKWEDPICANGGKWTFSCGRGKSDTMWLHTLLAMIGEQFDYGDEICGAVVSVRGKQERIAIWTKNAANEAAQISIGKQWKEFLDYKDSIGFIVHDDAKKMDKGLKNRYTV

SEQ ID NO: 1269 - protein, 267 aa, Saccharomyces cerevisiae
MSTSREDSVYLAKLAEQAERYEEMVENMKTVASSGQELSVEERNLLSVAYKNVIGARRASWRIVSSIEQKEESKEKSEHQVELICSYRSKIETELTKISDDILSVLDSHLIPSATTGESKVFYYKMKGDYHRYLAEFSSGDAREKATNASLEAYKTASEIATTELPPTHPIRLGLALNFSVFYYEIQNSPDKACHLRKQAFDDAIAELDTLSEESYKDSTLIMQLLRDNLTLWTSDMSESGQAEDQQQQQQHQQQQPPAAAEGEAPK

SEQ ID NO: 1270 - protein, 256 aa, Oryza sativa
MSREENVYMAKLAEQAERYEEMVEYMEKVAKTVDVEELTVEERNLLSVAYKNVIGARRASWRIVSSIEQKEEGRGNEEHVTLIKEYRGKIEAELSKICDGILKLLDSHLVPSSTAAESKVFYLKMKGDYHRYLAEFKTGAERKEAAESTMVAYKAAQDIALADLAPTHPIRLGLALNFSVFYYEILNSPDKACNLAKQAFDEAISELDTLGEESYKDSTLIMQLLRDNLTLWTSDLTEDGGDEVKEASKGDAGEGQ

SEQ ID NO: 1271 - protein, 260 aa, Oryza sativa
MSPAEASREENVYMAKLAEQAERYEEMVEFMEKVAKTTDVGELTVEERNLLSVAYKNVIGARRASWRIISSIEQKEESRGNEAYVASIKEYRSRIETELSKICDGILKLLDSHLVPSATAAESKVFYLKMKGDYHRYLAEFKSGAERKEAAENTLVAYKSAQDIALADLPTTHPIRLGLALNFSVFYYEILNSPDRACNLAKQAFDDAIAELDTLGEESYKDSTLIMQLLRDNLTLWTSDNAEDGGDEIKEAAKPEGEGH

SEQ ID NO: 1272 - protein, 206 aa, Oryza sativa
MAEVEAAPIAAAETPEVAAAEGAAAAKAPHKLHRQWAFWYDIQSKPKPGAAWGTSLRKAYTFDTVEEFWGLYDQIFRPSKVTVNADFHLFKAGVEPKWEDPECANGGKWTVPCSRKTTLENMWLETLMALIGEQFDESEEICGVVASVRQRGDKLALWTRTASNEAVQVNIGKKWKEIVDYNDKMVYSFHDDAKREKPSRGGRYNV

SEQ ID NO: 1273 - protein, 227 aa, Oryza sativa; identical to SEQ ID NO: 1268

SEQ ID NO: 1274 - protein, 210 aa, Sorghum bicolor
MAEVEVPAAAVATTIPEAAEATEGGAAAEAKGPHKLHRQWTFWYDIQSKPKPGAAWGTSLKKAYTFDTVEEFWSLYDQIFRPSKLSGNADFHLFKAGVEPKWEDPECANGGKWTVPCNRKATFENMWLETLMALIGEQFDETEDICGIVASVRARGDKLALWTRTASNEAVQVNIGKKWKDVIDYNDKITYTFHDDSRREKPSRGGRYTV

SEQ ID NO: 1275 - protein, 220 aa, Sorghum bicolor
MADEIDTRPASAGSRGRPAHATEDDDREEGEIADDTPAPALPVTHPLEHSWTFWFDNPQGKNKQAAWGSSIRPIHTFSTVEDFWGLYNNIHHPSKLVIGADFHCFKNKIEPKWEDPICANGGKWTISCGRGKSDTLWLHTLLAMIGEQFDYGDEICGAVVSVRGKQERIAIWTKNAANEAAQISIGKQWKEFLDYKDSIGFIVHDDAKKADKGPRNRYTV

SEQ ID NO: 1276 - protein, 352 aa, Oryza sativa
MADSPSPRLDEEDAFGRDFNSSPSPTAPPARSGEKRPFGDLDDDDEDVFASKKGKTKVEESAPGAATGMILSLRESLQNCKDNLASCQVEREAAKSEVQKWHSAFQNIPAVPAGTNPDPVSVVSYLNNLKSSEESLKEQLEKAKKREAAFIVTFAKREQEIAELKSAVRDLKTQLRPPSMQTRRLLLDPAIHEEFTRLKNLVEEKEKKIKELQDNVAAVNFTPSSKHGKMLMAKCRTLQEENEEIGAMASEGKIHELGMKIAVLKTRNNELRNQFNELYKHMDGLTNDVERSNEMVAILQDELETKDVELRRLKEMLAQKEATDENKIPQENDVAGDDIVAAAESQPIKVET

SEQ ID NO: 1277 - protein, 165 aa, Zea mays
MALAEADDGAVVFGEEQEALVLKSWAVMKKDAANLGLRFFLKVFEIAPSAKQMFSFLRDSDVPLEKNPKLKTHAMSVFVMTCEAAAQLRKAGKVTVRETTLKRLGATHLRYGVADGHFEVTGFALLETIKEALPADMWSLEMKKAWAEAYSQLVAAIKREMKPDA

SEQ ID NO: 1278 - protein, 191 aa, Zea mays
MGFSEAQEELVLRSWKAMKSDSESTALKFFLRIFEIAPGAKQMFSFLRDAGDAPLEKHPKLKAHAVTVFVMACESATQLRSTGDVKVREATLKRLGATHARAGVADAHFEVVKTALLDTIRDAVPDMWTPEMKAAWEEAYDQLAAVIKEEMKNAAAAEEQTKNAATAEEEIKNAAAAEEETTNAAAAVDGS

SEQ ID NO: 1279 - protein, 303 aa, Zea mays
MNTSPSRYRAMMGGWGGSDGYEGSKRTRMMMESNPYFAVNAGSPLDVSKRARMMEPGAPYFGAMGSSASGAGGGFYQPFNSNLAGAGSSTGIQSFPCVRLRGLPFDCNDIDVCKFFVGLDIVDCLLVNKNGRFTGEAFVVFPTSMQAEFALHRDRQNMGRRYVEVFRCKKHEYYCAIANEVNQGGYFEPEYRRSPPPPRPRKPSEDKGSMEYTEVLKLRGLPYSATTEDIIKFFLEYELAEENVHIAYRTDGKATGEAFVEFPTAEVAKTAMCKDKMTIGTRYVELFPSTPEEASRAKSRGRH

SEQ ID NO: 1280 - protein, 339 aa, Zea mays
MVRVGLSSAPGVNLTEQIDNVFDQLINKIEHADFDTRPFLKQLNVLGRYEPIKRNVYCTKRRIEDYGISCHCKPSPGSSVVCGRDCHCGMLFSCCSSQCECDDTCTNKSFQHRPLKKTKLIKTEKCGHGLVAEDEIKKGEFVIEYVGEVIDDRTCENRLWTMKRLLDTDFYLCEVSSNMVIDATNKGNRSRFINHSCEPNTAMQKWTVDGETRVGIFALRDIKIGEELTYDYKFVQFGAAQVCHCGSSNCRKMLGTTKYSGSSQNHHAKKKKRKTSCENCIQQFLRLWHPHKKMYVGCWIIDFDQETKMHTLKFNDLHTEKFNLKEEEWHFLEVDFDED

SEQ ID NO: 1281 - protein, 248 aa, Zea mays
MDSSLIDSENSMPGCACSHPECSPENCGHVSLFDGVYNSLVDINGTPMHGRFAYDEDSKIILQEGYPIYECNSSCICDSSCQNKVLQKGLLVRLELFRSENKGWAIRAAEPILQGTFVCEYIGEVVKADKAMKNAESVSSKGGCSYLFSIASQIDRERVRTVGAIEYFIDATRSGNVSRYISHSCSPNLSTRLVLVESKDCQLAHIGLFANQDIAVGEELAYDYRQKLVAGDGCPCHCGTTNCRGRVY

SEQ ID NO: 1282 - protein, 891 aa, Zea mays
MASSSKASDSSQRSKRSDQGMGKDAAAASVVPIHANLTQLIRQVQSGRLAYIKEKLEVNRKTLQRHSCSLFDVAAAAEVASRGTDGGNALSQRAAERQCGSDLANGIGERDVVSVQEENLATGTLALSSSGATAQRTIVRFVKLPLVEKIPPYTTWIFLDKNQRMADDQSVVGRRRIYYDTVGNEALICSDSDEEIPEPEEEKHFFTKGEDHLIWRATQDHGLNQEVVNVLCQFIGATPSEIEERSEVLFEKNEKHSGSSDKIESRLSLDKTMDAVLDSFDNLFCRRCLVFDCRLHGCSQNLVFPCEKQPYSFDPDENKKPCGHLCYLRWREGFKEMHDDGLAGGATYTMESGTASQRVDVNVMYESEDSNRQKGNIRSMTLVGTSGSKIISSVSAEESTTTPSADISETENVSSDLPPSSLRKHKISKHGPRYREHSPGKRQKVFTSDISFEGNIMNKLSIPEIRDTRLESRESGGDKLRILDESTKKTSRKDMCGESPATTMENVGRQSNKVSSTKNFLESTLSCWSALERDLYLKGIEIFGKNSCLIARNLLSGLKTCIEVANYMYNNGPAMAKRPLLNKSISGDFAENEQDYMEQDMAARTRIYRRRGRNRKLKYTWKSAGHPTVRKRTDDGKQCYTQYSPCACQQMCGKDCPCADKGTCCEKYCGCSKSCKNKFRGCHCAKSQCRSRQCPCFAASRECDPDVCRNCWVSCGDGSLGEPLARGDGYQCGNMKLLLKQQQRILLGRSDVAGWGAFIKNPVNKNDYLGEYTGELISHKEADKRGKIYDRANSSFLFDLNDQYVLDAYRKGDKLKFANHSSNPNCYAKVMLVAGDHRVGIYAKEHIEASEELFYDYRYGPDQAPAWARRPEGSKKDEASVSHRRAHKVAR

SEQ ID NO: 1283 - protein, 856 aa, Zea mays
MAQQMASVHLNDTTVVDAKPLRTLTPMFPAPLGLHTFTPQNSPSVVCVTPFGPYGGGTELGMPAVPPMFAAPVPAAGAEPSQRQPHTANMNGGDTELGMPAVPPMFAAPAPAAGAEPNQGQPHTANMNGTAVNSSVTSLQTPSAATQESGKRKRGRPKRVPDTTVSSAPSAPLAPTISPVPSLPVVTPVPSAPQELNTIVSLTPSSDAPQESGKRKRGRPKRIQDVPVMVPLTSQGDSTSVIQTLPGSSVHESGTRRGRPKRLQDSSDIVTPIDSKDSESSPQPPIAAPAESGKRKRGRPKRIDGSVTPSSHSVFSIDDDAVDTMKRGRPRKIDTKLLQFPSLFSDDPRQTADNVLMMFDALRRRLMQMDDVKQAAKQQPNLKAGSIMNNAELRVNKDKRIGEVPGVEVGDMFYFRIEMCLVGLNSQSMAGIDYMSAKFGNEEDPVAISVVSAGVYDNTGDDPDVLVYTGHGMSGKDDQKLERGNLALERSLHRGNPIRVIRSVKDLTCPTGKIYIYDGLYKIKEAWVEKGKSGFNVFKHKLLREPGQPDGIAVWKKTEKWRENPSSRDHVILLDISYGVENNPVCLVNEVDDEKGPSRFTYTTNLTYGNSLSSMRKMQGCKCISVCLPGDNNCSCTHRNAGDLPYSASGILVSRMPVLYECGDSCTCSQNCRNRVVQKGTQIRFEVFKTGDRGWGLRSWDPIRAGTFICEYAGEIIDINRVNGEDDYIFETSPLEQNLRWNYAPELLGEPSLSDSNETPKQLPIVISAKRTGNIARFMNHSCSPNVFWQPVLYDHGDEGYPHIAFFAIKHIPPMTELTYDYGQNQRNSIQMGTHSGFRKSKSCLCWSPKCRGSFG

SEQ ID NO: 1284 - protein, 866 aa, Zea mays
MSSLDPSPATSTQQKQLESLVNLLTQGSRFYRKAYNELFSGVTTEQDPDSSTNIPEYMLFGWHLFLMLHSRSPELFKDLVSCIHGLVAVLAILLIHVPAKFRSFTIEGSSHLIKQTEKGVDLIASLCHNYHTSEERLKEMLHKSYNAIEDIFHMKALSASECKPENLDKIDTDDLMYFKGLIDMECFQSNLEKMEKLCNSNSCKGELDFKSILINNDYIPYDENSTGDSTNLGRSKCAFETLASPTKTIKNMLTVPSSPLSPATGGSVKIVQMTPVTSAMTTAKWLREVISSLPDKPSSKLQQFLSSCDRDLTNAVTERVSIVLEAIFPTKSSANRGVSLGLNCANAFDIPWAEARKVEASKLYYRVLEAICRAELQNSNVNNLTPLLSNERFHRCLIACSADLVLATHKTVIMMFPAVLESTGLTAFDLSKIIENFVRHEETLPRELKRHLNSLEEQLLESMAWEKGSSLYNSLIVARPSVASEINRLGLLAEPMPSLDDLVSRQNVRIEGLPATPSKKRASGPDDNADPRSPKRSCNESRNTVVERNLQTPPPKQSHMVSTSLKAKCHPLQSTFASPTVCNPVGGNEKCADVTIHIFFSKILKLAAIRIRNLCERVQCVEQTERVYNVFKQILEQQTTLFFNRHIDQLILCCLYGVAKVCQLELTFREILNNYKREAQCKPEVFSSIYIGSTNRNGVLVSRHVGIITFYNEVFVPAAKPFLVSLISSGTHPEDKKNASGQILGSPKPSPFPNLPDMSPKKVSASHNVYVSPLRQTKLDLLLSPSSRSFYACIGEGTHAYQSPSKDLAAINSRLNYNGRKVNSRLNFDMVSDSVVAGSLGQINGGSTSDPAAAFSPLSKKRETDT

SEQ ID NO: 1285 - protein, 264 aa, Wheat dwarf virus
MASSSAPRFRVYSKYLFLTYPECTLEPQYALDSLRTLLNKYEPLYIAAVRELHEDGSPHLHVLVQNKLRASITNPNALNLRMDTSPFSIFHPNIQAAKDCNQVRDYITKEVDSDVNTAEWGTFVAVSTPGRKDRDADMKQIIESSSSREEFLSMVCNRFPFEWSIRLKDFEYTARHLFPDPVATYTPEFPTESLICHETIESWKNEHLYSVSLESYILCTSTPADQAQSDLEWMDDYSRSHRGGISPSTSAGQPEQERLPGQGL

SEQ ID NO: 1286 - protein, 352 aa, Arabidopsis thaliana
MDSSCIDEISSSTSESFSATTAKKLSPPPAAALRLYRMGSGGSSVVLDPENGLETESRKLPSSKYKGVVPQPNGRWGAQIYEKHQRVWLGTFNEQEEAARSYDIAACRFRGRDAVVNFKNVLEDGDLAFLEAHSKAEIVDMLRKHTYADELEQNNKRQLFLSVDANGKRNGSSTTQNDKVLKTCEVLFEKAVTPSDVGKLNRLVIPKQHAEKHFPLPSPSPAVTKGVLINFEDVNGKVWRFRYSYWNSSQSYVLTKGWSRFVKEKNLRAGDVVTFERSTGLERQLYIDWKVRSGPRENPVQVVVRLFGVDIFNVTTVKPNDVVAVCGGKRSRDVDDMFALRCSKKQAIINAL

SEQ ID NO: 1287 - protein, 365 aa, Oryza sativa
MGVVSFSSTSSGASTATTESGGAVRMSPEPVVAVAAAAQQLPVVKGVDSADEVVTSRPAAAAAQQSSRYKGVVPQPNGRWGAQIYERHARVWLGTFPDEEAAARAYDVAALRYRGRDAATNFPGAAASAAELAFLAAHSKAEIVDMLRKHTYADELRQGLRRGRGMGARAQPTPSWAREPLFEKAVTPSDVGKLNRLVVPKQHAEKHFPLRRAASSDSASAAATGKGVLLNFEDGEGKVWRFRYSYWNSSQSYVLTKGWSRFVREKGLRAGDTIVFSRSAYGPDKLLFIDCKKNNAAAATTTCAGDERPTTSGAEPRVVRLFGVDIAGGDCRKRERAVEMGQEVFLLKRQCVVHQRTPALGALLL

SEQ ID NO: 1288 - protein, 317 aa, Oryza sativa
MEQEAAMVVFSCNSGSGGSSSTTDSKQEEEEEEELAAMEEDELIHVVQAAELRLPSSTTATRPSSRYKGVVPQPNGRWGAQIYERHARVWLGTFPDEEAAARAYDVAALRFRGRDAVTNRAPAAEGASAGELAFLAAHSKAEVVDMLRKHTYDDELQQGLRRGSRAQPTPRWAREPLFEKAVTPSDVGKLNRLVVPKQQAERHFPFPLRRHSSDAAGKGVLLNFEDGDGKVWRFRYSYWNSSQSYVLTKGWSRFVREKGLRPGDTVAFSRSAAAWGTEKHLLIDCKKMERNNLATVDDDARVVVKLFGVDIVGDKTR

SEQ ID NO: 1289 - protein, 249 aa, Zea mays
MVKLAFGSVGDSFSVTSIKAYVAEFIATLLFVFAGVGSAIAYGQLTNGGALDPAGLVAIAIAHALALFVGVSVAANISGGHLNPAVTFGLAVGGHITILTGVFYWVAQLLGATVACLLLGFVTHGKAIPTHAVAGISELEGVVFEVVITFALVYTVYATAADPKKGSLGTIAPIAIGFIVGANILAAGPFSGGSMNPARSFGPAVAAGDFAGNWVYWVGPLVGGGLAGLVYGDVFIGGSYQQVADQDYA

SEQ ID NO: 1290 - protein, 288 aa, Zea mays
MAKQDIEASGPEAGEFSAKDYTDPPPAPLIDADELTKWSLYRAVIAEFIATLLFLYITVATVIGYKHQTDAAASGPDAACGGVGILGIAWAFGGMIFILVYCTAGIYGAHNPAVTFGLFLARKVSLVRALLYIIAQCLGAICGVGLVNGLQSAYYVRYGGGANELSDGYSKGTGLAAEIIGTFVLVYTVFSATDPKRSARDSHVPVLAPLPIGFAVFMVHLATIPITGTGINPARSLGAAVIYNKDKAWDDQWIFWVGPLIGAAIAAAYHQYVLRASATKLGSYRSNA

SEQ ID NO: 1291 - protein, 228 aa, Zea mays
MARERREIKRIESAAARQVTFSKRRRGLFKKAQELSVLCDADVALIVFSSTGKLSQFASSSMNEIIDKYNTHSKNLGKTEQPSLDLNLEHSKYANLNEQLAEASLRLRQMRGEELEGLNVEELQQLEKNLESGLHRVLQTKDQQFLEQINDLERKSTQLAEENMQLRNQVSQIPPAGKQAVADTENVIAEEGQSSESVMTALHSGSSQDNDDGSDVSLKLGLPCVAWK

SEQ ID NO: 1292 - protein, 233 aa, Zea mays
MVGTGKRERIAIRRIDNLAARQVTFSKRRRGLFKKAEELSILCDAEVGLVVFSATGKLFHFASSSMKQVIDRYDSHSKTLQRSEPQSSQLQSHMDDGTCARLKEELAETSLKLRQMRGEELQRLSVEQLQELEKTLESGLGSVLKTKSQKILDEISGLERKRTQLIEENSRLKEQVTRMSRMETQLGADPEFVYEEGQSSESVTNTSYPRPSTDTDDCSDTSLRLGLPLFSSK

SEQ ID NO: 1293 - protein, 206 aa, Glycine max
MTRKRIQIKKIDNISSRQVTFSKRRKGLFKKAQELSTLCDADIALIVFSATSKLFEYASSSMHQVIERHDRYSAIHRLDRPSIELQIESDSNNILRKKVEDKTRELRQMNGEDLQGLTLQELQKLEEHLKRSLTNVSKVKDAKFMQEISTFKRKGVELMEENQRLKQVPSLIHAHSYRQSSESILSNSSNLPEDGGSNTSLKLGLP

SEQ ID NO: 1294 - protein, 205 aa, Glycine max
MTRKRIQIKKIDNISSRQVTFSKRRKGLFKKAQELSTLCDADIALIVFSATSKLFEYASSSMHQVIERRDSHSAMNRLDRPSIELQIENDSNEILRKKVEDKNRELRQMNGEDLQGLTLQELHKLEEHLKRGLINVSKVKDEKLMQEISTLKRKGVELMEENQRLKQVVPSLIHVHRQSSESILSNSSNLPEDGGSDTSLKLGLP

SEQ ID NO: 1295 - protein, 196 aa, Triticum sp.
MGRGRSEIKRIDNPTQRQSTFYKRRDGLFKKARELAVLCDADLLLLLFSASGKLYQYLAPTVPSVKEFVERYEASRHTKVWSDIRQERRRELEKVAKMCDLLEKELRFMTVDDGERYTVPSLAALEHNLEAAMHKVRSEKDRKIGGEMSYLENMIRGKQAERYGLCDKLAHAQSLKVVEGGSTSLNNGLDLKLGFN

SEQ ID NO: 1296 - protein, 225 aa, Zea mays
MARERREIRRIESAAARQVTFSKRRRGLFKKAEELAVLCDADVALVVFSATGRLSQFASSSVNDIVDKYSTHSKNLGKSHQQPSIDLNVEQSKYSGLNEQLAEETNGLRQMRGEDLEGLSVEELHRMERKLEAGLHRVISTKDQLFMQQIGELLQKGTQLEDENRRLKEQMPQVLTAGTMVVAAAAENILTEDGQSSESVMTALHSGSSLDCDDGSDISLKLSLP

SEQ ID NO: 1297 - protein, 245 aa, Zea mays
MGRGKVQLKRIENKINRQVTFSKRRSGLLKKAHEISVLCDAEVALIIFSTKGKLYEYSTDSCMDKILERYERYSYAEKVLISAEYETQGNWCHEYRKLKAKVETIQKCQKHLMGEDLETLNLKELQQLEQQLESSLKHIRTRKSQLMVESISALQRKEKSLQEENKVLQKELAEKQKDQRQQVQRDQTQQQTSSSSTSFMLREAAPTTNVSIFPVAAGGRVVEGAAAQPQARVGLPPWMLSHLSC

SEQ ID NO: 1298 - protein, 382 aa, Arabidopsis thaliana
MDLSKVTLDIFTKLEQKWLSHCDSSRKTRILSIDGGGTTGIVAAASILHLEHQIRLQTGDPHAHISDFFDIVAGTGIGGILAALLVADDGSGRPMFTARDAVKFVAEKNSELFEIRYTGVFRRNKRYSGKSMERVLETAFRREDGKVLTMKDTCKPLLVPCYDLKTSAPFVFSRAGASESPSFDFELWKVCRATSATPSLFKPFSVVSVDGKTSCSAVDGGLVMNNPTAAAVTHVLHNKRDFPSVNGVDDLLVLSLGNGPSTMSSSPGRKLRRNGDYSTSSVVDIVVDGVSDTVDQMLGNAFCWNRTDYVRIQANGLTSGGAEELLKERGVETAPFGVKRILTESNGERIEGFVQRLVASGKSSLPPSPCKESAVNPLADGR

SEQ ID NO: 1299 - protein, 577 aa, Anabaena
MYFLPVLQTDTVIILNLASVREGNLDVYIDENIDNVIKTFGNGELTIGQWHFFAIVFNGGQLTIYLDDHEYTGSLTGSSLNKATSPITMGATLHNNVYFTGQLANISVWNYPCTQDQIQTHRSSPLVGNEPGLVAYWRLNEGEGTTVQDQSGNTHNGTLYGDPSWNLAQVLFAIAQSSSEGHRPSSSPAEIAEIAQTTEYPIPDNIQQQEQAQTPSQEESKQTMNNTANPKYKILAIDGGGIRGIIPAIILTEIEKRTQKQIFSLFDLIAGSSSGGILALGLTKPRLDLAGSDSPPVAQYSAEELLQIYLEYGAEIFYEPFWEQLLGQLEDIFVQPKYSSEGREEIIKQYFGDSPLENNLKEVFVTSYDIEQRIPIFFTNKLEKQQTKSKKFRKLCLGFTLTDAALATSATPTYFAPYRVSSSHNTNGFYTLVDGGLVANNPANLAILEAQISRQENQQALNMEDILVVSLGTGSLTSVYPYDQVKNWGLLQWTKPLLNMVLDGGSEVVAGELERLFEATNKGHKTSYYRFQPFLKSELEDIDNAKPENLRQLQTLANILIQEKNQEIDELCSILSS

SEQ ID NO: 1300 - protein, 240 aa, Zea mays
MMEGGSRADGRNPNQLRPFTCTGNPLHRAHGSARWAQGDTVVLAAVYGPKPGTRKGENPEKASIEVVWKPKTGQIGRQEREYEMTLKRTLQSICLLTVHPNTTTSVVLQVVGDDGSLMPCAINASCAALAFAGIPMKHLAVAISCGVMDNGVVILDTSRAEEQQARSFAHLVFPNSRKSVESKDPTQRDEESERGLITCITHGAMSEDDYFNCIERGVMASSRISDFMRKTLQKEASRDA

SEQ ID NO: 1301 - protein, 1286 aa, Saccharomyces cerevisiae
MSEGFSSSSIQELYQSLKEITNNADVELFEDRITKLDFESTDEPKHANDIIKDRFLRPSNALPWSLLDMVQDVPHTSSPEDCSGKLDYKELLKVPDPINRTSYQFKRTGLEGKISGYKEEVDLKEVANANASNSLSITRSINHNQNSVRGSTAQLPFTPGGIPMKSVKTDSEQNGSSTMANATKLLHKDGQGLFDIPEGMNRGIKPMDSPAENEDQNGQFKELKQLNEIDNELDIRIEANEAKLKEEEKSAKSISEEIMEEATEETTADNADDAEIDELLPIGIDFGRTKPVSKSVPVKKEWAHVVDLNHKIENFDELIPNPARSCPFELDTFQKEAVYHLEQGDSVFVAAHTSAGKTVVAEYAIAMAHRNMTKTIYTSPIKALSNQKFRDFKETFDDVNIGLITGDVQINPDANCLIMTTEILRSMLYRGADLIRDVEFVIFDEVHYVNDQDRGVVWEEVIIMLPQHVKFILLSATVPNTYEFANWIGRTKQKNIYVISTPKRPVPLEINIWAKKELIPVINQNSEFLEANFRKHKEILNGESAKGAPSKTDNGRGGSTARGGRGGSNTRDGRGGRGNSTRGGANRGGSRGAGAIGSNKRKFFTQDGPSKKTWPEIVNYLRKRELLPMVVFVFSKKRCEEYADWLEGINFCNNKEKSQIHMFIEKSITRLKKEDRDLPQILKTRSLLERGIAVHHGGLLPIVKELIEILFSKGFIKVLFATETFAMGLNLPTRTVIFSSIRKHDGNGLRELTPGEFTLAGRAGRRGLDSTGTVIVMAYNSPLSIATFKEVTMGVPTRLQSQFRLTYNMILNLLRIEALRVEEMIKYSFSENAKETLQPEHEKQIKVLQEELQTIEYKSCEICDNDIEKFLELMLAYKEATVNLMQEMVKSPSILHILKEGRLVAFRDPNDCLKLGFVFKVSLKDAVCVIMTFTKPYKLPNGEPNHLIYFPKADGYRRRNFPKFQKTDFYMEEVPVTAIEVITKRKFAAPLGKVIKKDVAALNEFNAETNNILDGKTLKEAINIEKQGLKIHQILLDRTNIRDEIFKLKSIKCPNLSQHIVPKFKAHVIKKKIEELYHLMSDQNLSLLPDYEKRLAVLKDTEFIDQNHNVLLKGRVACEINSGYELVLTELILDNFLGSFEPEEIVALLSVFVYEGKTREEEPPIVTPRLAKGKQRIEEIYKKMLCVFNTHQIPLTQDEAEFLDRKRFAMMNVVYEWARGLSFKEIMEMSPEAEGTVVRVITWLDEICREVKTASIIIGNSTLHMKMSRAQELIKRDIVFAASLYL

SEQ ID NO: 1302 - protein, 1432 aa, Saccharomyces cerevisiae
MSDIKQLLKEAKQELTNRDYEETIEISEKVLKLDPDNYFAHIFLGKALSSLPASNNVSSNRNLERATNHYVSAAKLVPDNLLAWKGLFLLFRTTEVVPDILSYDEYFDLCGQYADALLKQEQSQVELINDIKLLKKTHPDCQKAFYQHLKPGSLMAETIGRHLSTPQDALLNLIKILSNIETTEIGKTLSQNRLKLKASDPDYQIKLNSFSWEIIKNSEIDQLYNQLVNILADDQKRSEIENQWLEYRIKVLKSMPLDVKKDFFTKVKEMVEDMVLVNHQSLLAWQKYFEWTDYEDLDNMDAPLIIKYFKKFPKDPLAMILYSWLSSKLSKYDIKSLESANKPPEGHKKTEKETDIKDVDETNEDEVKDRVEDEVKDRVEDEVKDQDEEAKEDEEEDLDDIEIGLLEEEVVTVLTENIVKCKNNILAHRILCQYYLLTKEYEAALPYIKNGISLIAYNIKDLGVHLPLTKREFSLDLATVYTYVDAPKDHNAALKLYDNILSGDFSNIQAKMGKGIIFIERKNWKDAMTLLTQVHEQSPNNLEVLSELSWSKAHMGYMDEALAGLDTVIKGIKGMDLRSIDFRALNLWRQAKVYIMKHASINDAKQENVKCAFKLLIQSIKILDTFAPGFSTLGDIYCHYYKDHLRAFKCYFKAFDLDAGDYTAAKYITETYASKPNWQAASSIASRLIKGEKAKAELRSNNWPFRVVGIAHLEKQEESDSIEWFQSALRVDPNDVESWVGLGQAYHACGRIEASIKVFDKAIQLRPSHTFAQYFKAISLCDVGEYLESLDILEKVCQEAATEESFQIGLVEVLMRCSLDLYSQGFLLKSVSIAKDTIERIKIIISELKCENQQVWIYLSQVLRLFIWIESKVDTLPVESLVSIFENSQFSGSEEIDSVDNIKIDTLLDSTTDDNVSIACKFLILASKYSVSDQKFTDIAGTVRASYWYNIGISELTAFITLKEPQYRDAAIFAFKKSIQLQSNISETWIGLGIATMDINFRVSQHCFIKATALEPKATNTWFNLAMLGLKKKDTEFAQQVLNKLQSLAPQDSSPWLGMALILEEQGDIIGSSKLFAHSFILSNGRSKAAQFMYAKNVLENHINNGDDERDIETVEKLTTASIALEQFFKKSPDSQFALQCALLTLERLHHYENANELANRLIGILEKKFEKTQDERELFNFAIIKGQFARIHLGLGNFELSIENADLSQGIISESSDEKSMKTKISNHICLGLSYFFLNDFDQTLNQFQELLSISKDSKHLVVLIAKVLYDVGESDTKEIALQELTEYIATSGADLLVTLTIAAMSILDDKREDLSIILEELKALPLSKQIIDKHKDAPYLIEEITKRLYRNDTGKQVWQRSAYFFPNNLKVWERLDKNIQRRIASNGQNKVTAEEMSKLYCESKNLRSIQRGMFLCPWNVTAVKALNECF

SEQ ID NO: 1303 - protein, 292 aa, Saccharomyces cerevisiae
MACNFQFPEIAYPGKLICPQYGTENKDGEDIIFNYVPGPGTKLIQYEHNGRTLEAITATLVGTVRCEEEKKTDQEEEREGTDQSTEEEKSVDASPNDVTRRTVKNILVSVLPGTEKGRKTNKYANNDFANNLPKEGDIVLTRVTRLSLQRANVEILAVEDKPSPIDSGIGSNGSGIVAAGGGSGAATFSVSQASSDLGETFRGIIRSQDVRSTDRDRVKVIECFKPGDIVRAQVLSLGDGTNYYLTTARNDLGVVFARAANGAGGLMYATDWQMMTSPVTGATEKRKCAKPF

SEQ ID NO: 1304 - protein, 246 aa, Saccharomyces cerevisiae
MSRLEIYSPEGLRLDGRRWNELRRFESSINTHPHAADGSSYMEQGNNKIITLVKGPKEPRLKSQMDTSKALLNVSVNITKFSKFERSKSSHKNERRVLEIQTSLVRMFEKNVMLNIYPRTVIDIEIHVLEQDGGIMGSLINGITLALIDAGISMFDYISGISVGLYDTTPLLDTNSLEENAMSTVTLGVVGKSEKLSLLLVEDKIPLDRLENVLAIGIAGAHRVRDLMDEELRKHAQKRVSNASAR

SEQ ID NO: 1305 - protein, 747 aa, Saccharomyces cerevisiae
MSLLEQLARKRIEKSKGLLSADQSHSTSKSASLLERLHKNRETKDNNAETKRKDLKTLLAKDKVKRSDFTPNQHSVSLSLKLSALKKSNSDLEKQGKSVTLDSKENELPTKRKSPDDKLNLEESWKAIKEMNHYCFLKNDPCINQTDDFAFTNFIIKDKKNSLSTSIPLSSQNSSFLSLKKHNNELLGIFVPCNLPKTTRKVAIENFNRPSPDDIIQSAQLNAFNEKLENLNIKSVPKAEKKEPINLQTPPTESIDIHSFIATHPLNLTCLFLGDTNAGKSTLLGHLLYDLNEISMSSMRELQKKSSNLDPSSSNSFKVILDNTKTERENGFSMFKKVIQVENDLLPPSSTLTLIDTPGSIKYFNKETLNSILTFDPEVYVLVIDCNYDSWEKSLDGPNNQIYEILKVISYLNKNSACKKHLIILLNKADLISWDKHRLEMIQSELNYVLKENFQWTDAEFQFIPCSGLLGSNLNKTENITKSKYKSEFDSINYVPEWYEGPTFFSQLYLLVEHNMNKIETTLEEPFVGTILQSSVLQPIAEINYVSLKVLINSGYIQSGQTIEIHTQYEDFHYYGIVSRMKNSKQILETNTKNNISVGLNPDILEVLVKIHNTEDFTKKQFHIRKGDIIIHSRKTNTLSPNLPNTLKLLALRLIKLSIQTHALSDPVDLGSELLLYHNLTHNAVKLVKILGTNDISINPNQSLIVEVEIIEPDFALNVIDSKYITNNIVLTSIDHKVIAVGRIACQ

SEQ ID NO: 1306 - protein, 826 aa, Oryza sativa
MGSDVGPSTARLNGSCRHGPRAGVPCRSWAGYSAAVLGPARLGPAHLARYTSRLQSSSPQRPKPPPPSPRYRQRRLPSLRPSSSGGRAACRPSPRDRQRRLPSAVPPPPASVAASHQRRPVGVPQAPARDHQSSPLPELARLPCVSRMPRKVVSGPDYDDEYNDDYDEYDEDYDDYGGTGHSDDIQHPTKEKESSKKSSSMVPVLWRCSMCMFDNHESMVYCEMCGVFRESFMKSAKDGSIKVHGIPSDFGTPSMPKSDSTKMPVNTRTTDFGGDPEIKNASISHEKVGSTQYASVGSSSGAGKKVKHIALPEDVPVERTAQLISDHFQLKEDQSSRATSSAQNEDVAQKLSSDIQKLGLEKNEVDTAKPYLPEEYKPEKWMFANEESGVLSQLNLAIVGHVDSGKSTLSGRLLHLLGRISKKDMHKNEKEAKEKGKGSFAYAWAMDESSEERERGVTMTVAVAYLETNKYRVVLLDSPGHKDFVPNMISGATQADAAILVVDACTGSFEAGMDGEGGKSVGQTKEHAQLIRSFGVEQLIVAVNKMDAIGYSKERFEFIKVQLGSFLRACNFKDSSVTWIPLSAVENQNLIKIPSDVRLTSWYQGFCLLDAIDSLQLPSRDVSKPLILPICDVIKSQSTGQLAAFGKLETGAIRIGSKVLISPCGEVATVKSIERDSNSCDIARAGDNVAVSLQGIDGSKLIAGGILCNPGFPVPVSNFLELRVLVLDVTIPILIGYQVEFHIHHVKEAARVTKIVALLDKAGKPSKTAPRFLKSKQNAVVQVTLDAPVCVEEFSKCRALGRAFLRSGGSTIAVGVVTRVLGQDQN

SEQ ID NO: 1307 - protein, 199 aa, Zea mays
MAATAMDHDGGDDVVTPGELLGNSLTLAAGRGAYADGRSVRASVTGRRRIVPPAPASDDQRSTVEVVGHKAHGAVPQPGSVVIARVTKVMARMASADIMCVDSKAIREKFTGMIRQQDVRATEIDKVDMYQSYRPGDIVKAMVLSLGDARAYYLSTAKNELGVVSAQSIAGGTLVPISWTEMQCDLTGQIEQRKVAKVE

SEQ ID NO: 1308 - protein, 287 aa, Zea mays
MVGLSEGEKHFIRGGIAQDVRTDGRRRLQFRSLSVQTGVIPQANGSARVRLGATEIIASVKAELGKPSILHPDKGKVAIFVDCSPTAEPLFEGRGSEELSAELSVSLQRCLLGGKSGAGAAIDLSSLIVVDGKVCWDLYIDGLVVSSDGNLLDALAVAIKVALSDTGIPKVNVSVSAASDEEPEVDVSDEEFLQFDTSGVPVIITLTKVGRHYIVDATSEEESQMSSAVSVSVNRHGQICGLTKRGGAGLDPSVIFDMISVAKHVSQQFISLLDSEIAAAEAEEEAQ

SEQ ID NO: 1309 - protein, 406 aa, Oryza sativa
MAAAATTSSHLLLLSRQQAAASLQCGLSFRRQPGRLAGGSSAPSVRCMAAVDTASAPAATEASKKSSYEITTLTTWLLKQEQAGTIDGEMTIVLASISTACKQIASLVQRAPISNLTGVQGAVNVQGEDQKKLDVVSNEVFSNCLKSSGRTGVIASEEEDVPVAVEESYSGNYIVVFDPLDGSSNIDAAVSTGSIFGIYSPNDECLADIADDQNLDQVEQRCIVSVCQPGSNLLAAGYCMYSSSVIFVLTIGTGVYVFTLDPMYGEFVLTQEKVQIPKAGKIYAFNEGNYALWDDKLKSYMDSLKEPGPSGKPYSARYIGSLVGDFHRTLLYGGIYGYPRDQKSKNGKLRLLYECAPMSFIVEQAGGKGSDGHQRILDIMPTEIHQRVPLYIGSVEEVEKVEKFLA

SEQ ID NO: 1310 - protein, 332 aa, Escherichia coli
MKTLGEFIVEKQHEFSHATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYTTGCGVHAFTYDPSLGVFCLCQERMRFPEKGKTYSINEGNYIKFPNGVKKYIKFCQEEDKSTNRPYTSRYIGSLVADFHRNLLKGGIYLYPSTASHPDGKLRLLYECNPMAFLAEQAGGKASDGKERILDIIPETLHQRRSFFVGNDHMVEDVERFIREFPDA

SEQ ID NO: 1311 - protein, 388 aa, Synechocystis sp. PCC 6803
MDSTLGLEIIEVVEQAAIASAKWMGKGEKNTADQVAVEAMRERMNKIHMRGRIVIGEGERDDAPMLYIGEEVGICTREDAKSFCNPDELVEIDIAVDPCEGTNLVAYGQNGSMAVLAISEKGGLFAAPDFYMKKLAAPPAAKGHVDIDKSATENLKILSDCLNRSIEELVVVVMDRPRHKELIQEIRNAGARVRLISDGDVSAAISCAFSGTNIHALMGIGAAPEGVISAAAMRCLGGHFQGQLIYDPEVVKTGLIGESREGNLERLASMGIKNPDQVYNCEELACGETVLFAACGITPGTLMEGVRFFHGGVRTQSLVISSQSSTARFVDTVHMKGKPQSNPTALISLSATIPKKVKTWGNTSPFPLSPEVQTLGDLCFGWVIVTGV

SEQ ID NO: 1312 - protein, 347 aa, Synechocystis PCC6803
MTVSEIHIPNSLLDRDCTTLSRHVLQQLNSFGADAQDLSAIMNRIALAGKLIARRLSRAGLMADVLGFTGETNVQGESVKKMDVFANDVFISVFKQSGLVCRLASEEMEKPYYIPENCPIGRYTLLYDPIDGSSNVDINLNVGSIFAIRQQEGDDLDGSASDLLANGDKQIAAGYILYGPSTILVYSLGSGVHSFILDPSLGEFILAQENIRIPNHGPIYSTNEGNFWQWDEALRDYTRYVHRHEGYTARYSGALVGDIHRILMQGGVFLYPGTEKNPDGKLRLLYETAPLAFLVEQAGGRASDGQKRLLDLIPSKLHQRTPAIIGSAEDVKLVESFISDHKQRQGN

SEQ ID NO: 1313 - protein, 429 aa, Oryza sativa
MSSPPPAAAAAMAVDDADDDQLASMSTENIVRATRLLDNETRVLKDELQRTNLEVESYKEKIKENQEKIKLNKQLPYLVGNIVEILEMNPEDEAEEDGANIDLDSQRKGKCVVLKTSTRQTIFLPVIGLVDPEKLKPGDLVGVNKDSYLILDTLPSEYDSRVKAMEVDEKPTEDYNDIGGLEKQIQELVEAIVLPMTHKDRFQKLGIRPPKGVLLYGPPGTGKTLMARACAAQTNATFLKLAGPQLVQMFIGDGAKLVRDAFQLAKEKSPCIIFIDEIDAIGTKRFDSEVSGDREVQRTMLELLNQLDGFSSDERIKVIAATNRADILDPALMRSGRLDRKIEFPHPSEEARARILQIHSRKMNVNPDVNFEELARSTDDFNGAQLKAVCVEAGMLALRRDATEVTHEDFNEGIIQVQAKKKSSLNYYA

SEQ ID NO: 1314 - protein, 434 aa, Saccharomyces cerevisiae
MATLEELDAQTLPGDDELDQEILNLSTQELQTRAKLLDNEIRIFRSELQRLSHENNVMLEKIKDNKEKIKNNRQLPYLVANVVEVMDMNEIEDKENSESTTQGGNVNLDNTAVGKAAVVKTSSRQTVFLPMVGLVDPDKLKPNDLVGVNKDSYLILDTLPSEFDSRVKAMEVDEKPTETYSDVGGLDKQIEELVEAIVLPMKRADKFKDMGIRAPKGALMYGPPGTGKTLLARACAAQTNATFLKLAAPQLVQMYIGEGAKLVRDAFALAKEKAPTIIFIDELDAIGTKRFDSEKSGDREVQRTMLELLNQLDGFSSDDRVKVLAATNRVDVLDPALLRSGRLDRKIEFPLPSEDSRAQILQIHSRKMTTDDDINWQELARSTDEFNGAQLKAVTVEAGMIALRNGQSSVKHEDFVEGISEVQARKSKSVSFYA

SEQ ID NO: 1315 - protein, 1729 aa, Saccharomyces cerevisiae
MVASTKRKRDEDFPLSREDSTKQPSTSSLVRNTEEVSFPRGGASALTPLELKQVANEAASDVLFGNESVKASEPASRPLKKKKTTKKSTSKDSEASSANSDEARAGLIEHVNFKTLKNGSSLLGQISAITKQDLCITFTDGISGYVNLTHISEEFTSILEDLDEDMDSDTDAADEKKSKVEDAEYESSDDEDEKLDKSNELPNLRRYFHIGQWLRCSVIKNTSLEPSTKKSKKKRIELTIEPSSVNIYADEDLVKSTSIQCAVKSIEDHGATLDVGLPGFTGFIAKKDFGNFEKLLPGAVFLGNITKKSDRSIVVNTDFSDKKNKITQISSIDAIIPGQIVDLLCESITKNGIAGKVFGLVSGVVNVSHLRTFSEEDLKHKFVIGSSIRCRIIACLENKSGDKVLILSNLPHILKLEDALRSTEGLDAFPIGYTFESCSIKGRDSEYLYLALDDDRLGKVHSSRVGEIENSENLSSRVLGYSPVDDIYQLSTDPKYLKLKYLRTNDIPIGELLPSCEITSVSSSGIELKIFNGQFKASVPPLHISDTRLVYPERKFKIGSKVKGRVISVNSRGNVHVTLKKSLVNIEDNELPLVSTYENAKNIKEKNEKTLATIQVFKPNGCIISFFGGLSGFLPNSEISEVFVKRPEEHLRLGQTVIVKLLDVDADRRRIIATCKVSNEQAAQQKDTIENIVPGRTIITVHVIEKTKDSVIVEIPDVGLRGVIYVGHLSDSRIEQNRAQLKKLRIGTELTGLVIDKDTRTRVFNMSLKSSLIKDAKKETLPLTYDDVKDLNKDVPMHAYIKSISDKGLFVAFNGKFIGLVLPSYAVDSRDIDISKAFYINQSVTVYLLRTDDKNQKFLLSLKAPKVKEEKKKVESNIEDPVDSSIKSWDDLSIGSIVKAKIKSVKKNQLNVILAANLHGRVDIAEVFDTYEEITDKKQPLSNYKKDDVIKVKIIGNHDVKSHKFLPITHKISKASVLELSMKPSELKSKEVHTKSLEEINIGQELTGFVNNSSGNHLWLTISPVLKARISLLDLADNDSNFSENIESVFPLGSALQVKVASIDREHGFVNAIGKSHVDINMSTIKVGDELPGRVLKIAEKYVLLDLGNKVTGISFITDALNDFSLTLKEAFEDKINNVIPTTVLSVDEQNKKIELSLRPATAKTRSIKSHEDLKQGEIVDGIVKNVNDKGIFVYLSRKVEAFVPVSKLSDSYLKEWKKFYKPMQYVLGKVVTCDEDSRISLTLRESEINGDLKVLKTYSDIKAGDVFEGTIKSVTDFGVFVKLDNTVNVTGLAHITEIADKKPEDLSALFGVGDRVKAIVLKTNPEKKQISLSLKASHFSKEAELASTTTTTTTVDQLEKEDEDEVMADAGFNDSDSESDIGDQNTEVADRKPETSSDGLSLSAGFDWTASILDQAQEEEESDQDQEDFTENKKHKHKRRKENVVQDKTIDINTRAPESVADFERLLIGNPNSSVVWMNYMAFQLQLSEIEKARELAERALKTINFREEAEKLNIWIAMLNLENTFGTEETLEEVFSRACQYMDSYTIHTKLLGIYEISEKFDKAAELFKATAKKFGGEKVSIWVSWGDFLISHNEEQEARTILGNALKALPKRNHIEVVRKFAQLEFAKGDPERGRSLFEGLVADAPKRIDLWNVYVDQEVKAKDKKKVEDLFERIITKKITRKQAKFFFNKWLQFEESEGDEKTIEYVKAKATEYVASHESQKADE

SEQ ID NO: 1316 - protein, 994 aa, Oryza sativa
MGAANFAHSLADKPKQMPERLANTIFTSCASTLPKCSPSIDVLHIGHIKEHFSAEVIWHHKHYGQILPGDAYQNDSSQPSTSGSSSSLSAVWDQTTCSSAMRTLPMDSFSTVNGQNLSTNNKSLYPTTGQGPLLQQYIECEMKQETWSRSLEQSDQSNITTGNRDLYHAQIHPYINGEHKRDRCIQMKEKLGHTSDHEGFSREKSSNLSNHFMHHQQGFMTNYGACSPVSKTVDRAEQTSNSTVSKPTSPASDGSSGKHYPAKRLKVDVPHLVHVNEMEASKEQQPAANETYASAETVQSEVTNSPTKSPCCTSLGDNIACTDNVHGMDMVRLSGSAVQTEEEFRRENSDIEMKDAKVDLLDQTLSGDSLRARKRRGASVLYALTSEELKDHLCTLNHDTSQSKVPTEELLSVEGLPDQNTCNLCGMERLLFEPPPRFCALCFKIINSTGSYYVEVENGNDKSSICGRCHHLSSAKAKYQKRFSYAETDAEAEWWVQCDKCKAWQHQICALFNPKIVDPEAEYTCAKCFLKEKDNEDVDSLEPSTILGARELPRTRLSDHIEQRLSERLVQERQQRAIASGKSVDEVPGVEGLTVRVVSSADRTLQVQPRFKDFFKKEQYPGEFPYKSKAILLFQKNEGVDVCLFAMYVQEYGSACPSPNQRHVYLAYIDSVKYFRPEIKSASGEALRTFVYHEILIGYLDFCKKRGFVSCSIWTCPSTKRDDYVLYCHPTIQKMPKSDKLRSWYQNLVKKAVKEGVVVERNTLYDFFLQPTNECKTNISAAWLPYCDNDFWPGEAERLLEKKDDDTSQKKETQLGRLLRVAKRDDRKGNLEDILLVHKLGERLRTMKEDFLMLCLQQFCKHCHHPIVSGSSWVCTSCKNFFLCERCYAEELNTPLKDRHPATTKQKHAFERIEEEPLPETDDVDPTMESKNCSSMVYDVIPVPVVEEVAICVYSCGNCCSRTHCFVTMQTVQLPDAGKVCITRNIDLPSGVVK

SEQ ID NO: 1317 - protein, 826 aa, Oryza sativa
MVVVDASEFGAEGFDPKRWINAALDARHPSEPLDRFLADAEERLRSAADDAAAALERDSADALRRVPLACRDALRLRDDAVSLRSHLASVLQSLSQQAEGSSAESITALARIDTVKQRMEAAYATLQDAAGLAQLSQSVEDVFSSGDLPKAAETLATMRHCLSAVGEVAEFANVRKQLEVLEERLDDMVQPRLVDALSNRKVDAVQDLRGILIRIGRFKSLEVQYTKIHVKPLKKLWEDFDLKQRAKRVEMEKYGGESINSLSFASWLPNFYDETLLYLEQEWKWCLTAFPEEYKSLVPKVLVETMSELNSSFVSRVNLATGDAVPETRSVAKGILDVLSGDLPKSTKLQNKHLGALIDLHNMTGTFARNIQHLFSESDLLVLLNTLKAIYSPYETFKARYGQMERALLSAEMAGIDIRGAIARGVGAQGIELSETVRRMEESIPQIIVLLEAAVERCISLTGGSEADELVLALDDIMLQYISNLQETLKSLRIVCGVDNTAHSDSSKKEAGLEKKEAQRLVDVSEEEEWSIVQGALQILTVADCLTSRTSVFEASLRATLARIGTNFSISGFGSSLDKSTAANGDENAEVPITGRAALDIAAIRLTDLPDKSKKLFTVLEQSKDPRFHALPLTSQRVAAFSDTVNELVYDVLISKVRQRLNEVARLPIWSSVEEPGGLPLPSFSAYPQAYVTSVGEYLLTLPQQLEPLAEGISGGEAGNEEAQFFATEWIFKVAEGATALFMEQLRGIHYITDRGAQQLAADIEYLSNVLSALSMPIPPFLATFHTCISTPRDQVRDLIKSDGGSQLDLPTAHLVCKIRRISSSD

SEQ ID NO: 1318 - protein, 243 aa, Zea mays
MASADLLRKEEEFYSSLFDSAKGDGVKSRSQVIERKIESLEDMATKVSNRRSRRWLNDRLLIELVPRLHVEEIKGLFAPPPWGEELPLSAFCRTSVSDWEAFRSIDMDAEARLMQHMKRSSEKQRTHVDEDELIALNAWRRIGRQTREAIKKKFLPDLLQIYEEQVRAFIEGTGDSDVLVLNVQDPFQRLLLHGVCEFYNVTSMTTSSVRDGKPWKSTTIKKRHVTGLPPRITLVSFLRMRKN

SEQ ID NO: 1319 - protein, 162 aa, Zea mays
MASPSSSPSRKALSKIACSRLQKELAEWQVNPPAGFKHRVTDDLQRWVIDVAGAAGTLYTGETYKLQVDFPEHYPMEAPQVIFLHPAPMHPHIYSNGHICLDILYDSWSPAMTVSSICISILSMLSSSPEKQRPADNDRYVKNCRNGRSPKETRWWFHDDTV

SEQ ID NO: 1320 - protein, 232 aa, Zea mays
MAPSLLGGFTKSLAMTVLSEIGDKTFFAAAILAMRHPRKLVLAGCLTALIVMTALSASLGWVAPNLISRKWTHHLTTLLFFLFGIWSLWEGFKEDGDSEELAEVEAELDAAFKSNKGESKNKFKANDDMKKQQRPFLMQFFSPIFLKAFSITFFGEWGDKSQIATIGLAADENPFGVVLGGIIAQALCTTAAVLGGKSLASQISEKMVELSSGVLFLLFGIMSLLSGPEGEL

SEQ ID NO: 1321 - protein, 429 aa, Oryza sativa
MSSPPPAAAAAMAVDDADDDQLASMSTEDIVRATRLLDNETRVLKDELQRTNLEVESYKEKIKENQEKIKLNKQLPYLVGNIVEILEMNPEDEAEEDGANIDLDSQRKGKCVVLKTSTRQTIFLPVIGLVDPEKLKPGDLVGVNKDSYLILDTLPSEYDSRVKAMEVDEKPTEDYNDIGGLEKQIQELVEAIVLPMTHKDRFQKLGIRPPKGVLLYGPPGTGKTLMARACAAQTNATFLKLAGPQLVQMFIGDGAKLVRDAFQLAKEKSPCIIFIDEIDAIGTKRFDSEVSGDREVQRTMLELLNQLDGFSSDERIKVIAATNRADILDPALMRSGRLDRKIEFPHPSEEARARILQIHSRKMNVNPDVNFEELARSTDDFNGAQLKAVCVEAGMLALRRDATEVTHEDFNEGIIQVQAKKKSSLNYYA

SEQ ID NO: 1322 - protein, 247 aa, Zea mays
MASADLLRREEEFYSSLFDSAKGDGARSRSQLIERKIEALEDMATRVSNRRSRKWFNDRLLIELVPRLYVEEIKGLFAPPPWGEQVPLSAFYRANVGEWDSFRSIDMDAEARLMQHMKKSLEKPRNHVDEGESIALNAWHRIDRHTREAIKRNFLPDLLGIYEERVRAFIEDASDKDALVLNVQDPFQRLLLHGVCEFYNVSSTTTSSVREDGRPWKATTIKKRQGTGVPSRITLVSFLRMKKNGSQ

SEQ ID NO: 1323 - protein, 669 aa, Zea mays
MKVANGLSLRKSNGRFKSKLMMELVKQWREHQANMRCMNLSKRNNNIYVGAEGANITSPNDSNIWPTSALVAKNSNPRYVLASKCASQPPTMWLENSLNTSSGFKCSKLSIVRNALPSKTPKASVSWKSKDDSNAIPRHLEQSHCKKTSRATRTHFKAMPNLIHKAKNVDTSNLNDGTSGSSWRGQSDSYKGEDINIGKECTKTSELLKSREASRKSNILVVDRKDPNKDEPDKVKGIQDEVMTKEEGVKGHTCEGRATCWSCLKQANTTKTNDAPNLGSLLVGNEHMQGLMSNLRDNSSHLFEKNHSRHQRDDPCEYRETNLKFPNRIQSVGGNGKTNDVTSRRKRLLLEEKASAHVQNDLTYGPMKRRRYIEANEDEEEQNDLTYGPMKRRRYIEANEDEEDYVGDHHPVHIEDATTELTPQDSISKHCVERQCYCCSKPIDIPRWSGTFKIDGKEHISLAGHLSSKSCEKVWKLSSLPKVVQVTKVPRMAVWPKIFKASEPSGDNIGLYFFPPEMRHDEELDQLVNEVMDKDLILRAIIGEAEMLIFPSVLLPERYQTFQTKHYLWAAFKAKEDKGDAIVEEEVEKGNCVSNQPDKVQSDNASFPSNHGLDRPSMEAPPQSSSSVFGIVVRQAPNLEPEVKRFIQEMERKGALVTVMRGEAIGGGP

SEQ ID NO: 1324 - protein, 669 aa, Zea mays; identical to SEQ ID NO: 1323

SEQ ID NO: 1325 - protein, 199 aa, Arabidopsis thaliana
MVQTKKFRGVRQRHWGSWVAEIRHPLLKRRIWLGTFETAEEAARAYDEAAVLMSGRNAKTNFPLNNNNTGETSEGKTDISASSTMSSSTSSSSLSSILSAKLRKCCKSPSPSLTCLRLDTASSHIGVWQKRAGSKSDSSWVMTVELGPASSSQETTSKASQDAILAPTTEVEIGGSREEVLDEEEKVALQMIEELLNTN

SEQ ID NO: 1326 - protein, 243 aa, Oryza sativa
MGQSKKKFRGVRQRHWGSWVSEIRHPLLKRRVWLGTFETAEEAARAYDEAAILMSGRNAKTNFPVARNATGELTPAAAVAGRDGRVGGGSGSSSSMTANGGGNSLSQILSAKLRKCCKTPSPSLTCLRLDPEKSHIGVWQKRAGARADSSWVMTVELNKDTAVSSAATVAAATAVSSSDQPTPSDSTVTTTSTSTTGSPSPPPPAMDDEERIALQMIEELLGRSGPGSPSHGLLHGGEGSLVI

SEQ ID NO: 1327 - protein, 446 aa, Zea mays
MAATRRAFFHSAVDGIARAGPGEAERLPAPPQVGRPVEGASSMVLGFPVPRPTMPDRRPAAVTQQFFPPTTTAAQQATMEEQCHVPAGSAAEQWVRSSASRKSRRGPRSRSSQYRGVTFYRRTGRWESHIWDCGKQVYLGGFDTAQAAARAYDQAAIKFRGLNADINFTLDDYKDEMKKMKDLSKEEFVLVLRRQGAGFVRGSSRFRGVTQHKCGKWEARIGQLMGKKYVYLGLYDTETEAAQAYDKAAIKCYGKEAVTNFDAQSYDKELQSQPWDGELDLELSLGCASSDPSTVAVEAFSPATSSSSRKQRTMTLTLGLPEEEETGAGYPHPAAGMFGRPADGHVHVAPPPHRQWQQQQQGQHAAPDAAPERRAAEPADRQRWGRGARWPIASASGINWAWAPPYATARAGTDDDDASSAAAAASSGFPLWQLGAASSRSSWPSC

SEQ ID NO: 1328 - protein, 494 aa, Oryza sativa
MPGAAGYSGSVKLKYVKLGYQYLVNHFLTLLLVPVMAATALELARMGPGELLSLWRSLQLDLVHILCSVFLVVFVGTVYFMSRPRPVYLVDYSCYKPPPSCRVPFATFMEHTRLITDDEKSVRFQTRILERSGLGEETCLPPANHYIPPNPSMEASRAEAQLVIFSAIDDLVRRTGLKPKDIDILVVNCSLFSPTPSLSAMIINKYKLRSNIRSFNLSGMGCSAGLISLDLARDMLQVHPNSNALVVSTEIITPNFYWGTRRDMMLPNCLFRMGAAAILLSNRRREARRAKYRLMHVVRTHKGADDRAYRCVYEEEDEQGHSGISLSKELMAIAGDALKSNITTIGPLVLPMSEQLLFFFRLVGRKLINKKWKPYIPDFKLAFEHFCIHAGGRAVIDELQKNLDLSAQHVEASRMTLHRFGNTSSSSLWYELAYIEAKGRMRRGDRVWQIGFGSGFKCNSAVWKCLRTVKTPADGPWDDCIHRYPVDIPEVVKL

SEQ ID NO: 1329 - protein, 213 aa, Zea mays
MTENLHSRKMVQPKKFRGVRQRHWGSWVSEIRHPLLKRRVWLGTFETAEEAARAYDEAAVLMSGRNAKTNFPIQRSSTGEPTPAAGRDARSNFSSGSSTTNLSQILSAKLRKCCKAPSPSLTCLRLDPEKSHIGVWQKRAGARADSNWVMTVELNKDAASTDAASQSTSATTAPPATPMDEEERIALQMIEELLSSSSPASPSNGDDQGRFII

SEQ ID NO: 1330 - protein, 650 aa, Zea mays
MSRDLDCPVQTQMAVAVLDRSFSSEYPGGSRIEGRQLSWKRVFVQTDNGSVLGIELERGENVQTVKKKLQIALNVPTDESSLTFGDLVLNNDLSSIRNDSPLFLKRNQIHRSNSTPCLSPTGKNVLQRDRSGPIEILGCSSPSSRMKQLAKDVIKAIMNDVDPVAVNSGMGGAYYFKNIWGERVAIVKPTDEEPFAPNNPKGFVGKALGQPGLKRSVRVGETGFREVAAYLLDYGHFANVPPTMLVKITHTIFNVNDCVGCKSKVFCNKSEAVSKIASLQEFIPHDFDASDHGTSSFPVSAVHRIGILDIRIFNTDRHAGNLLVKKLGPGADNFGEQTELIPIDHGLCLPECLEDPYFEWIHWPQASVPFSEEELEYIARLDPVKDAEMLRMELPMIRDACLRVLVLSTVFLKEAAASGLCLSEIGDMMSRQFTAKEEEPSQLELLCMEARKWVEERESFLPNEAGVEDDDDDFTQFLIDGEDDYPDALEPSAFCKFGSMKASSRNPLSKLDERDEEDGDGTEEDDDDDILTGALPQRISSISKLSSSMKGLGFIGKPKPYRTCLRKGKATGRTKYTGKASEHQSGSRSANELLPPSASFVKLSDMSPKQWSAFLDKFQELLPGALSARKHAAGVVGQRSMPRLGTSCQF

SEQ ID NO: 1331 - protein, 621 aa, Zea mays
MSPNLDSAIKSQVPALLLRRLFGASRRDEAKQLQRTPAPVGRRRVFVQTETGCVLGMDLDRGDNAHTVKRRLQLAFNMPTGGTSLTFGDRVLENDLSFLRPDSPLLLTRNSINRSCSTPCLCPVSKDFEHKDCSGLVEMLGCSSSCARVKRLVDDVVTAIRSGVDPVPISSGLGGSYYFRNVLGDRVAIVKPTDEEPFAPNNPKGFVGRALGQPGLKRSVRVGETGFREVAAFLLDHDNFANVPATALVKITHSIFNINCPVNGGNLAPAHDQQQQVNSKIASFQQFIAHDFDASDHGTSSFPVAAVHRIGILDIRIFNTDRHAGNVLVRKLNGGTGRFGCQTELFPIDHGMCLPENLEDPYFEWIHWAQASIPFSEEELEYIRNLDPRKDVQMLRRELPMIREACLHVLALCTIFLKEAAAFGLCLAEIGEMMTREFRGMEEEPSQLELMCMEARKRVAEWEPFSATAEHGEDTDFQFSVDMLGEYSDVVRSPRFNGSGSKVSSFRSPLSKLVESVDEGSDGHEDQNESDRVLYAGWNTSSVPSKAMGHSGNASKSAMNRSADEQLPSSMCFVRLSDMSADEWDVFLEKFQELLKETLHESARAAAGQRMKQRLGTSCKF

SEQ ID NO: 1332 - protein, 472 aa, Zea mays
MSSARVRGPFTPPQWIELEHQALIYKYLSANSPVPHSLLVPIRRSGSLASSPYPPPYFGTSTFGWGSFQLGYSGNADLEPGRCRRTDGKKWRCSRDAVADQKYCERHMNRGRHRSRKHVEDQPGHAAKAMSAVAVAAAAAAATQHAAALAGAGATAAAGLAVNRHRQPGKSYATGATDPCSLQYSRELANKLSNESENMQDSDNVSMLTSMNTGNTAGSVFPFSKQNTALFEVSSSRPEFGLVPSDSLTSSPHSSLKSVKNLLSSRSLSEHQSSASLQHFVDWPRTPPAQGGLSWPEAEDMPRAQRSQLSVSAPMASSELSSASTSPIHDHEKLILSPLKLGREYTPSGVVSAAANRYEVSQLEATWATMFRDSSTGGPLGEVLAKNNSNAEARGCPSAAPPLTDYYCWDSGHGMQSSPVGVLQRTTAFGSVSSSTGSSPRVENHGACCDGTSNLMDDLGSVVVRHPSIRLL

SEQ ID NO: 1333 - protein, 396 aa, Oryza sativa
MMMMSGRPSGGAGGGRYPFTASQWQELEHQALIYKYMASGTPIPSDLILPLRRSFLLDSALATSPSLAFPPQPSLGWGCFGMGFGRKAEDPEPGRCRRTDGKKWRCSKEAYPDSKYCEKHMHRGKNRSRKPVEMSLATPPPPSSSATSAASNSSAGVAPTTTTTSSPAPSYSRPAPHDAAPYQALYGGPYAAATARTPAAAAYHAQVSPFHLHIDTTHPHPPPSYYSMDHKEYAYGHATKEVHGEHAFFSDGTEREHHHAAAGHGQWQFKQLGMEPKQSTTPLFPGAGYGHTAASPYAIDLSKEDDDEKERRQQQQQQQQHCFLLGADLRLEKPAGHDHAAAAQKPLRHFFDEWPHEKNSKGSWMGLEGETQLSMSIPMAANDLPITTTSRYHNDE

SEQ ID NO: 1334 - protein, 369 aa, Zea mays
MEGGRDVFLGAAARAPPPPPSCPFHGSATATRSGGAQMLSFSSNGVAGLGLCSGASKMQGVLSRVRRPFTPTQWMELEHQALIYKHFAVNAPVPSSLLLPIKRSLNPWSSLGSSSLGWAPFRSGSADAEPGRCRRTDGKKWRCSRDAVGDQKYCERHIKRGCHRSRKHVEGRKATPTTADPTMAVSGGSLLHSHAVAWQQQGKSSAANVTDPFSLGSNRNLLDKQNLGDQFSVSTSMDSFDFSSSHSSPNQAKVAFSPVAMQHEHDQLYLVHGAGSSAENVNKSQDGQLLVSRETIDDGPLGEVFKGKSCQSASADILTDHWTSTRDLRPPTGVLQMSSSNTVPAENHTSNSSYLMARMANSQTVPTLH

SEQ ID NO: 1335 - protein, 264 aa, Nostoc PCC7120
MSSTLYRRQLLKLLGMSVLGTSFSSCVTSPARAKTVNWGYIGKVGPEHWGELSPDFALCQIGRKQTPIDLQIADVKDVHSSSQDLLVTNYQPTALHLINNGKTVQVNYQPGSYLKYAHQKFELLQFHFHHFSEHRVDGKLYDMELHLVHRSKSGDLAVMGIFLQAGAFNPTLQIIWDATPQNQGTDKRIEDINIDASQFLPAQHRFFTYSGSLTTPPCSENVLWCVMATPIEASPAQIAKFSQMFPQNARPVQPLNDRLVIEAI

SEQ ID NO: 1336 - protein, 358 aa, Chlamydomonas reinhardtii
MSSDAMTINESLMEVEHTPAVHKRILDILPGISGGVARVMIGQPFDTIKVRLQVLGQGTALAAKLPPSEVYKDSMDCIRKMVKSEGPLSFYKGTVAPLVGNMVLLGIHFPVFSAVRKQLEGDDHYSNFSHANVLLSGAAAGAAGSLISAPVELVRTKMQMQRRAALAGTVAAGAAASAGAEEFYKGSLDCFKQVMSKHGIKGLYRGFTSTILRDMQGYAWFFLGYEATVNHFLQNAGPGVHTKADLNYLQVMAAGVVAGFGLWGSMFPIDTIKSKLQADSFAKPQYSSTMDCLKKVLASEGQAGLWRGFSAAMYRAIPVNAGIFLAVEGTRQGIKWYEENVEHIYGGVIGPATPTAAQ

SEQ ID NO: 1337 - protein, 467 aa, Synechococcus sp. PCC 7942
MTVWQTLTFAHYQPQQWGHSSFLHRLFGSLRAWRASSQLLVWSEALGGFLLAVVYGSAPFVPSSALGLGLAAIAAYWALLSLTDIDLRQATPIHWLVLLYWGVDALATGLSPVRAAALVGLAKLTLYLLVFALAARVLRNPRLRSLLFSVVVITSLFVSVYGLNQWIYGVEELATWVDRNSVADFTSRVYSYLGNPNLLAAYLVPTTAFSAAAIGVWRGWLPKLLAIAATGASSLCLILTYSRGGWLGFVAMIFVWALLGLYWFQPRLPAPWRRWLFPVVLGGLVAVLLVAVLGLEPLRVRVLSIFVGREDSSNNFRINVWLAVLQMIQDRPWLGIGPGNTAFNLVYPLYQQARFTALSAYSVPLEVAVEGGLLGLTAFAWLLLVTAVTAVRQVSRLRRDRNPQAFWLMASLAGLAGMLGHGLFDTVLYRPEASTLWWLCIGAIASFWQPQPSKQLPPEAEHSDEKM

SEQ ID NO: 1338 - protein, 310 aa, Chlamydomonas reinhardtii
MRSAVLQRGQARRVSCRVRADGSGVDSLPSTSASSSARPLIDRRQLLTGAAASVITFVGCPCPLCKPGEAKAAAWNYGEVAGPPTWKGVCATGKRQSPINIPLNTSAPKVDAEMGEFDFAYGSFEKCDVLNTGHGTMQVNFPAGNLAFIGNMELELLQFHFHAPSEHAMDGRRYAMEAHLVHKNKSTGNLAVLGIMLEPGGLIKNPALSTALEVAPEVPLAKKPSPKGINPVMLLPKKSKAGTRPFVHYPGSLTTPPCSEGVDWFVFMQPIKVPDSQILDFMRFVGDNKTYATNTRPLQLLNSRLVEYEL

SEQ ID NO: 1339 - protein, 598 aa, Zea mays
MSEEDEDQPPAKRPSPSPPADQVLDNVLETVLQFLDAPRDRSAASLVCRSWHSAESATRESVAVRNLLAVSATRTARRFPNARSLLLKGRPRFADFNLLPHGWDASAFRPWAAAVAAGAFPALTSLYLKRIPVTDADLDLLSRSLPASFRDLTLHLCDGFTSRGLASIASHCRGLRVLDVVECDMAEEQEVVDWVAAFPQEPSNLESLSFECYEPPVAFAALEALVERSPRLRRLGVNLHVSLGQLCRLMAHAPRLSHLGTGSFRPADGGEEGTGFGEVVSAFVAAGRARTLVSLSGFRDLAQEYLPTIAVVCAHLKSLDLSYSAVTPNQILMFIGQCYNLETLWVLDSVRDEGLDAVGISCKKLQSLRVLPLNAHEDADELVSEVGLTAISRGCPALRSILYFCQTMTNAAVVDMSRNCPELKVFRLCIMGRHQPDHATGEPMDEGFGAIVQNCSKLTRLSTSGQLTDRAFEYIGRHGKSLRTLSVAFAGNSDVALQYILQGCPKLEKLEIRDCPFGDAGLFAGMHHFYNMRFVWMSGCNLTLQGCKEVAQVLPRMVVELINGQSDENERNESVDILYMYRSLDGPREDVPPFVKIL

SEQ ID NO: 1340 - protein, 394 aa, Glycine max
MSDHLPREVLTEILSRLPVRSLLRFRSTSKSWKSLIDSQHLNWLHLTRSLTLASNTSLILRVDSDLYQTNFPTLDPPVSLNHPLMCYSNSITLLGSCNGLLCISNVADDIAFWNPSLRQHRILPYLPVPRRRHPDTTLFAARVCGFGFDHKTRDYKLVRISYFVDLHDRSFDSQVKLYTLRANAWKTLPSLPYALCCARTMGVFVGNSLHWVVTRKLEPDQPDLIIAFDLTHDIFRELPLPDTGGVDGGFEIDLALLGGSLCMTVNFHKTRIDVWVMREYNRRDSWCKVFTLEESREMRSLKCVRPLGYSSDGNKVLLEHDRKRLFWYDLEKKEVALVKIQGLPNLNEAMICLGTLVPPYFLPRQICRKPRALGCERPRKTRDDFLSQGFKLTL

SEQ ID NO: 1341 - protein, 563 aa, Glycine max
MGQSVSSAAVASRRERDQGHRSVNSSKTRFTASVSPMAGYSSGAAEEGENHRVEAVADESTDYISDLPNECLASVFQFLSSADRSRCSLVCRRWLQIEGQSRHRLSLNAELDLFPAIPSLFSRFDSVTKLALKCDRRSVSIRDDALVLISQRCPNLTRLKLRACRELTDAGMEAFAKNCKGLKKLSCGSCTFGSKGMNAVLDNCAALEELSVKRLRGIADTAAAEPIGPGVAAASLKTVCLKELYNGQCFGTLILGAKNLKTLKLFRCSGDWDRLFQLLVDRVTKIVEVHLERLQISDVGLQAIANYSSLEILHLVKTPECSDIGLVAIADRCKLLRKLHIDGWKANRIGDEGLIAVAKGCPNLLELVLIGVNPTKASLEMLASNCQNLERLALCGSDSVGDPEISCIAAKCVALKKLCIKSCPVSDQGMEALGNGCPNLVKVKVKKCKGVTPEGGDWLRRTRGSVAVNLDTGEAELQEASASDGGAQDNGVEFPQMPAQIAAASSSTRSSSSRFALMSARISAAALRSTRSGSSRLGLLPTRISAASTFRRWSGGSTSARHG

SEQ ID NO: 1342 - protein, 480 aa, Zea mays
MSFRSIVRDVRDGFGSLSRRSFEVTLASIYGLTGHHKGKTQSSSHVLDDSPSIIRESRWANLPPELIRDIIRRLEADESTWPARKHVVCFAAVCRTWREMCKEIVLSPEFCGKLTFPVSLKQPGPRDGNTMVQCFIKRNKSKSTYHLYLCLSNVVTSESGKFLLSAKRHRKTTCTEYTISMDSGNISRSKRTYIGKIRSNFLGTRFLIYDTQPPYNGAVVPPAGRTSRRFNSTKVSPKLPSVSYNIAQVSYELNVLGTRGPRRMRCIMHSIPASSVEPGGTVPGQPEQIVPRALEDSFRSTASFSQSFRSTASFSKSIMDSSMDFNSARFSDIAGSSARFTGVPGSSARFAGVPGSSARFSGIAGARLDNDEESETKERPLVLRNKPPRWHEQLQCWCLNFRGRVTIASVKNFQLIAAATPPPAGAPTPSQPAPSDPDKVILQFGKVARDMFTMDYRYPLSAFQAFAICLSSFDTKLACE

SEQ ID NO: 1343 - protein, 251 aa, Zea mays
MQCFIKRNKNNSTFYLYLGFTSSPVDKGKFLMAARRFRRGPHTEYIISLDAEDLSQGSNAYMGKLRSDFWGTNFKIYDSKPPYDGAKASSSRSSRRFGSRRISPQVSAGNYEVGQVSYKYNLLKSRGPRRMYCTLECPSAQETWENSLKTKFRRPLGPTTLRNKAPRWHEHLQCWCLNFHGRVTVASVKNFQLVAAADPSEPTTNVDDETVLLQFGKVDSDMFTMDYRQPLSAFQAFAISLSSFGTKLACE

SEQ ID NO: 1344 - protein, 406 aa, Oryza sativa
MSFRSVIQEVKGEIGAISRRGFRSRPGRVRRVAAAAEEPPDESSAAALVMRESCWTQLPPELLREVLARVEESEGWWPRRRDVVACAGVCRSWRGIVREIVRTPEASGNLTFPISLKQPGPRDAPMKCFIVRNRTTQTYYLYIGLTDALTDDGKFLLAARKCRRTTCTEYLISLDMNDISKRTDSYVGKLRSNFLGTKFTIYDAHPPYAGDVISKGQSARVIGSNHLSPRIPAGNYPVSHISYELNVLGSRGPRRMHCAMDSIPVSAIEQGGTAPTQTEFPLSYHESFTSIPFFKSKSVRANNSTASLLTQNGSKLVLKNKSPRWHEHLQCWCLNFHGRVTVASVKNFQLVASDESNPTNQEHDDVILQFGKVGKDMFTMDYRYPISAFQAFAICLSSFDTKIACE

SEQ ID NO: 1345 - protein, 358 aa, Zea mays
MPRDGAQAAPPPERGEMDEVVEADPDTEAEDQEERWARLLPELLSDVVRRVEASGGERWPARKDVVSCACVCRRWREAAVSVVRPPAESGKITFPSSLKQPGPRERPMQCFIKRNKNNSTFYLYLGFTSSPVDKGKFLMAARRFRRGPHTEYIISLDAEDLSQGSNAYMGKLRSDFWGTNFKIYDSKPPYDGAKASSSRSSRRFGSRRISPQVSAGNYEVGQVSYKYNLLKSRGPRRMYCTLECPSAQETWENSLKTKFRRPLGPTTLRNKAPRWHEHLQCWCLNFHGRVTVASVKNFQLVAAADPSEPTTNVDDETVLLQFGKVDSDMFTMDYRQPLSAFQAFAISLSSFGTKLACE

SEQ ID NO: 1346 - protein, 448 aa, Zea mays
MPFRSIVRDVRDGFGSLSRRGFEVRFLSHRRGKSHGAVHELHDPVLVVQSSCWASLPPELLRDVIERLETSEDTWPSRKHVVACAAVCRTWREMCREIVKSPEFSGKITFPVSLKQPGPRDGTIQCFIKRDKSTQIYSLYLSFSSAVPVENGKFLLSAKRNCRATYTEYIISINSGDTSRCTSNNTYIGKLRSNFLGTKFVIYDTHPPYNGTSQTVAGKTSQRFYSKKGSTKVSCRWYSIAQISYELNVLGTRGPRRMNCVMHSIPASCLEAGGSVPCQPDSIAAHSVGGSFSSVSLSKSSTMDHSMHFTSSRLSDAITGDGIVNRGQALNDADDEECKDMPLILRNKAPRWHEQLQCWCLNFRGRVTVASVKNFQLVAATQPAAGALTPSQAAPQPAPPPPPDQEKVILQFGKVGKDIFTMDYCYPLSAFQAFAICLSSFDTKLACE

SEQ ID NO: 1347 - protein, 367 aa, Zea mays
MVSWRRSASWLSSASRSSLGAAVGGEAKVTPEADPAAQHDEADEERWSRLLPELLTEIMRRVDAGAERWPPRRDVVVCACVCRRWRDAAVSVVRPPLECGRITFPSSLKQPGPRDAPMHCFIRRDKKISTFSLYLSLTQALTDKGKFLLAARRFRQGAHTEYIISYDYDDLHPRSSSYVGKLRSDFLGTKFIIYDTQAPYDGAKPSRTRSTRRFASKQISPQVSGGNFEVGQVTYRFNFMKSRGPRRMQCNIQCPVGQGSASDPSKEKTPSPSSLDLKNKAPRWHDHLQCWCLNFHGRVTVASVKNFQLVATAGSGGPWGVGDEETVILQFGKIEDDAFTMDYRQPLSAFQAFAICLTSFGTKLACE

SEQ ID NO: 1348 - protein, 436 aa, Zea mays
MSLKSIVRELKEMRDGIGSMSRRGGSGSDGRAFHGRSGSRHSWPSLWAEQQQSHRQGQGLGPGPEGPHHQHQGRWANLPPELLLDVIQRVESSEATWPARRQVVACAAICRSWREVTKEVVKTLEECGRITFPISLKQPGPREMPVQCFVRRERATSTYLLYLGLSPSMNVEKDKLLLAARKVRRATRTYFVISLVSDDFSHSSSTYVGKLKPNFLGTKFTIFDSQPPPDAVVLPNNKTSKRQSKQVSPRLPLGNYNVATVTYELTVLRNRGPRRMQCTMHSIPAECIQEGGKAPTPTGAIQSLDEPVSSTLPSAKGKEVAVEFSSTSLSADLSGPACVNGTPLVLKNKAPRWHEQLQCWCLNFRGRVTVASVKNFQLVASVDPSLNIPAAEQEKVILQFGKIGKDIFTMDYRYPLSAFQAFAICLTSFDTKPACE

SEQ ID NO: 1349 - protein, 401 aa, Zea mays
MSFRSLIQDMKDEFGSISRHSLRSRSHRSAGNAARAVAAGPSEAMDQSCWSQLPPELLREVLVRIEASESWWPARKDVVSGAGVCRTWRGIMKEAVRVPEVSGKLTFPISLKQPGPRDGTLKCFIRRNRTTQTYYLYIGLTEALADDGKFLLAARKCRKPTCTDYLISLDKVDMSKGSSTYIGKLRSNFLGTKFTVYDAHPPYDGAAVSKSRSARVVGLKQVSPRVPAGNYPVSHISYELNVLGSRGPRRMNCVMDSIPASAVKEGGKTPTQTEFPLSSLDSFPSFPFFRSKSARIDSSTSQSSSQREDRLVLKNKSPRWHEQLQCWCLNFRGRVTVASVKNFQLVASEDNGPESQESDKVILQFGKIGKDLFTMDYGYPISAFQAFAICLSSFDTKIACE

SEQ ID NO: 1350 - protein, 456 aa, Zea mays
MSFRSIVRDVRESFGSLSRRSLEVRISGLPGLSGGHHRGKSVGSVSDLRDRPVVVDQSRWVGLPPELLRDVMRRLEEGESNWPSRKNVVACAAVCGTWREICKDIVLSPEFCGKLTFPVSLKQPGPRNGIIQCFIKRDKSTSTYYLYLCLSPVVLSEDGKFLLAAKRNRRTTYTEYIISVDPKSISRSSDGCVGKMRSNFLGTKFIVHDTRAPHNAGSLVSCERGSRRISSRRVSPKVPTASYPIARVNYELNLLGTRGPRRMNCTMHSIPASTLDPQGMVPEPGQPKQIFVPGSSSFEDSFRSANNTPSSSRFSVADRSLDWSSSRFSETSGLAQQDDDDSDQAKERPLVLCNKEPRWHEQLQCWCLNFHGRVTVASVKNFQLIAAPQLDSEPSQQAQQQTQPSNSSSASDHDKVILQFGKVANDMFTMDYRYPLSAFQAFAICLTSFDSKLACE

SEQ ID NO: 1351 - protein, 595 aa, Oryza sativa
MGGEVPEPRRLNRALSFDDWVPDEALHLVMGHVEDPRDREAASRVCRRWHRIDALTRKHVTVAFCYAARPARLRERFPRLESLSLKGKPRAAMYGLIPDDWGAYAAPWIDELAAPLECLKALHLRRMTVTDADIAALVRARGHMLQELKLDKCIGFSTDALRLVARSCRSLRTLFLEECHITDKGGEWLHELAVNNSVLVTLNFYMTELKVAPADLELLAKNCKSLISLKMSECDLSDLISFFQTANALQDFAGGAFYEVGELTKYEKVKFPPRLCFLGLTYMGTNEMPVIFPFSMKLKKLDLQYTFLTTEDHCQIIAKCPNLLILEVRNVIGDRGLEVVGDTCKKLRRLRIERGDDDPGLQEEQGGVSQLGLTAVAVGCRELEYIAAYVSDITNGALESIGTFCKNLYDFRLVLLDRERQVTDLPLDNGVCALLRNCTKLRRFALYLRPGGLSDDGLSYIGQYSGNIQYMLLGNVGESDHGLIRFAVGCTNLQKLELRSCCFSERALSLAVLQMPSLRYIWVQGYRASQTGLDLLLMARPFWNIEFTPPSPESFNHMTEDGEPCVDSHAQVLAYYSLAGRRSDCPQWVIPLHPA

SEQ ID NO: 1352 - protein, 590 aa, Zea mays
MGRGGARAAPAAAVPPWHALPDEVWEHAFSFLPADSDRGAAACACHAWLRFERRSRRRLAVANCYAASPRDAVERFPAVRAVEVKGKPHFADFGLVPPAWGADAAPWVAAAAAGWPLLEEISFKRMVVTDDCLEMIAASFRNFQVLRLVSCEGFSTAGLAAIAAACRNLRELDLQENEIEDCSIHWLSLFPVSFTSLVTLNFSCLEGDVNITVLEQLVTRCSNLKTLKLNNAIPLDKLANLLRKAPQIVELGTGRFSADYHPDLFSKLEAAFAGCKSLRRLSGAWDAVPEYLPAFYCVCEGLTSLNLSYATVRGPELIKFISRCKNLQLLWVMDLIEDHGLAVVASSCNKLQELRVFPSAPFEAAEQVSLTERGLVDVSASCPMLESVLYFCRRMTNEALITIAKNRPNFTCFRLCIIEPHTPDYITHQPLDAGFSAIVESCKGLRRLSVSGLLTDSVFKSIGAHADRLEMLSIAFAGNSDLGLHYILSGCKSLKKLEIRDCPFGDKPLLANAAKLETMRSLWMSTCSMTLGACRQLARKMPRLSVEVMNDPRRGFPLDSLTDESPVETLYVYRTISGPRSDTPACVQIL

SEQ ID NO: 1353 - protein, 454 aa, Glycine max
MASSRPANVGILAMDIYFPPTCVTQDALEGHDGVSKGKYTIGLGQDCMAFCSEVEDVISMSLTVVTSLLEKFNVDPKQIGHLAVGSETVIDKSKSIKTFLMQVFEASGNTDIEGVDSTNACYGGTAALFNCVNWVESSSWDGRYGLVVCTDTAVYAEGPARPTGGAAAIAMLVGPDAPIAFESKLRGSHMSHAYDFYKPNLASEYPIVDGKLSQTCYLMALDSCYRLYCEKFEKLEGRPFSMSDSDYFVFHSPYNKLVQKSFGRLYFNDFLRNASFVDEVARETLAPYASLSGDESYQSRDLEKANQQAAKHLYDAKVQPSTLIPKQVGNMYTASLYAAFASLLHNKNSSLVGKRVVMFSYGSGLTATMFSFQLQEGQHPFNLSNIVTVMNVSDKLKQRVEIPPEKFVETLKIMEHRYGGKDFVTSKDCSYLTPGTFYLTNVDSMYRRFYAKKD

SEQ ID NO: 1354 - protein, 491 aa, Saccharomyces cerevisiae
MKLSTKLCWCGIKGRLRPQKQQQLHNTNLQMTELKKQKTAEQKTRPQNVGIKGIQIYIPTQCVNQSELEKFDGVSQGKYTIGLGQTNMSFVNDREDIYSMSLTVLSKLIKSYNIDTNKIGRLEVGTETLIDKSKSVKSVLMQLFGENTDVEGIDTLNACYGGTNALFNSLNWIESNAWDGRDAIVVCGDIAIYDKGAARPTGGAGTVAMWIGPDAPIVFDSVRASYMEHAYDFYKPDFTSEYPYVDGHFSLTCYVKALDQVYKSYSKKAISKGLVSDPAGSDALNVLKYFDYNVFHVPTCKLVTKSYGRLLYNDFRANPQLFPEVDAELATRDYDESLTDKNIEKTFVNVAKPFHKERVAQSLIVPTNTGNMYTASVYAAFASLLNYVGSDDLQGKRVGLFSYGSGLAASLYSCKIVGDVQHIIKELDITNKLAKRITETPKDYEAAIELRENAHLKKNFKPQGSIEHLQSGVYYLTNIDDKFRRSYDVKK

SEQ ID NO: 1355 - protein, 233 aa, Zea mays
MALRTLASKNALSFALGGAARPSAASARGVTTVALPDLSYDFGALEPAISGEIMRLHHQKHHATYVANYNKALEQLDAAVAKGDASAVVQLQGAIKFNGGGHVNHSIFWKNLKPISEGGGEPPHGKLGWAIDEDFGSFEALVKRMNAEGAALQGSGWVWLALDKEAKKLSVETTANQDPLVTKGASLVPLLGIDVWEHAYYLQYKNVRPDYLNNIWKVMNWKYAGEVYENVLA

SEQ ID NO: 1356 - protein, 193 aa, Arabidopsis thaliana
MSFELPALPYAKDALAPHISAETIEYHYGKHHQTYVTNLNNLIKGTAFEGKSLEEIIRSSEGGVFNNAAQVWNHTFYWNCLAPNAGGEPTGKVAEAIAASFGSFADFKAQFTDAAIKNFGSGWTWLVKNSDGKLAIVSTSNAGTPLTTDATPLLTVDVWEHAYYIDYRNARPGYLEHFWALVNWEFVAKNLAA

SEQ ID NO: 1357 - protein, 201 aa, Arabidopsis thaliana
MSYELPALPFDYTALAPYITKETLEFHHDKHHAAYVNNYNNAVKDTDLDGQPIEAVIKAIAGDASKAGLFNNAAQAWNHSFYWNSIKPNGGGAPTGALADKIAADFGSFENFVTEFKQAAATQFGSGWAWLVLDNGTLKITKTGNADTPIAHGQTPLLTIDVWEHAYYLDYQNRRPDYISTFVEKLANWDFASANYAAAIA

SEQ ID NO: 1358 - protein, 492 aa, Zea mays
MDPYKHRPSSGSNSSFWTTNSGAPVWNNNSALTVGQRGPILLEDYHLIEKLAQFDRERIPERVVHARGASAKGFFEVTHDVSHLTCADFLRAPGVQTPVIVRFSTVVHERGSPETLRDPRGFAVKFYTREGNFDLVGNNMPVFFIRDGMKFPDMVHAFKPNPKTNLQENWRIVDFFSHHPESLHMFTFLFDDVGIPLNYRHMEGFGVNTYTLINRDGKPHLVKFHWKPTCGVKCLLDNEAVTVGGTCHSHATKDLYDSIAAGNYPEWKLYIQTIDLDHEDKFDFDPLDVTKTWPEDIIPLQPVGRMVLNKNVDNFFAENEQIAFCPAIIVPGIHYSDDKLLQTRIFSYADTQRHRLGPNYLMLPVNAPKCAHHNNHHDGFMNFMHRDEEVNYFPSRFDPARHAEKVPIPPRVLTGCREKCIIQKENNFKQAGERYRSFDPARQDRFIQRWVDALTDPRVTHEHRTIWISYWSQCDAALGQKLASRLNLKPSM

SEQ ID NO: 1359 - protein, 494 aa, Zea mays
MDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSIAAGSFPEWTLYVQVMDPDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAAPPTPLPPRPVAGRREKATIRKPNDFKQPGERYRSWDADRQDRFVRRFADSLGHPKVSQELRSIWIDLLAKCDASLGMKIATRLNMKPNM

SEQ ID NO: 1360 - protein, 289 aa, Zea mays
MAAPMVDAEYLRQVDRARRHLRALISNKGCAPIMLRLAWHDAGTYDLKTKTGGANGSIRYEEEYTHGSNAGLKIAIDLLEPIKAKNPKITYADLYQLAGVVAVEVTGGPTVEFIPGRRDSSVCPREGRLPDAKKGAPHLRDIFYRMGLSDKDIVALSGGHTLGRAHPERSGFDGAWTKEPLKFDNSYFLELLNEESEGLLKLPTDKALLSDPEFRRYVELYAKDEDAFFKDYAESHKKLSELGFTPRSTAPSKSDLPTAAVLAQSAFGVAVAAAVVIAGYLYEASKKAK

SEQ ID NO: 1361 - protein, 447 aa, Zea mays
MDEEYDVIVLGTGLKECIISGLLSVDGLKVLHMDRNDYYGGESSSLNLTKLWNRFKGNDSPPEHLGVSKEYNVDMVPKFMMANGALVRVLIRTSVTKYLNFKAVDGSFVYNNGKIHKVPATDVEALKSNLMGLFEKRRARKFFIYVQDYEEDDPKSHEGLDLNKVTTREVISKYGLEDDTVDFIGHALALHRDDSYLDEPAIDTVKRMKLYAESLARFQGGSPYIYPLYGLGELPQAFARLSAVYGGTYMLNKPECKVEFDESGKAYGVTSEGETAKCKKIVCDPSYLPDKVKKVGRVARAICIMKHPIPDTKDSHSVQIILPKKQLKRKSDMYVFCCSYAHNVAPKGKFIAFVSTEAETDKPEIELKPGIDLLGPVEETFFDIYDRYEPVNNPDDDCCFLTNSYDSTTHFETTVKDVLALYNKITGKELDLSVDLNAASATEQEAA

SEQ ID NO: 1362 - protein, 458 aa, Glycine max
MDEEYDVIVLGTGLKECILSGLLSVDGLKVLHMDRNDYYGGESTSLNLIQFELRNDDFLCPPLQLWKRFRGDDKPPPHLGASRDYNIDMNPKFIMANGNLVRVLIHTDVTKYLYFKAVDGSYVFNKGKVHKVPANDMEALKSPLMGLFEKRRARKFFIYVQNYNESDPKTHEGMDLTRVSTKELIAKYGLDDNTIDFIGHALALHSDDRYLAEPALDTVKRMKLYAESLARFQGGSPYIYPLYGLGELPQAFARLSAVYGGTYMLNKPECKVEFDEEGKVVGVTSEGETAKCKKVVCDPSYLPGKVRKVARVARAIAIMSHPIPSTDDSHSVQIILPQKQLGRKSDMYLFCCSYTHNVAPKGKFIAFVSTEAETDQPAIELKPGIDLLGPVDEIFFDIYDRYEPVNEPTLDNCFISTSYDATTHFESTVDDVLNMYTLITGKVIDLSVDLSAASAAEE

SEQ ID NO: 1363 - protein, 247 aa, Zea mays
MSSAVEAISCPKVDVPAGPEPGEPAKEAAPPAEHCDTAPNGKCAPRCHGEEEEEEEDEEDEEKAPKAIDLGPMVSIKEQLEKDKDDESLRRWKEQLLGGVDLNSVGETLEPDVKIMSLSILSPGRPDIVLPLPVEPNGKGVWFTLKEGSPYRLKFTFSVSNNIVSGLRYTNTVWKTGLKVDRAKEMLGTFSPQLEPYTYVTPEDTTPSGMFARGSYSARTKFLDDDRKCYLEINYTFDIRREWPSTS

SEQ ID NO: 1364 - protein, 132 aa, Zea mays
MAQVRGSARGTGSGSSAAALALVLLCALLRGEFAESAVYTVGDRGGWSFNTASWPNGKRFRAGDVLVFRYDARAHNVVPVSAAGYSSCSAPEGARALATGNDRVTLRRGANYFICSFPGHCQAGMKVAVTAA

SEQ ID NO: 1365 - protein, 127 aa, Zea mays
MAEGRGSARAIGAMAFAVACCYCCVAIADAATTYYVGDSNGWSFSSPSWPNGKHFRAGDTLVFRYIPWIHNVVAVDEDGYNGCTTPPGSRTYTSGADSVTLARGDNFFICTRFGHCNLGMKLVVYAA

SEQ ID NO: 1366 - protein, 127 aa, Glycine max
MSQGRGSASLPIVVTVVSLLCLLVLLERADAATYTVGGPGGWTFNTNAWPKGKRFRAGDILIFNYDSTTHNVVAVDRSGYNSCKTPGGAKVFSSGKDQIKLARGQNYFICNYPGHCESGMKVAINAV

SEQ ID NO: 1367 - protein, 182 aa, Zea mays
MLCPCMHHVLVYNVSGTFVRSSACISQYLVKEKSSDPARPAGSCVAAFQYSSAHSVLEVSEADHGACSASNPLRSHQGQSTTIPLTKAGTRYFICGAPGHCASGMKVAITVSGGGGGGSSSADNTATPSGPSVRAMNTKPAFGLRSGGATTTDESDSSAAGSGARLAMGLLFGAAGLAAIMG

SEQ ID NO: 1368 - protein, 195 aa, Zea mays
MAATSRLALALLLAALVAAWQLPAAAVAANYTVGDEKGWNPDVDYTAWVKKHKPFYKGDWLIFEYQNGRSDVVQVDEVGYDNCDKANALSSYSKGHTYAFQLKDAKDYYFICSYGYCYNGMKLHVTAKSSSSSSSSSSGSDSSSSSSDDDSSSPSPPAKKSKAKTSAAPPPSLLAATPMAAAAAAAAALLLNRML

SEQ ID NO: 1369 - protein, 350 aa, Zea mays
MERERQAVARNRKVVLRGYIDRAPREEDMELVDGGAVELRVPEGGGGPAVLVKNLYLSCDPYMRGRMRDFRNSYIPPFKPGSPIEGFGVGRVVDSTHPGFSAGDVVSGMTGWEDYSLITKPEQLRKIQQSDIPLSYHLGLLGMPGFTAYVGFYEICSPKKGEFVFVSAASGAVGQIVGQLAKLHGCYVVGSAGTDQKVELLKEKFGFDAAFNYKEEPDLTAALKRHFPEGIDIYFENVGGPMLDAVLLNMRVHGRIAVCGMVSQHGVTAPAGIHNLFSLISKRIEMKGFIQSDYVHLFPQFVDDITRHYRDGKIVYVEDMSVGLESGPASFVGLFSGKNVGKQVVCVSRD

SEQ ID NO: 1370 - protein, 342 aa, Glycine max
MTQVRNKQVVLRDYVTGFPKESDMNIVEGTIILKVPEGSNDVLLKNLYLSCDPYMRLLMAKDRSFGDGSFTLASPLKGYGVSQVLESGRPDYKKGDLVWGITKWEEYSLVPSSLIHFKIEHTDVPLSYYTGILGMPGMTAYAGFFEVGSPKKGDTVFVSAASGAVGQLVGQFAKLTGCYVVGSAGSKEKVDLLKNKLGFDEAFNYKEEPDLNAALKRYFPEGIDIYFENVGGKTLDAVLPNMKFHGRIPVCGMISQYNLTQFDGVTNLANLIFKRVKMEGFIATDFYHLYPKFLEFVLPHIREGKVVYVEDIAEGLEKGPAALVGLYTGRNVGKQVVVVTHE

SEQ ID NO: 1371 - protein, 358 aa, Zea mays
MATTATNRRVILKEYVEGYPREEHMELLQGAEVPLRLTGAEPAGSVLVRNLYLSCDPYMRPKMSRPLRESYTAAFVPGDTITGYGVARVVDSSDPRLAPGDLVWGITGWEDYSVVTPPATRLLSKISHHGVGEGAGVPLSYYTGILGMPGLTAYVGFHEICAPKKGETVFVSAASGAVGQLVGQFARLAGCHVVGSAGSREKVELLKTRFGFHDAFNYKEEPDLGAALKRCFPDGIDIYFENVGGAMLDAVLLNMRVHGRIAVCGLISQYNLADGEKDAVRNLAAVISKRLRLQGFIEPDHKHLYPQYEAWVLPYIRDGTLAYVEDVAEGLESAPKALIGLFHGRNVGKQLVRVADDE

SEQ ID NO: 1372 - protein, 335 aa, Zea mays
MADLIKAVDIRGGKGERDALFINPQTPKPSPTEGQALVRVKAFGINRMDIVQRRGFYPLPPQAPATLGVEFSGTIESLGPGDHGAFKQGDEVFGLAYGGAYAEYLAVSTRMLLHKPSSMDFVTCAGIPETWITATQALHLVLGFTKGKSILWHAGASGVSIAGIQLSKIAGASQVFATAGSQEKCDFITSKLGATAAFNYKTQDWAEEIKKHTDGNGVDYIVDFVGASYFQQNQTAAARDGRIVLLGTLGGVKIPEADISQILYKRLRIEGSTLRSRDEEYQGKLRDRLEEYLPDFESGKLKILVDKVLPWEEIQEAHKHMEEAKNLGKIICTIS

SEQ ID NO: 1373 - protein, 525 aa, Emericella nidulans
MSPLNGVARSFPRPFQAVTRRPFRVVQPAIACPSNSRSFNHSRSLRSTGSQSPAPSPRDSSNPALSFPCLDAQEAKSALLSARSLGSGPEPSYTAGHHERFHSDEPLLLDWGGLLPEFDIAYETWGQLNEKKDNVILLHTGLSASSHAHSTEANPKPGWWEKFIGPGKTLDTDKYFVICTNVLGGCYGSTGPSTVDPSDGKKYATRFPILTIEDMVRAQFRLLDHLGVRKLYASVGSSMGGMQSLAAGVLFPERVGKIVSISGCARSHPYSIAMRHTQRQVLMMDPNWARGFYYDSIPPHSGMKLAREIATVTYRSGPEWEKRFGRKRADPSKQPALCPDFLIETYLDHAGEKFCLEYDANSLLYISKAMDLFDLGLTQQLATKKQRAEAQAKISSGTNTVNDASCSLTLPEQPYQEQPSASTSAEQSASASETGSAPNDLVAGLAPLKDHQVLVIGVASDILFPAWQQREIAETLIQAGNKTVEHIELGNDVSLFGHDTFLLDVRTSEAQFASSVLVGSHIIVQ

SEQ ID NO: 1374 - protein, 249 aa, Synechocystis PCC6803
MLNSLIADFRIIFERDPAARNWLEVLFCYPGLQALLIHRFSHRLYTLGLPFFPRLMSHLARFFTGIEIHPGAQIGQGVFIDHGMGVVIGETAIVGDYSLIYQGVTLGGTGKESGKRHPTLGENVVVGAGAKVLGNIAIGDNVRIGAGSVVLRDVPADFTVVGVPGRMVHPSGERVNPLEHGKLPDSEGKVIRLLLERIELLEQQVATLQQQQSEQAWESDYRSCSETDREPVLCRLGDREIEEFLGGTL

SEQ ID NO: 1375 - protein, 200 aa, Synechocystis PCC6803
MTEVLRVGQPAPDFTATAIVDQSFQTVKLSTYRGKYLVLFFYPLDFTFVCPTEIIAFSDRHSEFTALDTEVVGISVDSEFSHLAWIQTERKMGGIGNINYPLVSDLKKEISQAYNVLEPDAGIALRGLFIIDREGILQYATVNNLSFGRSVDETLRVLKAIRHVQSHPNEVCPVDWQEGDKTMIPDPEKAKTYFETVAEP

SEQ ID NO: 1376 - protein, 196 aa, Saccharomyces cerevisiae
MVAEVQKQAPPFKKTAVVDGIFEEISLEKYKGKYVVLAFVPLAFSFVCPTEIVAFSDAAKKFEDQGAQVLFASTDSEYSLLAWTNLPRKDGGLGPVKVPLLADKNHSLSRDYGVLIEKEGIALRGLFIIDPKGIIRHITINDLSVGRNVNEALRLVEGFQWTDKNGTVLPCNWTPGAATIKPDVKDSKEYFKNANN

SEQ ID NO: 1377 - protein, 261 aa, Saccharomyces cerevisiae
MFSRICSAQLKRTAWTLPKQAHLQSQTIKTFATAPILCKQFKQSDQPRLRINSDAPNFDADTTVGKINFYDYLGDSWGVLFSHPADFTPVCTTEVSAFAKLKPEFDKRNVKLIGLSVEDVESHEKWIQDIKEIAKVKNVGFPIIGDTFRNVAFLYDMVDAEGFKNINDGSLKTVRSVFVIDPKKKIRLIFTYPSTVGRNTSEVLRVIDALQLTDKEGVVTPINWQPADDVIIPPSVSNDEAKAKFGQFNEIKPYLRFTKSK

SEQ ID NO: 1378 - protein, 215 aa, Saccharomyces cerevisiae
MGEALRRSTRIAISKRMLEEEESKLAPISTPEVPKKKIKTGPKHNANQAVVQEANRSSDVNELEIGDPIPDLSLLNEDNDSISLKKITENNRVVVFFVYPRASTPGCTRQACGFRDNYQELKKYAAVFGLSADSVTSQKKFQSKQNLPYHLLSDPKREFIGLLGAKKTPLSGSIRSHFIFVDGKLKFKRVKISPEVSVNDAKKEVLEVAEKFKEE

SEQ ID NO: 1379 - protein, 176 aa, Saccharomyces cerevisiae
MSDLVNKKFPAGDYKFQYIAISQSDADSESCKMPQTVEWSKLISENKKVIITGAPAAFSPTCTVSHIPGYINYLDELVKEKEVDQVIVVTVDNPFANQAWAKSLGVKDTTHIKFASDPGCAFTKSIGFELAVGDGVYWSGRWAMVVENGIVTYAAKETNPGTDVTVSSVESVLAHL

SEQ ID NO: 1380 - protein, 162 aa, Zea mays
MAPIAVGDALPDGQLGWFDENDQLQQVSVHALAAGKKVILFGVPGAFTPTCSNQHVPGFITQAEQLKAKGVDEILLISVNDPFVMKAWAKTYPENKHVKFLADGSGAYTKALDLELDLTDKGLGVRSKRFALLADDLTVTVANIEEGGQFTISGAEEILKAL

SEQ ID NO: 1381 - protein, 260 aa, Glycine max
MACSATSASLFSANPTPLFSPKPSLSLHLNPLPTRPSPSLTRPSLSLTRPSHSRRSFVVKASSSELPLVGNTAPDFEAEAVFDQEFINVKLSDYIGKKYVVLFFYPLDFTFVCPTEITAFSDRHAEFEALNTEILGVSVDSVFSHLAWIQTDRKSGGLGDLNYPLISDVTKSISKSYGVLIPDQGIALRGLFIIDKEGVIQHSTINNLAIGRSVDETKRTLQALQYVQENPDEVCPAGWKPGEKSMKPDPKLSKDYFAAV

SEQ ID NO: 1382 - protein, 214 aa, Glycine max
MASLTVPNHCVPTLLRTHSLNYPSSQNLPLPSAPSNSQFFGLKLSHSSFSTIPSSSSSLKGSIFAKVTKGSKPPNFTLKDQNGKNVSLSNFKGKPVVVYFYPADETPGCTKQACAFRDSYEKFKKAGAVVVGISGDDAASHKAFASKYKLPFTLLSDEGNKVRKEWGVPGDFFGSLPGRETYVLDKNGVVQLVYNNQFQPEKHIGETLKILQSL

SEQ ID NO: 1383 - protein, 240 aa, Zea mays
MAAAPFAIAGRLSPVARLPVRAWRPAHGFASSGRARSLAVASAAQENRDNSVDVQVSQNGGNRQQGNAVQRRPRRATALDISPSPFGLVDPMSPMRTMRQMLDTMDRLFDDAVGFPMGTRRSPATTGDVRLPWDIVEDEKEVKMRIDMPGLARDEVKVMVEDDTLVIRGEHKKEEGAEGGSGGDGDGWWKQRSVSSYDMRLALPDECDKSKVRAELKNGVLLVTVPKTEVERKVIDVQVQ

SEQ ID NO: 1384 - protein, 218 aa, Zea mays
MASIVASRRAVPLVRALEKLIAASSAPGTGSALRPVAVAGGLRGYNTGAPLRRYEGAESEDDSVREYDGRHGGRDYAVPSLFSDIFRDPLSAPHSIGRLLNLMDDLAVAAPGRAVRRGWNAKEDEEALHLRVDMPGLGKEHVKVWAEQNSLVIKGEGEKEDSEDEAAPPPRYSGRIELAPEVYRMDKIKAEMKNGVLKVVVPKVKEQQRKDVFQVNVE

SEQ ID NO: 1385 - protein, 208 aa, Zea mays
MSRRAAALLLACLVAVTAAALADGALLPWFGDGRRGLDEAAVTDVGLLAADPFRILEHVPFGFDRDDVAMVSMARVDWRETPDAHEIVVDVPGMRREDLRIEVEDNRVLRVSGERRRAEERKGDHWHREERSYGRFWRRFRLPENADLDSVAASLDSGVLTVRFRKLAPEQIKGPRVVGIAGGDGGAEAKESIGTGAGDGHQTKKVEL

SEQ ID NO: 1386 - protein, 221 aa, Zea mays
MGPYSTAVAVSASPVLQASSLLTRARGSWRPTVAALRLSASVKCRRRALTVTCALPEKERPAAFNIPPTALLCPVPPPDGKERWDIKEEDDRVTLWLQVPGLSASDIEVTTSEDVLEIKRRVVAPQQPAPVDAHGVGAFHIRLLLTKEYDGSNVTADLKAGMLEVTVHKNPQRPGERAVMMGATKPPPEPRQNEESSTNQRSSTARKETGTPMGRQNPNGV

SEQ ID NO: 1387 - protein, 165 aa, Zea mays
MDGRMFGLETPLMVALQHLLDVPDGDAGAGGDKASGAAAGGGPTRTYVRDARAMAATPADVKELPGAYAFVVDMPGLGTGDIRVQVEDERVLVISGERRREEREDAKYLRMERRMGKFMRKFVLPDNADMDKISAVCRDGVLTVTVEKLPPPEPKKPKTIEVKVA

SEQ ID NO: 1388 - protein, 154 aa, Zea mays
MSLVRRGSVFDPFSVDLFDPFDSVFRSIVPSSSSAAAASETAAFASARIDWKETPEAHVFKADLPGVKKEEVKVEVEDGNVLLISGQRSREKEDKGDKWHRVERSSGQFVRRFRLPENAKTEEVRAALENGVLTVTVPKAEVKKPEVKSIQISG

SEQ ID NO: 1389 - protein, 208 aa, Zea mays
MSTVTSCTFLSLGSPVRPAVSSARPAAAAVASRRRPRSLSVCCEAGRKGDHNPKTDLHPFNIPAFVLVHPVAPREERWQLEEDADKVNLWFEVPGQSKDDLTVEIDEDVLVIKKRKELVGQRSPAGGGVAEYGSQSQQQSRRGTADGKELPAAQQGQAGEVVYARMLLPAGYSRDGVQAELKSGVLRVTVVKVTERARRKIDVPIQVK

SEQ ID NO: 1390 - protein, 799 aa, Saccharomyces cerevisiae
MSTIYRESDSLESEPSPTPTTIPIQINMEEEKKDAFVKNIDEDVNNLTATTDEEDRDPESQKFDRHSIQEEGLVWKGDPTYLPNSPYPEVRSAVSIEDDPTIRLNHWRTWFLTTVFVVVFAGVNQFFSLRYPSLEINFLVAQVVCYPIGRILALLPDWKCSKVPFFDLNPGPFTKKEHAVVTIAVALTSSTAYAMYILNAQGSFYNMKLNVGYQFLLVWTSQMIGYGAAGLTRRWVVNPASSIWPQTLISVSLFDSLHSRKVEKTVANGWTMPRYRFFLIVLIGSFIWYWVPGFLFTGLSYFNVILWGSKTRHNFIANTIFGTQSGLGALPITFDYTQVSQAMSGSVFATPFYVSANTYASVLIFFVIVLPCLYFTNTWYAKYMPVISGSTYDNTQNKYNVTKILNEDYSINLEKYKEYSPVFVPFSYLLSYALNFAAVIAVFVHCILYHGKDIVAKFKDRKNGGTDIHMRIYSKNYKDCPDWWYLLLQIVMIGLGFVAVCCFDTKFPAWAFVIAILISLVNFIPQGILEAMTNQHVGLNIITELICGYMLPLRPMANLLFKLYGFIVMRQGLNLSRDLKLAMYMKVSPRLIFAVQIYATIISGMVNVGVQEWMMHNIDGLCTTDQPNGFTCANGRTVFNASIIWSLPKYLFSSGRIYNPLMWFFLIGLLFPLAVYAVQWKFPKFKFAKHIHTPVFFTGPGNIPPSTPYNYSLFFAMSFCLNLIRKRWRAWFNKYNFVMGAGVEAGVAISVVIIFLCVQYPGGKLSWWGNNVWKRTYDNDYKKFYTLKKGETFGYDKWW

SEQ ID NO: 1391 - protein, 520 aa, Zea mays
MAAAPPPKADELQPFPPKEQLPGVAFCITSPPPWPEAILLGFQHFVVMLGTTVIIPSALVPQMGGGNEEKARVVQTILFVAGINTLFQTLFGTRLPVVMGGSYVFVGPTISIVLAGRYSNEADPHEGALLVASTIQIILGFSGLWRNVVKLLSPLAAVPLVSLVGFGLYELGFPGVAKCVEVGLPELLLLVVFSQYLPQVLDFGKSVFSRFSVLFTVAIVWLYAYILTIGGAYKNSPPKTQVHCRVDRSGLISGAPWISVPYPFQWGAPTFDAGEAFAMMMTSFIALVESTGAFIGASRYASATMIPPSIISRGVGWQGIGLLLDSFFGTANGTSVSVENIGLLALTRIGSRRVVQISAGFMIFFSVLGKFGALFASIPLPVFAGMYCLFFAYVGGVGLSLLQFCNLNSFRTKFIMGFAFFMGLSVPQYFNEYTAVASYGPVHTGARWFNDMINVPFTSKPFVAGLVAYILDNTLQVKESAVRKDRGNHWWEKFRSFKKDARSQEFYSLPFNLNKFFPSV

SEQ ID NO: 1392 - protein, 533 aa, Zea mays
MAGGGAATPPKQEELQPHPVKDQLPSVSYCITSPPPWPEAVILGFQHYIVMLGTSVIIPSALVPQMGGGNEEKARVIQTLLFVAGINTLCQSFFGTRLPAVMGGSYTIVAPTISIIMAGRYSNEADPREKFLRTMRGTQGALIIASTIQIVLGFSGLWRNVVKLLSPLSAVPLVSLAGFGLYELGFPGVAKCVEIGLPEIILMLIFSQYLPHAVHAAKPVFDRFSVIFTIAIVWLYAYILTVSGAYKNARTKTQLHCRVDRSGLVGGAPWISVPYPFQWGAPTFDAGESFAMMVAAFVALVESSGAFIAVSRYASATMIPPSVLGRGIGWQGIGTLLGAFFGTANGTAVSVENAGLLALTHVGSRRVVQISAGFMIFFSVLGKFGAIFASIPLPIFAALYCILFAYIGACGLSFLQFCNLNSFRTKFIMGFSLFMGLSVPQYFNEYTSVAGYGPVHTGARWFNDMINVPFSSKPFVAVLVAFLLDNTIQVRDSGVRRDRGYHWWDKFRSFKTDSRSEEFYSLPFNLNKFFPSV

SEQ ID NO: 1393 - protein, 446 aa, Zea mays
MMSRQCANRIFLTGGSSFLHGLKSRVASSRSHGTVRLNWRCVRTNLWRAERLGVKATPSEHIIAVLQASDIFSGIRKWSKLQLVAMTGVMACVVLVVPSSDAVDALKTCTCLLKECRIELAKCIANPSCAANVACLNTCNNRPDETECQIKCGDLFENSVVDEFNDCAVSRKKCVPKKSDVGEFPVPDPSSLVKSFNMADFNGKWYISSGLNPTFDTFDCQLHEFHVEGDKLIANITWRVRTPDSGFFTRSTVQRFVQDPSQPGILYNHDNEFLHYQDDWYIISSKVENKDDDYIFVYYRGRNDAWDGYGGSVLYTRSKTVPETIIPELERAAKSVGRDFSTFIMTDNTCGPEPPLVERIEKTVVEGEKTIVREVKEIEEEVEELEKEEASLFQKLAEGLMEVKQDFMNFLQGLSKEEMELLDQLNMEATEVEQVFSRALPLRKLR

SEQ ID NO: 1394 - protein, 340 aa, Oryza sativa
MLVVVARKSSSSARVAAHQTRSHRAAMPAGQPHAHEPDGGGASHRRPQSPPSLPAEVVPAFAPPESEDEESWVWSQIKAEARRDADAEPALASFLYATVLSHPSLPRSISFHLANKLCSSTLLSTLLYDLFLASFTAHPSLRAAVVADLLAARSRDPACVGFSQCLLNFKGFLAIQAHRVSHVLWAQQRRPLALALQSRVADVFAVDIHPAAVVGKGILLDHATGVVIGETAVVGDNVSILHHVTLGGTGKAVGDRHPKIGDGVLIGAGATILGNVKIGAGAKIGAGSVVLIDVPARNTAVGNPARLIGRKNGEVEKDEDMPGESMDHTSFIRQWSDYTI

SEQ ID NO: 1395 - protein, 354 aa, Oryza sativa
MTSCGCLVLEKVEDHGGEAAGRGRGRLAQGGGGGGGGCGSCAGEWRSRSETMFPIYVMGSSRASSAAAARGIVDAAGDPIWEAVKSEAKSEAEKEPILSSFLYASVLSHDCLERALSFVLANRLEDPTLLATQLIDIFNDVMMNNKDIRRSIRLDAQAFKDRDPACAQYSWALLYLKGYHSVQSYRIAHVLWNQGRKVLALALQSRISEVFAVDIHPAARIGEGILLDHGTGLVIGETAIVGNWVSLMQGVTLGGTGKENGDRHPKIGQGALLGAGATILGNINVGEGAMIAAGSLVLKDVPPHSMAVGNPAKVVGYKDKEDPSLTMKHDARRDYFEHVAVSFSDDKANGSVVK

SEQ ID NO: 1396 - protein, 580 aa, Zea mays
MEQRNVLALGEHVLKATVWKRKHKTAMEHPEGNDVMVFSQHDQRKHPVIFDDRAKCKKSKLISCGSGVILESYWNFKTSGLPVRVLFYQHGDWSDFPEDVVNLAQQDFQLKKPITTAVFQNKHILLDFIHMICIDYEMTIDKPLAWVDDNGKRFFPDLSAGLYTSKPSQHENGEADECDGTPTSVAESSSSVSVGEVVSHGKRINDIAEDNMRAHNILYEAVGENISGPSFHLNEYSSGTIQATGKPNDCRRIDSAVRNLLLKGLGQPFSEEDIIGIYRTPLLDQRGQVRCGLFQKEIEETRSRRGNANVRYAWLPCSRYTMEQMAMRGALEIAKPHKGSICGVGTCLAPANCTNSCARYSDFHEDGIIRMMLCRVIMGNVEVVLPGSKQFQPSNGSFDNGVDDLQNPQNYIVWDANVHKHIYAEYAVIVQAPLVTNECSGLKDSVPNISEIISSGSRDNLTKEDRFAPCGVEQEAPRLGRAPRAPSSPWMPFSMLFAAISTKVPRSDMELVIRYYEEFKRKRMSRSDLVVRMRQIVGDKILVSTIMRLHHQKKPPSMAAAAAGLARALARGEEGGGVAE

SEQ ID NO: 1397 - protein, 256 aa, Zea mays
MSEGKKYLIVLAHHEPKSLNHSFAQRAQQVLTAAGNEVKLIDLHAVNFNPVSDRRNFKTTANPEFLKQQIEERHATEHDGFADDIKESLEAVDWCDVLILQFPFWWFSMPAILKGWIDKVWASGRVYGPNKKFTAGVWKGKKAFLSITTGSSEPTYAGPDSRMGDINSLLFPINHGILAFVGFTVLPPFIAYSASHATEDQRKQFLDEYEQRLLNLENLTPISYPPNEAFDSTGILKADWKAAQAHQNSNPAPREG

SEQ ID NO: 1398 - protein, 887 aa, Zea mays
MWNPLSWVMEMAAIMAIALANGGGKPPDWQDFVGIIVLLVINSTISFIEENNAGNAAAALMANLAPKTKVLRDGRWGEQEAAILVPGDIISIKLGDIVPADARLLEGDALKVDQSALTGESLPVTKGPGDEVFSGSTCKQGEIEAVVIATGVHTFFGKAAHLVDSTNQVGHFQQVLTAIGNFCICSIGVGILVEIIVMFPIQHRKYRSGIENLLVLLIGGIPIAMPTVLSVTMAIGSHKLSQQGAITKRMTAIEEMAGMDVLCSDKTGTLTLNKLSVDKNLVEVFCKGVDKDHVLLLAARASRTENQDAIDAAMVGMLADPKEARAGIREIHFLPFNPVDKRTALTYIDADGNWHRVSKGAPEQILDLCHCKEDLRRKVHSIIDKYAERGLRSLAVARQEVPEKNKESPGGPWQFVGLLPLFDPPRHDSAETIRKALVLGVNVKMITGDQLAIGKETGRRLGMGTNMYPSSALLGQNKDATLEALPVDELIEKADGFAGVFPEHKYEIVKRLQEKKHIVGMTGDGVNDAPALKKADIGIAVADATDAARSASDIVLTEPGLSVIISAVLTSRCIFQRMKNYTIYAVSITIRIVLGFMLIALIWQYDFSPFMVLIIAILNDGTIMTISKDRVKPSPLPDSWKLKEIFATGIVLGSYLALMTVIFFWAMHKTDFFSDKFGVRSIRDSEHEMMSALYLQVSIVSQALIFVTRSRSWSFVERPGLLLVTAFLLAQLVATFLAVYANWGFARIKGIGWGWAGVVWLYSIVFYFPLDLLKFFIRFVLSGRAWDNLLENKTAFTTKKDYGREEREAQWATAQRTLHGLQPPEASSNTLFNDKSSYRELSEIAEQAKRRAEIARLRELNTLKGHVESVVKLKGLDIDTIQQNYTV

SEQ ID NO: 1399 - protein, 649 aa, Zea mays
MARFEVNGKSVQGVDLLRRRHWPSRLDFWPFLALYALWLLLAVPALDFTDALIILAALSAAHILTFLFTAWFVDFRAFVGYSKVKDIHAANTCKVTPAKFSGSKEIVPLHKQKNVASTSAAGETEEIYFDFRKQRFIYSAEKDNFLKLRYPTKELIGHYGKGTGYGTEAKISTAVDKWGRNVFEYPQPTFQKLMKEQIMEPFFVFQVFCVALWCLDAYWYYSLFTLFMLFLFESTMAKNRLKTLTELRRVKVDSQIVLTYRCGKWVKVPGTELLPGDIVSIGRSTSGEDRSVPADMLLLAGSAIVNEAILTGESTPQWKVSIAGRGPDDMLSIRRDKNHILFGGTKVLQHTADKSVNLRSPDGGCLAFVLRTGFETSQGKLMRTILFSTERVTANNKESGLFILFLLFFAIIASGYVLVKGLEDPTRSRYKLLLSCSLIITSVIPPELPMELSIAVNTSLIALARHGIFCTEPFRIPFAGKVDICCFDKTGTLTSDDMEFQGIVTSEGDDLISDANKLPLRTQEVLSSCHALVFVDNKLVGDPLEKAAIKGIDWIYTSDEKAMSKKPGGQPVQIVHRYHFASHLKRMSVIVRIQQKFYAFIKGAPETIQEKLVDLPAAYVETYKKYTRQGSRVLALAYKLLPEMPVSFC

SEQ ID NO: 1400 - protein, 1355 aa, Saccharomyces cerevisiae
MNDDRETPPKRKPGEDDTLFDIDFLDDTTSHSGSRSKVTNSHANGYYIPPSHVLPEETIDLDADDDNIENDVHENLFMSNNHDDQTSWNANRFDSDAYQPQSLRAVKPPGLFARFGNGLKNAFTFKRKKGPESFEMNHYNAVTNNELDDNYLDSRNKFNIKILFNRYILRKNVGDAEGNGEPRVIHINDSLANSSFGYSDNHISTTKYNFATFLPKFLFQEFSKYANLFFLCTSAIQQVPHVSPTNRYTTIGTLLVVLIVSAMKECIEDIKRANSDKELNNSTAEIFSEAHDDFVEKRWIDIRVGDIIRVKSEEPIPADTIILSSSEPEGLCYIETANLDGETNLKIKQSRVETAKFIDVKTLKNMNGKVVSEQPNSSLYTYEGTMTLNDRQIPLSPDQMILRGATLRNTAWIFGLVIFTGHETKLLRNATATPIKRTAVEKIINRQIIRLFTVLIVLILISSIGNVIMSTADAKHLSYLYLEGTNKAGLFFKDFLTFWILFSNLVPISLFVTVELIKYYQAFMIGSDLDLYYEKTDTPTVVRTSSLVEELGQIEYIFSDKTGTLTRNIMEFKSCSIAGHCYIDKIPEDKTATVEDGIEVGYRKFDDLKKKLNDPSDEDSPIINDFLTLLATCHTVIPEFQSDGSIKYQAASPDEGALVQGGADLGYKFIIRKGNSVTVLLEETGEEKEYQLLNICEFNSTRKRMSAIFRFPDGSIKLFCKGADTVILERLDDEANQYVEATMRHLEDYASEGLRTLCLAMRDISEGEYEEWNSIYNEAATTLDNRAEKLDEAANLIEKNLILIGATAIEDKLQDGVPETIHTLQEAGIKIWVLTGDRQETAINIGMSCRLLSEDMNLLIINEETRDDTERNLLEKINALNEHQLSTHDMKSLALVIDGKSLGFALEPELEDYLLTVAKLCKAVICCRVSPLQKALVVKMVKRKSSSLLLAIASGANDVSMIQAAHVGVGISGMEGMQAARSADIALGQFKFLKKLLLVHGSWSYQRISVAILYSFYKNTALYMTQFWYVFANAFSGQSIMESWTMSFYNLFFTVWPPFVIGVFDQFVSSRLLERYPQLYKLGQKGQFFSVYIFWGWIINGFFHSAIVFIGTILIYRYGFALNMHGELADHWSWGVTVYTTSVIIVLGKAALVTNQWTKFTLIAIPGSLLFWLIFFPIYASIFPHANISREYYGVVKHTYGSGVFWLTLIVLPIFALVRDFLWKYYKRMYEPETYHVIQEMQKYNISDSRPHVQQFQNAIRKVRQVQRMKKQRGFAFSQAEEGGQEKIVRMYDTTQKRGKYGELQDASANPFNDNNGLGSNDFESAEPFIENPFADGNQNSNRFSSSRDDISFDI

SEQ ID NO: 1401 - protein, 1258 aa, Schizosaccharomyces pombe
MARDVDNKQNAKRISRDEDEDEFAGESMVGRTLDNPFLGEDEFEDIFGSESQYISSSGQNSTNPFLADTRIENSPLGSESKANQLNKQGTNVNHIEIPLRDFNDPTQPESFLPPPKNTFTSRIKKIKNLFKKEKKQVKPEDLGPRQIILNDYSANHFLHNAVSTCKYSAFTFLPKFLKEQFSKYANLFFLFTAVVQQIPGITPVNRYTTIGPMLIVLSVSGIKEIMEDIKRKKQDQELNESPCYVLQGTGFVEKQWKDVVVGDIVKIVSETFFPADLVLLSSSEPEGLCYIETANLDGETNLKIKQALPETAGLLKPVELGQLSGEVKSEQPNNNLYTFDATLKLLPSDRELPLSPDQLLLRGAQLRNTPWVYGIVVFTGHESKLMKNTTETPIKRTSVEKQVNSQILFLLCIFVFLCFASSLGALIHRSVYGSALSYVKYTSNRAGMFFKGLLTFWILYSNLVPISLFVTFELVRYIQAQLISSDLDMYNEETDTPAACRTSSLVEELGQVGYIFSDKTGTLTRNQMEFRQCTIAGVAYADVIPEDRQFTSEDLDSDMYIYDFDTLKENLKHSENASLIHQFLLVLSICHTVIPEYDESTNSIKYQASSPDEGALVKGAASIGYKFLARKPHLVTVSIFGKDESYELLHICEFNSTRKRMSIVFRCPDGKIRLYVKGADTVIMERLASDNPYLQTTIHHLEDYATVGLRTLCIAMREVPEDEYQRWSTVFETAASSLVDRAQKLMDAAEEIEKDLILLGATAIEDRLQDGVPDTISTLQTAGIKIWVLTGDRQETAINIGMSCKLIDEDMGLVIVNEETKEATAESVMAKLSSIYRNEATTGNVESMALVIDGVSLTYALDFSLERRFFELASLCRAVICCRVSPLQKALIVKMVKRNTGEVLLAIGDGANDVPMIQAAHVGVGISGMEGLQAVRSSDFSISQFCYLKKLLLVHGSWCYQRLSKLILYSFYKNIALYMTQFWYAFCNAFSGQVIFESWSISLYNVLFTVLPPVVIGIFDQFVSAGQLFQYPQLYQLGQRSEFFNLKRFWSWITNGFYHSLLLFLCSIAVFYYDGPNKDGLASGHWVWGTTLYAAILATVLGKAALISNHWTQYTVIATLGSFLLWIVFMPIYAVAAPAIGFSKEYYGIIPHLYGNLKFWASLLVLPTIALMRDFVWKYSSRMYYPEEYHYVQEIQKYNVTDYRPRIVGFHKAIRKIRQMQRMRKQRGYAFSQGEEDQSRILDAYDTTHTRGAYGEMR

SEQ ID NO: 1402 - protein, 1175 aa, Oryza sativa
MASGRPLLDASPRPTQQPPASSLLPPPQPEPPLRADRLAFSLEVPDPFRREPDPSSAASQRGEEEGGGEEESRAVVVGEPSSSEAAAGFAGNGVRTAKYSVLTFLPRNLFEQFRRLSYVYFLAITVLNQLPQVAVFGRGASVLPLAFVLFVTAVKDAYEDLRRHRSDRQENNRLARVLLAPPAAGEFAPKKWKHIRVGDVVRVASSETLPADMVLLATSDPSGVAHVQTVNLDGETNLKTRYAKQETQLRFSQDGGIGGVLHCERPNRNIYGFQANLEIDGKRVSLGPSNIVLRGCELKNTTWAIGVVVYAGKETKVMLNSSGAPSKRSRLETQLNRETVILSIMLIGMCTTASVLAGIWILNHRGDLEFTQFFREKDYTTGKNYNYYGMGMQIFITFLMAVIVYQVIIPISLYISMELVRLGQAYFMGADRDLYDESSRSKFQCRALNINEDLGQIKYVFSDKTGTLTENKMEFQCASIRGVDYCSGKDSCGYSVVVDDLLWTPKMAVKIDHRLLKLLRGGGTDEETKLVLEFFLALAACNTIVPLVLDTRDSKQKLIDYQGESPDEQALVYAAASYGIVLVERTSGYVVIDVLGDRQRFDILGLHEFDSDRKRMSVIVGCPDKTVKLYVKGADSSLFGITKNSLDLDIVRATEAHLHKYSSFGLRTLVIGMRELSQPEFEEWQLAYENASTSVLGRGNLLRSVAANIENNIRILGATGIEDKLQDGVPETIESLRQADIKVWILTGDKQETAISIGYSCKLLTNDMTQIVINNNSKESCKRSLEEAHATIKKLRIASTGTQSPELASESAGVTLALIVDGNSLVYILETELQEELFKVARECSVVLCCRVAPLQKAGIVALIKNRTDDMTLAIGDGANDVSMIQMADVGVGISGQEGRQAVMASDFAMGQFRFLVPLLLVHGHWNYQRMSYMILYNFYKNATFVLVLFWYVLYTAFTLTTAITEWSSLLYTVLYTSLPTIVVGILDKDLSKETLLAYPKLYGSGQRDEKYNVNLFVLNMLEALWQSLVVFYMPYFAYRQSTIDMSSLGDLWALAPVIVVNMLLAMDIFRWNWIVHAFVWGTIAATTICLFVIDSIWFLPGYGAIFHIMGTGLFWLLLLIIVVAAMVPHFVIKAFTEYFTPSDIQVAREIEKFENVNQVNRSEVPMTRLHDPRR

SEQ ID NO: 1403 - protein, 310 aa, Saccharomyces cerevisiae
MTTSILDTYPQICSPNALPGTPGNLTKEQEEALLQFRSILLEKNYKERLDDSTLLRFLRARKFDINASVEMFVETERWREEYGANTIIEDYENNKEAEDKERIKLAKMYPQYYHHVDKDGRPLYFEELGGINLKKMYKITTEKQMLRNLVKEYELFATYRVPACSRRAGYLIETSCTVLDLKGISLSNAYHVLSYIKDVADISQNYYPERMGKFYIIHSPFGFSTMFKMVKPFLDPVTVSKIFILGSSYKKELLKQIPIENLPVKYGGTSVLHNPNDKFYYSDIGPWRDPRYIGPEGEIPNIFGKFTVTS

SEQ ID NO: 1404 - protein, 327 aa, Zea mays
MAAEASAVQQLAGLLDQVDAPLKKTFENVHQGYPTETLLRFLKAREWHVNKAHRMLEDSLNWRMQNEIDSILEKPIIPVDLYRSIRDTQLIGLSGYSKEGIPVFAVGVGLSTYDKASVNYYVQSHIQINEYRDRFILPTVTKKYGRPITTCIKVLDMTGLKLSALHQMKIVTAISTVDDLNYPEKTETYYIVNAPYIFSACWKVVKPLLQERTRKKVHVLRGCGRDELLQIMDYSSLPHFCRQEGSGSSKHSSGDADNCFSLDHPFHQELYSFIQEQALNQELIKQGSLHVKIPEQDPEDAKIVEVIEAEFHKLGVQNGSANGIDQA

SEQ ID NO: 1405 - protein, 251 aa, Zea mays
MASAAGGGAAGEGEWLKVSQLRPMVEAQDPNAKAVDNLTLRRFLRARDHDVDKASAMFLKFLKWRREAAPGGSVPEEQVRRELSQDKLCMGGVDRAGRPILVAFAARHFSAGRDMAEFKSFVVYFFDKICARIPRGQEKFLCIVDLKGWGYSNCDVRAYIAAIEILQNYYPERLGKALMIHVPYIFMKAWKMIYPFIDTNTRDKFVFVEDKSLQETLRREIDEGQLPEFLGGKMDVIPLKDYGVQQQPQAV

SEQ ID NO: 1406 - protein, 296 aa, Zea mays
MFRRKHGSDFNSDDAEQREAKISELKAALGTLSARGEKYCSEACLRRYLEARNWNVAKSRKMLEESLKWRAAYKPEDIRWPDVSVEAETGKMYRASFRDREGRTVVVMKPTKQNTSSHEGQIRFLVYTLENAIFSLPEGQEKMVWLIDFTGWTVSHASPIKTCRETANILQNHFPERLAIGFLFNPPKVFEAFYKVIKIFLDPKSVEKVNFVYEKDEESMKVMYKYIDPEVLPVEFGGKSNVVYNHEEYSELMRQDDIKTASFWAVDAKTNHANPAINGTLVPEVAPQSSLAAKAS

SEQ ID NO: 1407 - protein, 256 aa, Glycine max
MEAVRAGREGAIGLGQGDGVAKDSTETELTKIRLLRAIVETRDPSSKEEDDFMIRRFLRARDLDVEKASAMLLKYLKWRNSFVPNGSVSVSDVPNELAQDKVFMQGHDKIGRPILMVFGGRHFQNKDGLDEFKRFVVYVLDKVCASMPPGQEKFVGIAELKGWGYSNSDVRGYLSALSILQDYYPERLGKLFIVNAPYIFMKVWQIVYPFIDNKTKKKIVFVEKNKVKSTLLEEMEESQVPEIFGGSLPLVPIQDS

SEQ ID NO: 1408 - protein, 630 aa, Zea mays
MESGLVASHRLRVPPPSASAGHHHLIRHRHAHAPVAAAPLRLSLPRHLPRSTPLRLPAALPLRHCLPPLRAASAAAAAVPAPGDDASPKFLGVETKTIKKIVPLGLMFFCILFNYTILRDTKDVLVVTAKGSSAEIIPFLKTWVNLPMAVGFMLLYTKLADVLSKEALFYAVIFPFIAFFGAFAYVLYPMRDAIHPTALADRLLASLGPSFLGPVAILRVWSFCLFYVMAELWGSVVISVLFWGFANQITTVEEAKEFYPLFGLGANVALIFSGRTVKYFSNMRKNLGPGVDGWAISLKAMMSIVVVLGLVITGIYWGVNKFVIDNSSVPVVERKKKDKPKLSMGESMKVLLSSRYVRDLATLVVAYGISINLVEVTWKSKLKAQFPSPNEYSSFMGDFSTATGIATFTMMLLGRVILRKFGWGVAATITPAVLLLTGVGFFSLILFGEPLTPLMTKFGMTPLLAAVYVGAMQNIFSKSAKYSLFDPCKEMAYIPLDEDMKVKGKAAIDVVCNPLGKSGGALIQQFMILSFGSLANSTPYLGGILLVIVLAWLGAVRSLDLQFSSLAKQELGREKLLKTQAVETVAEVVGTGNGSLQETLASEPSANGAATKQSQEPESTAPEKSGQQSQ

SEQ ID NO: 1409 - protein, 441 aa, Xylella fastidiosa
MPGAAPTSPSRQPLLQRLAGVRPEEAPAVLWSMLYVVALFLAYYVLRPIRDELGVAGGVQNLPWLFTGTLLAMLVASPLFALAVRSLPRRQFIALAYRFFAANLVLFALLLHFADPQWQVWVGRAFFIWVSVFNLFVVSVFWSFMVDLFDSEQGKRLFGLFAAGATAGGLLGSAITSGLIEHLDRSWLMAIAIVFLELAVLASRRLSRIAPAFQHAARRDNPDQPLGGGIFAGMVHTLRSPYLGGLAIFILLYSVTSTFLYFQQASIAQASFPDRAARTAFFANIDLIVNAVTLVFQLFVTGRMMATVGIVATLCVLPLVSLLGFAALAASPSVAVIVAAQVARRVANFALARPAREILFTSSAREDRYKAKNFIDTVVYRGGDQIASWGYAGLMGLGLTLAQIPMIAVPLSAVWLGLSVWLGRTHQAQERQDAATAPSIH

SEQ ID NO: 1410 - protein, 318 aa, Saccharomyces cerevisiae
MSSNAQVKTPLPPAPAPKKESNFLIDFLMGGVSAAVAKTAASPIERVKLLIQNQDEMLKQGTLDRKYAGILDCFKRTATQEGVISFWRGNTANVIRYFPTQALNFAFKDKIKAMFGFKKEEGYAKWFAGNLASGGAAGALSLLFVYSLDYARTRLAADSKSSKKGGARQFNGLIDVYKKTLKSDGVAGLYRGFLPSVVGIVVYRGLYFGMYDSLKPLLLTGSLEGSFLASFLLGWVVTTGASTCSYPLDTVRRRMMMTSGQAVKYDGAFDCLRKIVAAEGVGSLFKGCGANILRGVAGAGVISMYDQLQMILFGKKFK

SEQ ID NO: 1411 - protein, 644 aa, Oryza sativa
MESLALLHAKPGGLPPRAGLRLPLPRARSARVSLPSSPAAPVSLQSPLLLASRSGPTSRDAVVGLGLGCGLLRRRSGASGGGGGGVSCGAQPAAAAAAGAVPAAQPEGKKFLGVEVKTLKKIVPLGLMFFCILFNYTILRDTKDVLVVTAKGSSAEIIPFLKTWVNLPMAIGFMLLYTKLSNVLSREALFYTVIFPFIAFFGAFAFVLYPLRNVIHPTALADKLLAALGPSFLGPVAILRIWSFCLFYVMAELWGSVVISVLFWGFANQITTVEEAKEFYPLFGLGANIALIFSGRTVKYFSNLRKTLGPGIDGWEVSLKGMMSLVVLLGLVITSIYWGVNKFVLNDPSLPKSDRKKKKDKPKLGMKESLKVLLSSRYVRDLATLVVAYGISINLVEVTWKSKLKAQQFPSPNEYSSFMGDFSTATGIATFTMMLLGRIILRKFGWGVAAMITPTVLLLTGVGFFSLILFGQPLTPMLATMGMTPLLAAVYVGALQNIFSKSAKYSLFDPCKEMAYIPLDEDMKVVKGKAAIDVVCNPLGKSGGALIQQFMILTFGSLANSTPYLGGILLVIVLAWLGAASSLDKQFSSLAKEDLKRDMSAKEKVDPSLLKAPEADVLVEHTNGTIESEATATESSPSNSSPSN

SEQ ID NO: 1412 - protein, 677 aa, Zea mays
MALPSMSLVAKGVLPFSARTSSGVTQRPVSVTASLEHKTSDARRKFLKLALGNLGVGLPTLLGAKKALADEQGVSSSRMSYSRFLEYLDKDRVKKVDLFENGTIAIVEAISPELGNRVQRVRVQLPGLSQELLQKLREKNIDFAAHSNQEDSGSLLFNLIGNLAFPLILIGGLFLLSRRAQGGLGGPNGPGFPLGFGQSRAKFQMEPNTGVTFDDVAGVDEAKQDFMEVVEFLKKPERFTAVGARIPKGVLLVGPPGTGKTLLAKAIAGEAGVPFFSISGSEFVEMFVGVGASRVRDLFKKAKENAPCIVFVDEIDAVGRQRGTGIGGGNDEREQTLNQLLTEMDGFEGNTGIIVIAATNRADILDSALLRPGRFDRQVSVDVPDVRGRTEILKVHGSNKKFDSDVSLDVIAMRTPGFSGADLANLLNEAAILAGRRGRTAISSKEIDDSIDRIVAGMEGTVMTDGKSKSLVAYHEVGHAICGTLTPGHDPVQKVTLVPRGQARGLTWFIPMDDPTLISRQQLFARIVGGLGGRAAEEVIFGEPEVTTGAAGDLQQITGLAKQMVVTFGMSEIGPWSLMEGGAQSGDVIMRMMARNSMSEKLAEDIDSAVKQLSDEAYEIALRHIRNNREAIDKIVEVLIEKETVTGDEFRAILSEFAEIPVENRVPPATPAAALPA

SEQ ID NO: 1413 - protein, 810 aa, Zea mays
MASQGEPSASASDPKEKKDYSTAILERKKSPNRLVVDEATNDDNSVVALHPDTMERLQLFRGDTVLLKGKKRKDTVCIVLADETCEEPKVRMNKVVRQNLRVRLGDVVSVHQCQDVKYGKRVHILPIDDTVEGITGNLFDAFLKPYFLEAYRPVRKGDLFLVRGGMRSVEFKVIETDPSEYCIVAPDTEIFCDGEPIKREDEERLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTNGEVERRIVSQLLTLMDGLKSRSHVIVMGATNRPNSIDPALRRFGRFDREIDIGVPDEVGRLEVLRIHTKNMKLAEDVNLELISKDTHGYVGADLAALCTEAALQCIREKMDIIDLEDETIDAEILNSMAVTNDHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEQSRLQIFKACLRKSPVAKDVDLNALAKYTQGFSGADITEICQRACKYAIRENIEKDIERERRMKDNPEAMEEDEVDEIAEIKAAHFEESMKYARRSVSDADIRKYQAFAQTLQQSRGFGSEFRFSEQSATAGAAAADPFASAGAAADDDDLYS

SEQ ID NO: 1414 - protein, 270 aa, Arabidopsis thaliana
MELNRSEADEAKAETTPTGGATSSATASGSSSGRRPRGRPAGSKNKPKPPTIITRDSPNVLRSHVLEVTSGSDISEAVSTYATRRGCGVCIISGTGAVTNVTIRQPAAPAGGGVITLHGRFDILSLTGTALPPPAPPGAGGLTVYLAGGQGQVVGGNVAGSLIASGPVVLMAASFANAVYDRLPIEEEETPPPRTTGVQQQQPEASQSSEVTGSGAQACESNLQGGNGGGGVAFYNLGMNMNNFQFSGGDIYGMSGGSGGGGGGATRPAF

SEQ ID NO: 1415 - protein, 249 aa, Arabidopsis thaliana
MAYGKRPFGGDESEEREEDENLFPVFSARSQHDMRVMVSALTQVIGNQQSKSHDNISSIDDNYPSVYNPQDPNQQVAPTHQDQGDLRRRHYRGVRQRPWGKWAAEIRDPKKAARVWLGTFETAESAALAYDEAALKFKGSKAKLNFPERVQLGSNSTYYSSNQIPQMEPQSIPNYNQYYHDASSGDMLSFNLGGGYGSGTGYSMSHDNSTTTAATTSSSSGGSSRQQEEQDYARFWRFGDSSSSPHSGY

SEQ ID NO: 1416 - protein, 158 aa, Arabidopsis thaliana
MEVSNSCSSFSSSSVDSTKPSPSESSVNLSLSLTFPSTSPQREARQDWPPIKSRLRDTLKGRRLLRRGDDTSLFVKVYMEGVPIGRKLDLCVFSGYESLLENLSHMFDTSIICGNRDRKHHVLTYEDKDGDWMMVGDIPWDMFLETVRRLKITRPERY

SEQ ID NO: 1417 - protein, 387 aa, Arabidopsis thaliana
MASSPLTANVQGTNASLRNRDEETADKQIQFNDQSFGGNDYAPKVRKPYTITKERERWTDEEHKKFVEALKLYGRAWRRIEEHVGSKTAVQIRSHAQKFFSKVAREATGGDGSSVEPIVIPPPRPKRKPAHPYPRKFGNEADQTSRSVSPSERDTQSPTSVLSTVGSEALCSLDSSSPNRSLSPVSSASPPAALTTTANAPEELETLKLELFPSERLLNRESSIKEPTKQSLKLFGKTVLVSDSGMSSSLTTSTYCKSPIQPLPRKLSSSKTLPIIRNSQEELLSCWIQVPLKQEDVENRCLDSGKAVQNEGSSTGSNTGSVDDTGHTEKTTEPETMLCQWEFKPSERSAFSELRRTNSESNSRGFGPYKKRKMVTEEEEHEIHLHL

SEQ ID NO: 1418 - protein, 398 aa, Arabidopsis thaliana
MDKEKSPAPPCGGLPPPSPSGRCSAFSEAGPIGHGSDANRMSHDISRMLDNPPKKIGHRRAHSEILTLPDDLSFDSDLGVVGNAADGASFSDETEEDLLSMYLDMDKFNSSATSSAQVGEPSGTAWKNETMMQTGTGSTSNPQNTVNSLGERPRIRHQHSQSMDGSMNINEMLMSGNEDDSAIDAKKSMSATKLAELALIDPKRAKRIWANRQSAARSKERKTRYIFELERKVQTLQTEATTLSAQLTLLQRDTNGLTVENNELKLRLQTMEQQVHLQDELNEALKEEIQHLKVLTGQVAPSALNYGSFGSNQQQFYSNNQSMQTILAAKQFQQLQIHSQKQQQQQQQQQQQHQQQQQQQQQYQFQQQQMQQLMQQRLQQQEQQNGVRLKPSQAQKEN

SEQ ID NO: 1419 - protein, 212 aa, Arabidopsis thaliana
MVSALSRVIENPTDPPVKQELDKSDQHQPDQDQPRRRHYRGVRQRPWGKWAAEIRDPKKAARVWLGTFETAEEAALAYDRAALKFKGTKAKLNFPERVQGPTTTTTISHAPRGVSESMNSPPPRPGPPSTTTTSWPMTYNQDILQYAQLLTSNNEVDLSYYTSTLFSQPFSTPSSSSSSSQQTQQQQLQQQQQQREEEEKNYGYNYYNYPRE

SEQ ID NO: 1420 - protein, 357 aa, Glycine max
MKERQRWRAEEDALLRSYVKQYGPREWNLVSQRMNTYLNRDAKSCLERWKNYLKPGIKKGSLTEEEQRLVIHLQAKYGNKWKKIAAEVPGRTAKRLGKWWEVFKEKQQREKKEINRIADPINNSKYEHILESFAEKLVKERPSPSFVMAASDGAFLLTDTPAPASSLRPSWLSNSSSAAAIGPSSLSVKLSLSSSTVATPPFSWLPPERGPDNAPFVLGNVSALHGAIPTLSDSMHMSQMVEHCKELGEGHRALATHKKEAAWRLSRVELQLESEKANRRREKIEEFEAKIKALQEEEKAALGRIEAEYREQLAALRRDAENKEQKLAEQWDAKHLRFTRLLEQLGCRAGLLEPNAR

SEQ ID NO: 1421 - protein, 361 aa, Glycine max
MKDRQRWRAEEDALLRAYVKQYGPREWNLVSQRMNTPLNRDAKSCLERWKNYLKPGIKKGSLTEEEQRLVINLQATHGNKWKKIAAQVPGRTAKRLGKWWEVFKEKQQRETKGNNCTIDPINDSKYEHILESFAEKLVKERPSTSTSTSFVMATSNSSFLHADAPAPAPALLPSWLSNSNGTAPVRPPSPSVTLSLSPSTVAAPPPWMQPPVRGQDNASPLVLGNVAPHGAVLAFGENMVMSELVECCKELDEVHHALAGHKKEAAWRLSRVELQLESEKAGRRREKMEEIEAKIKALREEQTAALDRIEAEYREQLAGLRRDAESKEQKLAEQWAAKHLRLTKFLEQVGCRSRLTEPNGR

SEQ ID NO: 1422 - protein, 351 aa, Zea mays
MDQSFGNLGAGAGSSSGGSNSKAAAAAVSSSSFLQLPLSTASPAYYGAPLALLHHAAAAPSSSQQHQQQQHHHHYARHGAEMSAAEAEAIKAKIVAHPQYSALLAAYLDCQKVGAPPDVLERLTAMAAKLDARPPGRHEPRDPELDQFMEAYCNMLVKYREELTRPIDEAMEFLKRVEAQLDCISGGGGSSSARLSLADGKSEGVGSSEDDMDPNGRENDPPEIDPRAEDKELKYQLLKKYSGYLSSLRQEFSKKKKKGKLPKEARQKLLHWWELHYKWPYPSETEKIALAESTGLDQKQINNWFINQRKRHWKPSEDMPFVMMEGFHPQNAAALYMDGPFMADGMYRLGS

SEQ ID NO: 1423 - protein, 308 aa, Glycine max
MDGMYGVPAEYADKALMTPENLIFPPDYHHDFLAAGRIPLFGSDEFFSSSAGIHRQQEDDVAATTVMKAKIASHPHYPRLLQAYIECQKVGAPPEIARLLEEIRRENDPCKSDAVSSSTCFGADPELDEFMEAYCDMLVKYKSDLARPFDEATTFLNKIEMQLSHLCTGASVSNVSDDGGVSSDEDLSTGDGDAQDGQLKGEDRELKDRLLRKFGSHIGTLKLEFSKKKKKGKLPKEARQALLQWWNVHYKWPYPTEADKIELAKSTGLDQKQINNWFINQRKRHWKPSENMQFSMMENFNGRILADE

SEQ ID NO: 1424 - protein, 311 aa, Glycine max
MEAVYRLKPLLDVVRVGNATTSEMRLDSTANCYLQLEAPQPQENNNVTDSSSDMSDRIIKIQIANHPLYPDLLSAYIECQKVGAPPELACLLEEIGRESHRMNARREIGEGPELDHFMETFCQVLHRYKEELSRPFNEATLFLGDMESQLSNLCNETLTKSSDNNNRSDEVASGASEEELSCGEMEAFEDNVSSVTCPSDQRLKEMLLRKYSGHFSGLRKEFLKRRKKGKLPKDARMALMGWWNTHHRWPYPTEEEKVKLSEITGLDQKQINNWFINQRKRHWKPTEDMRFAVMDGLRGGGGGGIGGPMLF

SEQ ID NO: 1425 - protein, 420 aa, Glycine max
MDKDKSLGLPPPSGRYSGYSSTGSVFNVKSEPSPSSSTTLYPPLAPGTTSSESSHFGHGLSTDSSGFSHDISRMPDNPPRNRGHRRAHSEILTLPDDISFDSDLGVVGGGDGPSFSDDAEEDLLSMYLDMDKFNSSSATSTFQMVEPSNAVGASASTPASGAPTSSTENVVIGTNERPRVRHQHSQSMDGSTTIKPEMLVSGSEDMSAADSKKAMSAAKLAELALIDPKRAKRIWANRQSAARSKERKMRYIAELERKVQTLQTEATSLSAQLTLLQRDTNGLNSENNELKLRLQTMEQQVHLQDALNDALKEEIQHLKILTGQAMPPNGGPMMNFASFGGGQQFYPNNHAMHTLLAAQQFQQLQIHPQKQQQHQFQQLQQQQREQHQQSIDLKMREATPTPCPKDNASSDVNPSGAKDC

SEQ ID NO: 1426 - protein, 287 aa, Glycine max
MAIQDQNGFFRSQGGPPEGGGVSLSSGHSVTHIQLNDQFSCGNDYALKVRKPYTITKQRERWTDEEHKKFLEALKLYGRAWRRIEEHVGTKTAVQIRSHAQKFFSKVLHDPTGNNTNTVESIEIPPPRPKRKPMHPYPRKLVETPNKEISIPEQPMKSNSLKSSDFDQENQSPKSVLSGVGSDSLGSSDSDTPNGSLSPMSSISGFHTSSFTRAKPKTTTSEEEAGMDTDSTHDEKPLMKFKLPPNGCVSIKEDNTAEESSGRTFKLFGMTLFVTDTCKPSPTIEEC

SEQ ID NO: 1427 - protein, 182 aa, Oryza sativa
MELELGLAPPNSGHLVVDELSSSSSSGGGSGSAPVSASSAGKRGFREAFQETLLLFDDGSCCNTSDDDCRRRKKTVVGWPPVSSARRACGGANYVKVKKEGDAIGRKVDLALHSSYDELAATLARMFPTNDHQGEKKMANDDHGDAAGPVVTYEDGDGDWMLVGDVPWDDFARSVKRLKILG

SEQ ID NO: 1428 - protein, 298 aa, Arabidopsis thaliana
MGKEVMVSDYGDDDGEDAGGGDEYRIPEWEIGLPNGDDLTPLSQYLVPSILALAFSMIPERSRTIHDVNRASQITLSSLRSSTNASSVMEEVVDRVESSVPGSDPKKQKKSDGGEAAAVEDSTAEEGDSGPEDASGKTSKRPRLVWTPQLHKRFVDVVAHLGIKNAVPKTIMQLMNVEGLTRENVASHLQKYRLYLKRIQGLTTEEDPYSSSDQLFSSTPVPPQSFQDGGGSNGKLGVPVPVPSMVPIPGYGNQMGMQGYYQQYSNHGNESNQYMMQQNKFGTMVTYPSVGGGDVNDK

SEQ ID NO: 1429 - protein, 258 aa, Zea mays
MGEEAVDDYELHMVCYGGGGGGSEDERVMEWESGLPGADELTPLSQPLVPAGLAAAFRIPPEAGRTLLDVHRASAATVSRLRRAPPPSSSGSGGSSSFAPFHPAARGDEGADSSAAGGGAAATTNGNNNMSSSSKRPRLVWTPQLHKRFVDVVAHLGMKNAVPKTIMQLMNVEGLTRENVASHLQKYRLYVKRMQGLSDEGPSPSDHIFASTPVPQSLVHEVPMYGTMASGGQAYHNHNGMGGGGYQYQYHHYHHAHK

SEQ ID NO: 1430 - protein, 335 aa, Arabidopsis thaliana
MLEGLVSQESLSLNSMDMSVLERLKWVQQQQQQLQQVVSHSSNNSPELLQILQFHGSNNDELLESSFSQFQMLGSGFGPNYNMGFGPPHESISRTSSCHMEPVDTMEVLLKTGEETRAVALKNKRKPEVKTREEQKTEKKIKVEAETESSMKGKSNMGNTEASSDTSKETSKGASENQKLDYIHVRARRGQATDRHSLAERARREKISKKMKYLQDIVPGCNKVTGKAGMLDEIINYVQCLQRQVEFLSMKLAVLNPELELAVEDVSVKQAYFTNVVASKQSIMVDVPLFPLDQQGSLDLSAINPNQTTSIEAPSGSWETQSQSLYNTSSLGFHY

SEQ ID NO: 1431 - protein, 138 aa, Zea mays
MAGKGGKGLLAAKTTAAKSTDKDKDRKKAPVSRSSRAGLQFPVGRIHRQLKSRASAHGRVGATAAVYSAAILEYLTAEVLELAGNASKDLKVKRITPRHLQLAIRGDEELDTLIKGTIAGGGVIPHIHKSLINKTAKE

SEQ ID NO: 1432 - protein, 134 aa, Zea mays
MAGRGKAIGAGAAKKATSRSSKAGLQFPVGRIARFLKAGKYAERVGAGAPVYLAAVLEYLAAEVLELAGNAARDNKKTRIVPRHIQLAVRNDEELTKLLGGATIASGGVMPNIHQHLLPKKAASSKASVDDDDN

SEQ ID NO: 1433 - protein, 157 aa, Zea mays
MDASGAGSKGKKGAAGRKAGGPRKKSVTRSVKAGLQFPVGRIGRYLKKGRYAQRVGTGAPVYLAAVLEYLAAEVLELAGNAAKDNKKTRIIPRHVLLAIRNDEELGKLLAGVTIAHGGVLPNIHSVLLPKKAAEKAASGGSKEPKSPKKGAKSPKKA

SEQ ID NO: 1434 - protein, 160 aa, Zea mays
MDAGAKVVKKAAAGRRGGGGPKKKPVSRSVKAGLQFPVGRIGRYLKQGRYSQRVGTGAPVYLAAVLEYLAAGLLELAGNAARDNKKNRIIPRHVLLAIRNDEELGKLLAGVTIAHGGVLPNINPVLLPKKTAVAAAKEGKEKKSPKKAAAAKSPKKVAAS

SEQ ID NO: 1435 - protein, 317 aa, Arabidopsis thaliana
MAVELMTRNYISGVGADSFAVQEAAASGLKSIENFIGLMSRDSFNSDQPSSSSASASASAAADLESARNTTADAAVSKFKRVISLLDRTRTGHARFRRAPVHVISPVLLQEEPKTTPFQSPLPPPPQMIRKGSFSSSMKTIDFSSLSSVTTESDNQKKIHHHQRPSETAPFASQTQSLSTTVSSFSKSTKRKCNSENLLTGKCASASSSGRCHCSKKRKIKQRRIIRVPAISAKMSDVPPDDYSWRKYGQKPIKGSPHPRGYYKCSSVRGCPARKHVERAADDSSMLIVTYEGDHNHSLSAADLAGAAVADLILESS

SEQ ID NO: 1436 - protein, 170 aa, Arabidopsis thaliana
MATQDSQGIKLFGKTIAFNTRTIKNEEETHPPEQEATIAVRSSSSSDLTAEKRPDKIIACPRCKSMETKFCYFNNYNVNQPRHFCKGCHRYWTAGGALRNVPVGAGRRKSKPPGRVVVGMLGDGNGVRQVELINGLLVEEWQHAAAAAHGSFRHDFPMKRLRCYSDGQSC

SEQ ID NO: 1437 - protein, 270 aa, Arabidopsis thaliana; identical to SEQ ID NO: 1414

SEQ ID NO: 1438 - protein, 352 aa, Arabidopsis thaliana
MVRTPCCKAELGLKKGAWTPEEDQKLLSYLNRHGEGGWRTLPEKAGLKRCGKSCRLRWANYLRPDIKRGEFTEDEERSIISLHALHGNKWSAIARGLPGRTDNEIKNYWNTHIKKRLIKKGIDPVTHKGITSGTDKSENLPEKQNVNLTTSDHDLDNDKAKKNNKNFGLSSASFLNKVANRFGKRINQSVLSEIIGSGGPLASTSHTTNTTTTSVSVDSESVKSTSSSFAPTSNLLCHGTVATTPVSSNFDVDGNVNLTCSSSTFSDSSVNNPLMYCDNFVGNNNVDDEDTIGFSTFLNDEDFMMLEESCVENTAFMKELTRFLHEDENDVVDVTPVYERQDLFDEIDNYFG

SEQ ID NO: 1439 - protein, 220 aa, Arabidopsis thaliana
MARMTRDGKEHEYKKGLWTVEEDKILMDYVRTHGQGHWNRIAKKTGLKRCGKSCRLRWMNYLSPNVNRGNFTDQEEDLIIRLHKLLGNRWSLIAKRVPGRTDNQVKNYWNTHLSKKLGLGDHSTAVKAACGVESPPSMALITTTSSSHQEISGGKNSTLRFDTLVDESKLKPKSKLVHATPTDVEVAATVPNLFDTFWVLEDGFELSSLTMMDFTNGYCL

SEQ ID NO: 1440 - protein, 314 aa, Arabidopsis thaliana
MADLFGGGHGGELMEALQPFYKSASTSASNPAFASSNDAFASAPNDLFSSSSYYNPHASLFPSHSTTSYPDIYSGSMTYPSSFGSDLQQPENYQSQFHYQNTITYTHQDNNTCMLNFIEPSQPGFMTQPGPSSGSVSKPAKLYRGVRQRHWGKWVAEIRLPRNRTRLWLGTFDTAEEAALAYDRAAFKLRGDSARLNFPALRYQTGSSPSDTGEYGPIQAAVDAKLEAILAEPKNQPGKTERTSRKRAKAAASSAEQPSAPQQHSGSGESDGSGSPTSDVMVQEMCQEPEMPWNENFMLGKCPSYEIDWASILS

SEQ ID NO: 1441 - protein, 198 aa, Arabidopsis thaliana
MENGMYKKKGVCDSCVSSKSRSNHSPKRSMMEPQPHHLLMDWNKANDLLTQEHAAFLNDPHHLMLDPPPETLIHLDEDEEYDEDMDAMKEMQYMIAVMQPVDIDPATVPKPNRRSVRISDDPQTVVARRRRERISEKIRILKRIVPGGAKMDTASMLDEAIRYTKFLKRQVRILQPHSQIGAPMANPSYLCYYHNSQP

SEQ ID NO: 1442 - protein, 131 aa, Arabidopsis thaliana
MDQGGRGVGAEHGKYRGVRRRPWGKYAAEIRDSRKHGERVWLGTFDTAEEAARAYDQAAYSMRGQAAILNFPHEYNMGSGVSSSTAMAGSSSASASASSSSRQVFEFEYLDDSVLEELLEEGEKPNKGKKK

SEQ ID NO: 1443 - protein, 181 aa, Arabidopsis thaliana
MARPQQRFRGVRQRHWGSWVSEIRHPLLKTRIWLGTFETAEDAARAYDEAARLMCGPRARTNFPYNPNAIPTSSSKLLSATLTAKLHKCYMASLQMTKQTQTQTQTQTARSQSADSDGVTANESHLNRGVTETTEIKWEDGNANMQQNFRPLEEDHIEQMIEELLHYGSIELCSVLPTQTL

SEQ ID NO: 1444 - protein, 286 aa, Arabidopsis thaliana
MALSSAKHQRNHRLSATNKNQTLTKVSSISSSSPSSSSSSSSTSSSSPLPSQDSQAQKRSLVTMEEVWNDINLASIHHLNRHSPHPQHNHEPRFRGQNHHNQNPNSIFQDFLKGSLNQEPAPTSQTTGSAPNGDSTTVTVLYSSPFPPPATVLSLNSGAGFEFLDNQDPLVTSNSNLHTHHHLSNAHAFNTSFEALVPSSSFGKKRGQDSNEGSGNRRHKRMIKNRESAARSRARKQAYTNELELEVAHLQAENARLKRQQDQLKMAAAIQQPKKNTLQRSSTAPF

SEQ ID NO: 1445 - protein, 287 aa, Arabidopsis thaliana
MAMQERCESLCSDELISSSDAFYLKTRKPYTITKQREKWTEAEHEKFVEALKLYGRAWRRIEEHVGTKTAVQIRSHAQKFFTKVARDFGVSSESIEIPPPRPKRKPMHPYPRKLVIPDAKEMVYAELTGSKLIQDEDNRSPTSVLSAHGSDGLGSIGSNSPNSSSAELSSHTEESLSLEAETKQSLKLFGKTFVVGDYNSSMSCDDSEDGKKKLYSETQSLQCSSSTSENAETEVVVSEFKRSERSAFSQLKSSVTEMNNMRGFMPYKKRVKVEENIDNVKLSYPLW

SEQ ID NO: 1446 - protein, 336 aa, Oryza sativa
MAGMDPGGGGAGAGSSRYFHHLLRPQQPSPLSPLSPTSHVKMEHSKMSPDKSPVGEGDHAGGSGSGGVGGDHQPSSSAMVPVEGGSGSAGGSGSGGPTRRPRGRPPGSKNKPKPPIIVTRDSPNALHSHVLEVAGGADVVDCVAEYARRRGRGVCVLSGGGAVVNVALRQPGASPPGSMVATLRGRFEILSLTGTVLPPPAPPGASGLTVFLSGGQGQVIGGSVVGPLVAAGPVVLMAASFANAVYERLPLEGEEEEVAAPAAGGEAQDQVAQSAGPPGQQPAASQSSGVTGGDGTGGAGGMSLYNLAGNVGGYQLPGDNFGGWSGAGAGGVRPPF

SEQ ID NO: 1447 - protein, 448 aa, Arabidopsis thaliana
MMMETRDPAIKLFGMKIPFPSVFESAVTVEDDEEDDWSGGDDKSPEKVTPELSDKNNNNCNDNSFNNSKPETLDKEEATSTDQIESSDTPEDNQQTTPDGKTLKKPTKILPCPRCKSMETKFCYYNNYNINQPRHFCKACQRYWTAGGTMRNVPVGAGRRKNKSSSSHYRHITISEALEAARLDPGLQANTRVLSFGLEAQQQHVAAPMTPVMKLQEDQKVSNGARNRFHGLADQRLVARVENGDDCSSGSSVTTSNNHSVDESRAQSGSVVEAQMNNNNNNNMNGYACIPGVPWPYTWNPAMPPPGFYPPPGYPMPFYPYWTIPMLPPHQSSSPISQKCSNTNSPTLGKHPRDEGSSKKDNETERKQKAGCVLVPKTLRIDDPNEAAKSSIWTTLGIKNEAMCKAGGMFKGFDHKTKMYNNDKAENSPVLSANPAALSRSHNFHEQI

SEQ ID NO: 1448 - protein, 373 aa, Arabidopsis thaliana
MQMVHTSRSIAQIGFGVKSQLVLTIGLERPPGQVKDQTMSKEAEMSIAVSALFPGFRFSPTDVELISYYLRRKIDGDENSVAVIAEVEIYKFEPWDLPEESKLKSENEWFYFCARGRKYPHGSQSRRATQLGYWKATGKERSVKSGNQVVGTKRTLVFHIGRAPRGERTEWIMHEYCIHGAPQDALVVCRLRKNADFRASSTQKIEDGVVQDDGYVGQRGGLDKEDKSYYESEHQIPNGDIAESSNVVEDQADTDDDCYAEILNDDIIKLDEEALKASQAFRPTNPTHQETISSESSSKRSKCGIKKESTETMNCYALFRIKNVAGTDSSWRFPNPFKIKKDDSQRLMKNVLATTVFLAILFSFFWTVLIARN

SEQ ID NO: 1449 - protein, 371 aa, Arabidopsis thaliana
MMEGVSREAQMSIAASSMFPGFRFCPTDEELISYYLRKKLEGHEESVQVISEVELCKYEPWDLPAKSFIQSDNEWFFFSPRGRKYPNGSQSKRATECGYWKATGKERNVKSGSNIIGTKRTLVFHLGRAPKGERTEWIMHEYCINDKSQESLVICRLKRNTEFRLSDASNRASSSQRHPVNSHESGCAISGGGIDQRDACEQDKEVGCSSKRDSSSYGSPSMEQIDSVSESNQRPVNEATFTESSGQPKEGYEEDCYAEILKDDIIKLDESSVLVESHTRPQDPTQMQPAPQGTAQRRIRLRVGNSKHSRAVVRFPSTMHSSKNTFFARTTNSLVVLAFFVFTLMVLYFLSLVRGQKQDKYCGEFSGVNHD

SEQ ID NO: 1450 - protein, 333 aa, Triticum aestivum
MAAQNNKEVDALVEKITGLHAAIAKLPSLSPSPAVDALFTELVTACVPPSPVDVTKLGPEAQEMREGLIRLCSEAEGKLEAHYSDMLAAFDNPLDHLGMFPYYSNYINLSKLEYELLARYVPGGIAPARVAFIGSGPLPFSSFVLAARHLPDTMFDNYDLCGTANDRASKLFRADTDVGARMSFHTADVADLAGELAKYDVVFLAALVGMAAEDKAKVIAHLGAHMADGAALVVRSAHGARGFLYPIVDPQDITLGGFEVLAVCHPDDDVVNSVIIAQKSKDVHVSGLHSGRAVGGQSARGTVPVVSPPCRFGEMVAEVTQKREEFANAEVAF

SEQ ID NO: 1451 - protein, 364 aa, Zea mays
MVVMGKEQQQHEEEEVQGKVVQEEVQVVQETVVPVPSEEDKEAEAALVHKISSLAAAIAKLPSLSPSPEVNALFTELVTACIPRSSVDVERLGPELQEMRGGLIRLCADAEALLEAHYSDLLASFDNPLEHLSLFPYINNYILLSQLEHGLLARHVPGPAPARVAFVGSGPLPLSSLVLAARHLPGASFDNYDICGEANDRARRLVRGDGALQARMAFRTSDVADVTRELASYDAVFLAALVGMAAEEKARVVAHLGRHMAPGAALVVRSAHGARGFLYPVVDPEEIRRGGFDVLAVHHPEGEVINSVIIARKPVAVDAHATGGVGHAHVHAHGAVLSRPCLCCEMEARAHQKMEEVAVEQLPS

SEQ ID NO: 1452 - protein, 672 aa, Zea mays
MDQLRPEPAAGAHEIEKTAAPDVESEPAAAVPEPERVPPWREQVTARGMVAALLIGFVYTVIIMKLSLTTGLTPTMNVSAALLAFLALRGWTRALGRLGIACRPFTRQENTVVQTCVVACYTIGFGGGFGSFLLGLDKKTYELSGVSTPGNVPGSYREPAIGWMTGFLLAVSFVGLLTLLPLRKVLVIDYKLTYPSGTATAVLINGFHTPQGDKNAKIQVRGFLKYFGISFLWSFFQWFYTAGDHCGFAQFPTFGLQAFNQTFSFDFSLTYVGAGMICSHLVNLSLLFGAVVSWGVMWPLIGKQKGNWYPADASQNSMTGIYGYKAFLCIALLVGDGLYNFVKVIAITVKNIRERSRRKNLNRVADADTMALDDMQRDEVFNRDNIPTWLSYAGYAALSLIAVIAIPIMFREVRWYYVVVAYALAPALGFCNAYGTGLTDMNMGYNYGKVALFVLAAWAGKDSGVVAGLVGCGLVKQLVLVSADLMHDFKTGHLTLTSPRSMLVGQAVGTLMGCVLAPLTFMLFYRAFDVGEPDGYWKAPYALIYRNMAILGVEGFSALPRHCLQLCAGFFAFAVLANLARDLLPRRLARLVPLPMAMAVPFLVGASFAVDMCVGSLVVFAWHKLDGKKAALLVPAVASGLICGDGIWTFPSSLLALAKVKPPICMKFTPGS

SEQ ID NO: 1453 - protein, 745 aa, Zea mays
MSGAVLVAIVASIGNLLQGWDNATIAAAVLYIKKEFQLQNEPTVEGLIVSMSLIGATIVTTFSGPLSDSIGRRPMLILSSILYFFSGLIMLWSPNVYVLLLARFVDGFGIGLAVTLVPLYISEIAPSEIRGLLNTLPQFSGSGGMFLSYCMVFGMSLSPSPDWRIMLGVLAIPSLFFFGLTIFYLPESPRWLVSKGRMAEAKKVLQKLRGKDDVSGELSLLLEGLEVGGDTSIEEYIIGPATEAADDLVTDGDKEQITLYGPEEGQSWIARPSKGPSMLGSVLSLASRHGSMVNQSVPLMDPIVTLFGSVHENMPQAGGSMRSTLFPNFGSMFSVTDQHAKNEQWDEENLHRDDEEYASDGAGGDYEDNLHSPLLSRQATGAEGKDIVHHGHRGSALSMRRQSLLGEGGDGVSSTDIGGGWQLAWKWSEKEGENGRKEGGFKRVYLHQEGVPGSRRGSIVSLPGGGDVLEGSEFVHAAALVSQSALFSKGLAEPRMSDAAMVHPSEVAAKGSRWKDLFEPGVRRALLVGVGIQILQQFAGINGVLYYTPQILEQAGVAVILSKFGLSSASASILISSLTTLLMLPCIGFAMLLMDLSGRRFLLLGTIPILIASLVILVVSNLIDLGTLAHALLSTVSVIVYFCCFVMGFGPIPNILCAEIFPTRVRGLCIAICAFTFWIGDIIVTYSLPVMLNAIGLAGVFSIYAVVCLISFVFVFLKVPETKGMPLEVITEFFAVGAKQAAAKA

SEQ ID NO: 1454 - protein, 523 aa, Zea mays
MAGGGIVNTGGGKDYPGKLTLFVLLTCIVAATGGLIFGYDIGISGGVTSMNPFLEKFFPEVYRKKQEAKTNQYCKYDNQLLQTFTSSLYLAALVASFFAATVTRAVGRKWSMLVGGLTFLVGAALNGAAQNIAMLIIGRILLGVGVGFANQSVPVYLSEMAPARLRGMLNIGFQLMITIGILAAELINYGTNKIKAGYGWRVSLALAAVPAAIITLGSLFLPDTPNSLLERGHPEEARRMLRRIRGTDDIGEEYADLVAASEEARQVRHPWRNILRRRYRAQLTMAVAIPFFQQLTGINVIMFYAPVLFDTLGFKNDASLMSSVITGLVNVFATVVSIVTVDRVGRRKLFLQGGAQMIVCQLIVGTLIAAKFGTSGTGDIAKGYAAVVVVFICAYVAGFAWSWGPLGWLVPSEIFPLEIRPAGQSINVSVNMFFTFCIAQAFLTMLCHFKFGLFYFFAGWVVIMTVFIAFFLPETKNVPIEEMVLVWKSHWFWKRFIADEDVHVGIGNNHPAKNGSDTKGADA

SEQ ID NO: 1455 - protein, 518 aa, Glycine max
MPAVGGINTGGGKEYPGSLTLFVTVTCIVAAMGGLIFGYDIGISGGVTSMDPFLLKFFPSVFRKKNSDKTVNQYCQYDSQTLTMFTSSLYLAALLSSLVAATVTRKFGRKLSMLFGGLLFLVGALINGFAQHVWMLIVGRILLGFGIGFANQSVPLYLSEMAPYKYRGALNIGFQLSITVGILVANVLNYFFAKIKGGWGWRLSLGGAMVPALIITVGSLVLPDTPNSMIERGDREKAKAQLQRIRGIDNVDEEFNDLVAASESSSQVEHPWRNLLQRKYRPHLTMAVLIPFFQQLTGINVIMFYAPVLFSSIGFKDDAALMSAVITGVVNVVATCVSIYGVDKWGRRALFLEGGVQMLICQAVVAAAIGAKFGTDGNPGDLPKWYAIVVVLFICIYVSAFAWSWGPLGWLVPSEIFPLEIRSAAQSINVSVNMLFTFLIAQVFLTMLCHMKFGLFLFFAFFVLIMTFFVYFFLPETKGIPIEEMGQVWQAHPFWSRFVEHDDYGNGVEMGKGAIKEV

SEQ ID NO: 1456 - protein, 510 aa, Zea mays
MPGGAFLLNGSGGGMADYGGGLTVPVVVTCLMAASGGLIFGYDIGISGGVSEMEDFLNKFFPGLLKRTARANKDVYCIYNNQALTAFTSSLYAFGMVGTLLASRVTRRLGRQAVMLIGGGLFLAGALVNAAAANIAMLIVGRMLLGLGLGFSGQATPVYLAEVSPPRWRGGFISAFPLFISVGYLVANLINYGTSRIPGWGWRLSLGLASVPAAVMVVGAAFIPDTPSSLVLRGKHDDARAALQRVRGKGVDIGPEFADILAAAENDRRNEEGAFRRILRREYRPYLVMAVAFPVFLNLTGVAVTAFFSPILFRTVGFESDAALMGAVILGLMNIGGILASGFAMDRYGRKLLFMIGGALMFTCQVAMASIIGSHLGNGSKMPKGYAVTVLVVALIFSASFSWSWGALYWTIPGEIYPVEVRSAGQGAAVALNLGLNFLQAQFFLAMLCCFKYGTFLFYASWLVVMTAFAVAFVPETKGVPLESMAHVFARHWYWGRFVKDHQKLGEEST

SEQ ID NO: 1457 - protein, 580 aa, Glycine max
MEGGGVEVDASAFRECLSLSWKNPYVLRLAFSAGIGGLLFGYDTGVISGAILYIRDDFKAVDRKTWLQEAIVSMALAGAIVGAAVGGWINDRFGRRKAILLADTLFFIGSAVMAAATNPSILIVGRVFVGLGVGMASMASPLYISEASPTRVRGALVSLNGFLITGGQFLSYLINLAFTKAPGTWRWMLGAAVVPALIQIVLMMMLPESPRWLFRKGREEEGKEILRKIYPPQEVEAEINTLRESVEIEIKEAEATDNISIVKMLKTKTVRRGLYAGMGLQIFQQFVGINTVMYYSPTIVQLAGFASNRTALLLSLVTSGLNAFGSILSIYFIDRTGRKKLVLFSLCGVVFSLVVLTVVFHQSTTHSPMVSALETSHFNNTCPDYHSAANPGGWDCMKCLKASPNCGFCASGANKLLPGACLISNDTTKDQCHEEDRLWYTVGCPSKFGWLAIVGLALYIIFFSPGMGTVPWVVNSEIYPLRYRGICGGMASTSNWVSNLIVAQSFLSLTQAIGTSWTFMIFIFITIAAIIFVIIFVPETKGLPMEEVEKMLEGRDLNFKFWQRSSHCGEEVPPQKTQSN

SEQ ID NO: 1458 - protein, 539 aa, Zea mays
MMRCAATGGGCVASWSGDRRLPAVNPCSVRMPTGNDGWCAGLRSRAADLAGLEMANLRGGVGGLFRASPRYGRLQATAAVDPEDIPLEKVQVKSSGHVLPYVGVACLGAILFGYHLGVVNGALEYLAKDLGIAENAVLQGWVVSTSLAGATLGSFTGGSLADKFGRTRTFILDAVPLALGAFLSATAQDIRTMIIGRLLAGIGIGVSSALVPLYISEISPTEIRGTLGTVNQLFICIGILAALLAGLPLAGNPAWWRTMFGIAVVPSILLAVGMAFSPESPRWLFQQGKVTQAELAVKRLYGKEMVTEIMFDLRASGQSSSESEAGWFDLFSKRYWKVVSVGAALFLFQQLAGINAVVYYSTSVFRSAGIASDVAASALVGAANVFGTMVASSLMDKQGRKSLLITSFSGMGASMLLLALSFTWKALAPYSGTLAVVGTVLYVLSFALGAGPVPALLLPEIFASRIRAKAVALSLGMHWVSNFFIGLYFLSVVSKFGISNVYLGFASVCALAVLYIAGNVVETKGRSLEEIERELSVAE

SEQ ID NO: 1459 - protein, 533 aa, Zea mays
MAGAGAAANGGRNKYAVLDRSEERQTDARTERRRRPLAPESERGRRERFVYACAVFASLNAVLLGYDVGVMSGAIIYMQKDLHITEFQQEILVGCLSVVSLLGSLSGGRTSDAIGRKWTMGLGAIVFQIGATIMTFAPSFTVLMIGRLLAGVGIGFGAMVSGVYIAEISPAGARGTLTSLPEICINFGILLGYVSNYAFSGLSEHINWRIMLGVGILPSVFIGFALFVIPESPRWLMMEKRVSEARAVLLQISESEAEAEERLAEIEEAAGLMKSMKSEDKEVWRELLNPSPAVRRMLYAGCGIQLFQQITGIDATVYYSPTIFKDAGIKSDQELLAATVAVGFTKTVFILVAIFLIDRVGRKPLLYVSTIGMTICLFLLGVALTLQNHAVGLMSPRVGIDLAIFAVCGNVAFFSIGMGPICWVLSSEVFPLRLRAQGSALGQVGGRVSSGLVSMSFLSMARAISVAGMFFVFAAISTISVLFVYFCVPETKGKTLEQIEMMFESGDEWGGGEIELEDTQHLIPSIKKSVPLG

SEQ ID NO: 1460 - protein, 481 aa, Glycine max
MAIEKHEDVESGYLHEPFIQPEDAAAACKENGSDKSVKNGSIGMVLLSTLVAVCGSFTFGTCVGYSAPTQAAIRADLNLSLAEFSMFGSLVTIGAMLGAITSGRITDFIGRKGAMRISTGFCITGWIAVFFSKGSYSLDFGRFFTGYGIGVISYVVPVYIAEIAPKNLRGGLATTNQLLIVTGGSVSFLLGSVINWRELALAGLVPCICLLVGLCFIPESPRWLAKVGREKEFQLALSRLRGKDADISDEAAEILDYIETLQSLPKTKLLDLFQSKYVHSVVIGVGLMACQQSVGINGIGFYTAEIFVAAGLSSGKAGTIAYACIQIPFTLLGAILMDKSGRRPLVMVSAAGTFLGCFVAAFAFFLKDQSLLPEWVPILAFAGVLIYIAAFSIGLGSVPWVIMSEIFPIHLKGTAGSLVVLVAWLGAWVVSYTFNFLMSWSSPGTLFLYAGCSLLTILFVAKLVPETKGKTLEEIQACISS

SEQ ID NO: 1461 - protein, 511 aa, Glycine max
MEAPSLTKPNDPTKPSNTSSTLSLEGGPGEASPLRKMFAVASIAAGIQFGWALQLSLLTPYVQLLGVPHAAASFIWLCGPISGLVVQPIVGYYSDHCTSRFGRRRPFILGGALAVAIAVFLIGYAADIGHSAGDDITKKTRPRAVGVFVIGFWILDVANNMLQGPCRAFLADLAAGDQQKTRIANGFFSFFMAVGNVLGYAAGSYSGLHKIFPFTETKACDVFCANLKSCFFFSILLLLFLATVALLYVKDKQVEAIPLDDATQPSCFFQLFGALKELKRPMWMLMLVTAVNWVGWFPYFLFDTDWMGREVYGGTAGEDAYAKGVRVGSLGLMVNAVVLGFMSLAVEPLGKMVGGVKRLWAIVNFILAIGFGMTVVITKVAEHQRRMNPAAVGHPSEGVVVGSMVFFGVLGVPLAITFSVPFALASIYCSASGAGQGLSLGVLNLAIVVPQMVVSALSGPWDSLFGGGNLPAFMVGAAAAALSAIMAIVLLPTPKPADEAKASSMMAGGFH

SEQ ID NO: 1462 - protein, 508 aa, Zea mays
MAGDGMEVSASGGGGGNKQPQISLLGLFLACMVAGGVQYGWALQLSLLTPYVQTLGIPHALTSVMWLCGPIAGLLVQPCVGLYSDKCTSKLGRRRPFIFTGCIIICISVIVIGFSSDIGYALGDTTEDCNVYTGKRLHAALFFVMGFWLLDFSNNTVQGPARALMADLAGSHGPSTANAIFVSWMAIGNILGYSSGSTDKWHTWFPFLQTRACCEACANLKAAFLVSVVFLGLSTVVTMIFAREVPLDPAAAAKQDEAGESSGPFAVFKGMKNMPPGMPQVLIVTGLTWLSWFPFILFDTDWMGREMYHGRPDGSPEEVARFQEGVRQGAFGLLLNSVVLGASSFLIEPMCRKLTAKVVWVMSSFLVCVAMALVTVLSSWSLGDIGGNVQDAAAVDKGLKTTALAIFVFLGFPFAVLCSVPFAVTAQLAAAKGGGQGLCTGVLNISIVVPQMVIAIGSGPWDELFGKGNIPAFGLAAVFAFTAAVAGIIMLPKQPKTSFRSVSMGGGH

SEQ ID NO: 1463 - protein, 521 aa, Zea mays
MPGAVIVHHHTRYKTYPGEVTGIAIFSCFIASVAGCIFGYDIGLTSGLTSTEPFLVKFFPSIYEEMKRQVVVNQYCKFDSQVLTLFSSSLFLAATVATFFAGPMTRAFGRKWTLFAAASAYVVGACIGGVSVNFPMLLTGRVLVGSGVGISIQAAPLYISEVAPAQQRGMLNILFQLMITVGILTANMTNYLASKVSGGWGWRIPVTFGAIPAAVIALGALAIPDTPASLVERGDTATARKTLSQIRGVGDVREEFDDLAAASEDAKAVQCPWRELFFGGKYKPQLTFALLIPFFQQLTGINVIMFYAPVLFKTVGFKQNATLVSSVITGLVNVFSTFVAIATADKIGRRALFLQGGTQMIISQILVGTFIGLQFGMSGTGDISEQYAMCIVLFVCVYVAGFAWSWGPMGWLVPSEIYPLAVRSAAMSVTVAVNMFFTAFIGQIFLTLLCHLRFGLFYFFGAWVLLMTLFIAMLLPETKSVPVEEMAHVWKKHWFWRKFVIDTGNDARNAEMRKRIALEMS

SEQ ID NO: 1464 - protein, 514 aa, Zea mays
MAGGVVVNAAGGKTYPGRMTPFVFFTCLVASSGGLIFGYDIGISGGVTSMASFLKEFFPSVYAKAAANKDTNQYCKFDSQLLTLFTSSLYLAALATSFVAASVTRVFGRKWSMFCGGVTFLAGSALNGAATDVMMLIMGRILLGVGVGFANQSVPLYLSEMAPAKLRGMLNIGFQLMTTIGILAANLINFWTAGIEGGWGWRIGLGLAGVPALIITLGALVLPDTPNSLIARGFNDDAKAVLVKIRGTDDVQDEYDDMVAASEEANAIEHPWRNILERRYRPQLTVAALIPFFQQLTGINVIMFYAPVLFLTIGFGDDASLMAAVITGLVNMFATVVSIVCVDRLGRRALFLQGGTQMFVSQIVVGTLIALQFGTAGVGEMSRSNAWLLVLFICLYVAGFAWSWGPLGWLVPSEVFALEVRSAGQSIAVCVNMLLTFIIGQAFLSMLCSLKFGLFYFFAGWMFIMTTFIALFLPETKGVPIEEMNLVWSRHWFWGKYVNVDTQHGGASPRSNGV

SEQ ID NO: 1465 - protein, 513 aa, Arabidopsis thaliana
MGAYETEKPTKDAAALETQSPEDFDQPSPLRKIISVASIAAGVQFGWALQLSLLTPYVQLLGIPHKWSSLIWLCGPVSGMIVQPIVGFHSDRCRSKFGRRRPFIATGAALVAVAVFLIGYAADFGYKMGDKLEEKVKVRAIGIFALGFWILDVANNTLQGPCRAFLADLAAGDAKRTRVANAFFSFFMAVGNVLGYAAGSYTNLHKMFPFTMTKACDIYCANLKTCFFLSITLLLIVTVTSLWYVNDKQWSPPPRNADDDEKTSSVPLFGEIFGAFKVMKRPMWMLLIVTALNWIAWFPFLLFDTDWMGREVFGGDSDGNERSKKLYSLGVQSGAMGLMFNSIVLGFMSLGVEWIGRKLGGAKRLWGIVNFILAAGLAMTVLVTKFAEDHRKTAGDLAGPSASVKAGALSLFAVLGIPLAITFSTPFALASIFSSCSGAGQGLSLGVLNLAIVIPQMIVSLGGGPFDALFGGGNLPAFIVAAIAAAISGVLALTVLPSPPPDAPKATTMGGFH

SEQ ID NO: 1466 - protein, 591 aa, Arabidopsis thaliana
MSDSVSISVPYKNLRKEIELETVTKNQDGSGSSSFSSSPLNHPESADGESVSKNCSLVTLVLSCTVAAGVQFGWALQLSLLTPYIQTLGISHAFSSFIWLCGPITGLVVQPFVGIWSDKCTSKYGRRRPFILVGSFMISIAVIIIGFSADIGYLLGDSKEHCSTFKGTRTRAAVVFIIGFWLLDLANNTVQGPARALLADLSGPDQRNTANAVFCLWMAIGNILGFSAGASGKWQEWFPFLTSRACCAACGNLKAAFLLAVVFLTICTLVTIYFAKEIPFTSNKPTRIQDSAPLLDDLQSKGLEHSKLNNGTANGIKYERVERDTDEQFGNSENEHQDETYVDGPGSVLVNLLTSLRHLPPAMHSVLIVMALTWLSWFPFFLFDTDWMGREVYHGDPTGDSLHMELYDQGVREGALGLLLNSVVLGISSFLIEPMCQRMGARVVWALSNFTVFACMAGTAVISLMSLSDDKNGIEYIMRGNETTRTAAVIVFALLGFPLAITYSVPFSVTAEVTADSGGGQGLAIGVLNLAIVIPQMIVSLGAGPWDQLFGGGNLPAFVLASVAAFAAGVIALQRLPTLSSSFKSTGFHIG

SEQ ID NO: 1467 - protein, 510 aa, Arabidopsis thaliana
MATSDQDRRHRATRNRPPIPRPSNSSSRPVVPPPRSKVSKRVLLRVASVACGIQFGWALQLSLLTPYVQELGIPHAWASVIWLCGPLSGLFVQPLVGHSSDRCTSKYGRRRPFIVAGAVAISISVMVIGHAADIGWAFGDREGKIKPRAIVAFVLGFWILDVANNMTQGPCRALLADLTENDNRRTRVANGYFSLFMAVGNVLGYATGSYNGWYKIFTFTKTVACNVECANLKSAFYIDVVFIAITTILSVSAAHEVPLASLTSEAHGQTSGTDEAFLSEIFGTFRYFPGNVWIILLVTALTWIGWFPFILFDTDWMGREIYGGEPNIGTSYSAGVSMGALGLMLNSVFLGITSVLMEKLCRKWGAGFVWGISNILMAICFLGMIITSFVASHLGYIGHEQPPASIVFAAVLIFTILGIPLAITYSVPYALISIRIESLGLGQGLSLGVLNLAIVIPQVIVSVGSGPWDQLFGGGNSPALAVGAATGFIGGIVAILALPRTRIQKPIPLP

SEQ ID NO: 1468 - protein, 537 aa, Oryza sativa
MARGSGAGGGGGGGGGGLELSVGVGGGGARGGGGGEAAAAVETAAPISLGRLILSGMVAGGVQYGWALQLSLLTPYVQTLGLSHALTSFMWLCGPIAGMVVQPCVGLYSDRCTSKWGRRRPYILTGCVLICLAVVVIGFSADIGYAMGDTKEDCSVYHGSRWHAAIVYVLGFWLLDFSNNTVQGPARALMADLSGRHGPGTANSIFCSWMAMGNILGYSSGSTNNWHKWFPFLKTRACCEACANLKGAFLVAVIFLSLCLVITLIFAKEVPFKGNAALPTKSNEPAEPEGTGPLAVLKGFRNLPTGMPSVLIVTGLTWLSWFPFILYDTDWMGREIYHGDPKGTDPQIEAFNQGVRAGAFGLLLNSIVLGFSSFLIEPMCRKVGPRVVWVTSNFLVCIAMAATALISFWSLKDFHGTVQKAITADKSIKAVCLVLFAFLGVPLAVLYSVPFAVTAQLAATRGGGQGLCTGVLNISIVIPQVVIALGAGPWDELFGKGNIPAFGLASGFALIGGVAGIFLLPKISKRQFWSVSMGGGH

SEQ ID NO: 1469 - protein, 506 aa, Oryza sativa
MAVDMELDGGGDGKGKAPPQISLSGLFLACMVAGGVQYGWALQLSLLTPYVQTLGIPHALTSVMWLCGPIAGLIVQPCVGLYSDKCTSSLGRRRPFILTGCIIICISVIVIGFSSDIGYALGDTTEDCKVYRGPRYHAAAAFILGFWLLDFSNNTVQGPARALMADLSGRHGPSAANAIFCSWMALGNILGYSSGSTNDWHKWFPFLMTRACCEACANLKAAFLVAVVFLGLSTAVTMVFAREVALDPVAAAKRNEGEASGLLAVFKGMKNLPVGMPSVLIVTGLTWLSWFPFILFDTDWMGREIYHGRPDGSPAEVTAFQEGVRQGAFGLLLNSIVLGISSFLIEPMCRRLGARAVWVMSSAVVCVAMAAVSVLSAWSLGDFGGSVQDAARAPAEEGGVRASALALFVFLGLPFAVLCSVPFAVTAQLAASRGGGQGLCTGVLNISIVVPQMAIALGAGPWDELFGEGNIPAFAMASVFAAAAAAAGVVLLPKVSVRSVSMAGGH

SEQ ID NO: 1470 - protein, 512 aa, Arabidopsis thaliana
MVSHPMEKAANGASALETQTGELDQPERLRKIISVSSIAAGVQFGWALQLSLLTPYVQLLGIPHKWASLIWLCGPVSGMLVQPIVGYHSDRCTSRFGRRRPFIVAGAGLVTVAVFLIGYAADIGHSMGDQLDKPPKTRAIAIFALGFWILDVANNTLQGPCRAFLADLSAGNAKKTRTANAFFSFFMAVGNVLGYAAGSYRNLYKVVPFTMTESCDLYCANLKTCFFLSITLLLIVTFVSLCYVKEKPWTPEPTADGKASNVPFFGGIFGAFKELKRPMWMLLIVTALNWIAWFPFLLFDTDWMGREVYGGNSDATATAASKKLYNDGVRAGALGLMLNAIVLGFMSLGVEWIGRKLGGAKRLWGIVNFILAICLAMTVVVTKQAENHRRDHGGAKTGPPGNVTAGALTLFAILGIPQAITFSIPFALASIFSTNSGAGQGLSLGVLNLAIVVPQMVISVGGGPFDELFGGGNIPAFVLGAIAAAVSGVLALTVLPSPPPDAPAFKATMGFH

SEQ ID NO: 1471 - protein, 593 aa, Saccharomyces cerevisiae
MTISNKSWRSYFPHLRKLPEDDQYLYSDDTNSSIIAEEELHHSVDKSSKTDVTAETTAVEPHPHNLRHDLPYEVRDEAGRKWWKYFDEFEYRVNKEYKKSRKWYEFLYPNHTTQTKAERRLLYKLDIIIALYFFMLCWSKSVDLNNYTNAYVSNMKEDLNMKGNDYVYTSTIANVGAIVFQLPFMYLLPRFPSHIILPVMDLGWTWFTFACYRANSLAELRAYRFILSAFGAAYYPVSQYILGCWYAPDEINSRVCLFFCGQQLGSVTSGLLQSRIFKSLNGVHGLAGWRWMFLIDAIAISLPTAIIGFFVIPGVPSKCYSLFLTDEEIRIARARNKRNQIKDGVDKSKLAPLWSRKLWKKVFCTPAFWVLVVFDTCSWNNMTAYSGSYTLWLKSNTKYSIAQVNNLSVIPACLGFAYVIFCAFGADLFRCKWIFMVFAAIMNTVSCALLIKWDIPSKAKWYAFFTTYFSVAASPCLWSFINDFLRFDPQVKAITWIAIYSFSQSTYAWIPTLAWPTVESPRFKTGYTVSLIFGAIYGLWTFVVLFFYKRNEKKHALGNGIILYDSNKGEELPEFVKKNMEERDGYYYLKRSS

SEQ ID NO: 1472 - protein, 509 aa, Arabidopsis thaliana
MGALEAERAANNATALETQSSPEDLSQPSPLRKIISVASIAAGVQFGWALQLSLLTPYIQLLGIPHKWSSYMWLCGPISGMIVQPIVGYHSDRCESRFGRRRPFIAAGVALVAVSVFLIGFAADMGHSFGDKLENKVRTRAIIIFLTGFWFLDVANNTLQGPCRAFLADLAAGDAKKTRVANACFSFFMAVGNVLGYAAGSYTNLHKMFPFTMTKACDIYCANLKTCFFLSITLLLIVTFSSLWYVKDKQWSPPQGDKEEKTSSLFFFGEIFGAVRHMKRPMVMLLIVTVINWIAWFPFILYDTDWMGREVYGGNSDGDERSKKLYDQGVQAGALGLMFNSILLGFVSLGVESIGRKMGGAKRLWGCVNFILAIGLAMTVLVTKSAEHHREIAGPLAGPSSGIKAGVFSLFTVLGIPLAITYSIPFALASIFSTNSGAGQGLSLGVLNIAICIPQMIVSFSSGPLDAQFGGGNLPSFVVGAIAAAISGVLALTVLPSPPPDAPAMSGAM

SEQ ID NO: 1473 - protein, 370 aa, Oryza sativa
MSSATDGAASRLGVAGALGMSVTSSVAIVICNKYLISTLGFFFATTLTSWHLMVTFCTLYVAQRLRFFEAKPIDAQTVISFGLLNGISIGLLNLCLGFNSVGFYQMTKLAIIPFTMLLETIFLSKKFSRSIKISLMVLLLGVGIASVTDLQLNLLGSIIAVLTIAATCVSQILTNQIQRRLKVSSTQLLYQSSPYQSAVLLVTGPFVDKLLTNRDVFAFTYTFQVVAFIVLSCSIAVCVNFSTFLVIGTTSPVTYQVLGHLKTCLILSFGYVLLRDPFTFRNVAGILVAIFGMGLYSFFSVSESRDKKLADGPSPPLPISSSQMAEMKDSEPLLGGGGGAAAKSSPWNEVKGLQSFDEVPRTAKSAFSRP

SEQ ID NO: 1474 - protein, 356 aa, Oryza sativa
MGVTGEKFQLGTVGALSLSVVSSVSIVICNKALMSSLGFNFATTLTSWHLLVTFCSLHVALCMKLFEHKPFDARTVMGFGVLNGISIGLLNLSLGFNSVGFYQMTKLAIIPCTVILETLFFRKKFSRNIQLSLSVLLFGVGVATVTDLQLNAVGSVLSLLAIITTCIAQIMTNTIQKKFKVSSTQLLYQSCPYQALTLFIVGPFLDGFLTNQNVFAFDYTSQVVFFIVLSCLISVSVNFSTFLVIGKTSPVTYQVLGHLKTCLVLAFGYVLLHDPFSWRNILGILIAVIGMVSYSYFCTKEAPPKPTEASPQLNQVKESESDPLISDSLSTAENGGNAGDDEALKVPMWSSKYSKA

SEQ ID NO: 1475 - protein, 340 aa, Zea mays
MTAGFQLGVIGSLTLSVASSVAIVICNKALISTLGFPFATTLTSWHLMVTFCTLHVAQRLRFFEPKAIDGQTVVLFGLLNGTSIGLLNLSLGFNSIGFYQMTKLAIIPFTVLLETIFLKKRFSETIKFSLLVLLLGVGIASVTDLKLNCLGSVLSGLAIATTCVGQILTNTIQRKLKVSSTQLLYQSAPYQAAILFATGPFVDHLLTGRSVFAHRYTFPVVGFIVLSCLIAVSVNFSTFLVIGTTSPVTYQVLGHLKTCLVLSFGYTLLHDPFTVRNILGILVAIFGMALYSIFSVREGKKKSAGDALPVSQMPDKETEPLLATKDNSDTKKANGVAHDC

SEQ ID NO: 1476 - protein, 577 aa, Oryza sativa
MSATTSNSRRLCNGRGQVIPGPTLPEAVKMGPHAIRIVVGGLGEGELSTATTVHGPERASSSSAPPEMASAALPEAVAPKKKGNVRFAFACAILASMTSILLGYDIGVMSGASLYIKKDFNISDGKVEVLMGILNLYSLIGSFAAGRTSDWIGRRYTIVFAAVIFFAGAFLMGFAVNYAMLMFGRFVAGIGVGYALMIAPVYTAEVSPASARGFLTSFPEVFINFGILLGYVSNYAFSRLPLNLGWRIMLGIGAAPSVLLALMVLGMPESPRWLVMKGRLADAKVVLEKTSDTAEEAAERLADIKAAAGIPEELDGDVVTVPKRGSGNEKRVWKELILSPTPAMRRILLSGIGIHFFQQASGIDSVVLYSPRVFKSAGITDDKHLLGTTCAVGVTKTLFILVATFFLDRVGRRPLLLSSTGGMILSLIGLGAGLTVVGQHPDAKIPWAIGLSIASTLAYVAFFSIGLGPITWVYSSEIFPLQVRALGCSLGVAANRVTSGVISMTFLSLSKAITIGGSFFLYSGIAALAWVFFYTYLPETRGRTLEEMSKLFGDTAAASESDEPAKEKKKVEMAATN

SEQ ID NO: 1477 - protein, 392 aa, Oryza sativa
METVAAASYTRGAATRSPACCAAMSFSQSYRPKAARPPSTFYGESLRVNTARSLPSGRQSKAASRAALSTRCEIGDSLEEFLTKATPDKNLIRLLICMGEAMRTISFKVRTASCGGTACVNSFGDEQLAVDMLADKLLFEALEYSHVCKYACSEEVPELQDMGGPVDGGFSVAFDPLDGSSIVDTNFTVGTIFGVWPGDKLTGVTGGDQVAAAMGIYGPRTTYIIALKDCPGTHEFLLLDEGKWQHVKDTTTIGEGKMFSPGNLRATFDNPEYDKLINYYVKEKYTLRYTGGMVPDVNQIIVKEKGIFTNVTSPTAKAKLRLLFEVAPLGFLIEKAGGYSSDGKQSVLDKVINNLDERTQVAYGSKNEIIRFEETLYGSSRLTAGATVGAAA

SEQ ID NO: 1478 - protein, 339 aa, Oryza sativa
MDHEADAYRTDLMTITRYVLNEQSRNPEARGDLTILLSHIVLGCKFVASAVNKAGLAKLIGLAGETNVQGEEQKKLDVLSNEVFVKALVSSGRTCVLVSEEDEEATFVDPALRGKYCVCFDPLDGSSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQAK

SEQ ID NO: 1479 - protein, 393 aa, Triticum sp.
METVAAAGYARGAATRSPACCAAMSFSQSYRPKAARPATSFYGESLRANTARTSFPAGRQSKAASRAALTTRCAIGDSLEEFLTKATPDKNLIRLLICMGEAMRTIAFKVRTASCGGTACVNSFGDEQLAVDMLADKLLFEALEYSHVCKYACSEEVPELQDMGGPVEGGFSVAFDPLDGSSIVDTNFTVGTIFGVWPGDKLTGVTGGDQVAAAMGIYGPRTTFVVALKDCPGTHEFLLLDEGKWQHVKDTTSIGEGKMFSLGNLRATFDNPDYDKLVNYYVKEKYTLRYTGGMVPDVNQIIVKEKGIFTNVTSPTAKAKLRLLFEVAPLGFLIEKAGGHSSDGKQSVLDKVISVLDERTQVAYGSKNEIIRFEETLYGSSRLAASATVGATA

SEQ ID NO: 1480 - protein, 440 aa, Ralstonia eutropha
MAQVSRICNGVQNPSLISNLSKSSQRKSPLSVSLKTQQHPRAYPISSSWGLKKSGMTLIGSELRPLKVMSSVSTACMPEVQRMTLTQFLIEERRRYPDASGGFNGLILNVAMACKEIARAVAFGALGGLHGKASNQAGEAGAVNVQGEIQQKLDVLSNTTFLRVNEWGGYLAGMASEEMEAPYQIPDHYPRGKYLLVFDPLDGSSNIDVNVSVGSIFSVLRAPEGASAVTEQDFLQPGSAQVAAGYALYGPTTMLVLTVGNGVNGFTLDPNLGEFFLTHPNLQVPADTQEFAINASNSRFWEAPVQRYIAECMAGKSGPRGKDFNMRWIASMVAEAHRILMRGGVFMYPRDSKDPAKPGRLRLLYEANPIAFLMEQAGGRASTGRQTLMSVAPGALHQRIGVIFGSRNEVERIEGYHTDQTDPDLPSPLFNERSLFRASA

SEQ ID NO: 1481 - protein, 383 aa, Chlorella sorokiniana
MQATAVATAAPAARVATTGKAATGVKAAPRVAVRAAGASASSSFATGARLSAKASRTAARRAAVAAQAKIGDTLEEFLLEATPDPKLRQLMMSMSEAIRTIAYKVRTASSGGTASVNSFGDEQLAVDLLADKLLFEALKYSGCCKLACSEEVPEPLDLGGEGFSVAFDPLDGSSIVDTNFSVGTIFGVWPGDKLTGITGRQQAAAGMGIYGPRTVFCIALKDAPGCHEFLLQDDGKWLHVKETETIGEGKMFSPGNLRATFDNPAYEKLIAYYIGEKYTLRYTGGMVPDVFQIIVKEKGVFTNVISPSTKAKLRLLFEVAPLALLVEKAGGASSCDGLCVSGLDVEVKQHDQRTQICYGSKGEVRRFEEYMYGNSPRFSEVTA

SEQ ID NO: 1482 - protein, 334 aa, Nitrosomonas europaea
MHTGTTLTQFIIEEQRHIAGASGDFTALLNDIVTAIKTISNAVNKGALIGVMGALDTENVQGETQKKLDVITNEIMIRNNEWAGHLSGMASEEMDDVYSIPSPYPLGKYLLVFDPLDGSSNVDLNISVGTIFSILRSPVPSRAASMEDFLQPGVKQVCAGYALYGSSTMLVLTTGHGVNGFTLDRDIGEFVLTHPNMRIPADTREFAINASNQRFWEAPVQRYVAECLAGSTGPRGRDFNMRWVASMVAEVHRILTRGGIFMYPRDTKDPSKPGRLRLMYEANPMSFIVEQAGGLSTTGYERILDVVPQDLHQRVPVILGSKNEVEVVLEYHNA

SEQ ID NO: 1483 - protein, 345 aa, Nostoc PCC7120
MENTLGLEIIEVVEQAAIASAKWMGKGEKNTADQVAVEAMRERMNKIYMRGRIVIGEGERDDAPMLYIGEEVGICTQPNADQLCNPDELVEIDIAVDPCEGTNLVAYGQPGSMAVLAISEKGGLFAAPDFYMKKLAAPPAAKGKVDINKSATENLKILSECLDRSIDELVVVVMKRDRHQGLIKEIRDAGARVQLISDGDVGAAISCGFAGTNVHALMGIGAAPEGVISAAAMRALGGHFQGQLIYDPEVVKTGLIGESKQANLDRLSSMGINDPDKVYDAHELASGENVLFAGCGITSGNLMQGVRFFHGGARTQSLVISSQSQTARFVDTIHMAGQPKTVQLH

SEQ ID NO: 1484 - protein, 345 aa, Nostoc punctiforme PCC 73102
MENTLGLEIIEVVEQAAIASAKWMGKGEKNIADQVAVEAMRERMNKIYMRGRIVIGEGERDDAPMLYIGEEVGICTQPNAEALCNPDELIEIDIAVDPCEGTNLVAYGQPGSMAVLAISEKGGLFAAPDFYMKKLAAPPAAKGKVDINKSATENLKILSECLERSIEELVIVVMKRERHNDLIKEIREAGARVALISDGDVGAAISCGFAGTNIHALMGIGAAPEGVISAAAMRALGGHFQGQLIYDPAIVKTGLIGESREANIDRLKSMNINDPDKVYDAHELASGETVLFAASGITSGNLMNGVRFFNGGARTQSLVISNQSKTARFVDTIHMFGEPKTLQLN

SEQ ID NO: 1485 - protein, 399 aa, Saccharomyces cerevisiae [sequence omitted]

SEQ ID NO: 1486 - protein, 521 aa, Glycine max
MLLELALGLLVLALFLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVVEGEVSGVFLDTLLEFAEDETMEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEAGPLDLRGQHFQLLPFGSGRRMCPGVNLATSGMATLLASLIQCFDLQVLGPQGQILKGGDAKVSMEERAGLTVPRAHSLVCVPLARIGVASKLLS

SEQ ID NO: 1487 - protein, 336 aa, Glycine max
MENSTEESHLRSENSVTYESPYPIYGMSFSPSHPHRLALGSFIEEYNNRVDILSFHPDTLSVTPHPSLSFDHPYPPTKLMFHPRKPSPSSSSDLLATSGDYLRLWEIRDNSVDAVSLFNNSKTSEFCAPLTSFDWNDIDPNRIATSSIDTTCTIWDIERTLVETQLIAHDKEVYDIAWGEARVFASVSADGSVRIFDLRDKEHSTIIYESPHPDTPLLRLAWNKQDLRYMATILMDSNKVVILDIRSPTTPVAELERHRGSVNAIAWAPHSSTHICSAGDDTQALIWELPTLASPTGIDPVCMYSAGCEINQLQWSAAQPDWIAIAFANKMQLLKV

SEQ ID NO: 1488 - protein, 346 aa, Gossypium hirsutum
MAASSDPNPEGSDEQQKRSEIYTYEAPWHIYAMNWSVRRDKKYRLAIASLLEHYNNRLEIVQLDDSNGEIRSDPNLSFDHPYPPTKTIFIPDKECQKPDLLATSSDFLRIWRISDDHSRVDLKSLLNGNKNSEFCGPLTSFDWNEAEPKRIGTSSIDTTCTIWDIERETVDTQLIAHDKEVYDIAWGGVGVFASVSADGSVRVFDLRDKEHSTIIYESSEPDTPLVRLGWNKQDPRYMATIIMDSAKVVVLDIRFPTLPVVELQRHQASVNAIAWAPHSSCHICTAGDDSQALIWDLSSMSQPVEGGLDPILAYTAGAEIEQLQWSSSQPDWVAIAFSTKLQILRV

SEQ ID NO: 1489 - protein, 396 aa, Escherichia coli [sequence omitted]

SEQ ID NO: 1490 - protein, 386 aa, Saccharomyces cerevisiae
MSAATVGKPIKCIAAVAYDAKKPLSVEEITVDAPKAHEVRIKIEYTAVCHTDAYTLSGSDPEGLFPCVLGHEGAGIVESVGDDVITVKPGDHVIALYTAECGKCKFCTSGKTNLCGAVRATQGKGVMPDGTTRFHNAKGEDIYHFMGCSTFSEYTVVADVSVVAIDPKAPLDAACLLGCGVTTGFGAALKTANVQKGDTVAVFGCGTVGLSVIQGAKLRGASKIIAIDINNKKKQYCSQFGATDFVNPKEDLAKDQTIVEKLIEMTDGGLDFTFDCTGNTKIMRDALEACHKGWGQSIIIGVAAAGEEISTRPFQLVTGRVWKGSAFGGIKGRSEMGGLIKDYQKGALKVEEFITHRRPFKEINQAFEDLHNGDCLRTVLKSDEIK

SEQ ID NO: 1491 - protein, 369 aa, Escherichia coli
MKSRAAVAFAPGKPLEIVEIDVAPPKKGEVLIKVTHTGVCHTDAFTLSGDDPEGVFPVVLGHEGAGVVVEVGEGVTSVKPGDHVIPLYTAECGECEFCRSGKTNLCVAVRETQGKGLMPDGTTRFSYNGQPLYHYMGCSTFSEYTVVAEVSLAKINPEANHEHVCLLGCGVTTGIGAVHNTAKVQPGDSVAVFGLGAIGLAVVQGARQAKAGRIIAIDTNPKKFDLARRFGATDCINPNDYDKPIKDVLLDINKWGIDHTFECIGNVNVMRAALESAHRGWGQSVIIGVAVAGQEISTRPFQLVTGRVWKGSAFGGVKGRSQLPGMVEDAMKGDIDLEPFVTHTMSLDEINDAFDLMHEGKSIRTVIRY

SEQ ID NO: 1492 - protein, 369 aa, Nostoc PCC7120
MEVKAAIAYGAGKPLTIETVQLEGPKAGEVLVEVKASGVCHTDAYTLSGNDPEGLFPAILGHEGAGVVVDVGAGVTSVKPGDHVIPLYTPECRQCAYCLSFKTNLCQAIRGTQGRGVMPDGTSRFSINGQMIHHYMGTSTFANYTVLPEIAVAKIREDAPFDKVCYIGCGVTTGIGAVIYTAKVEAGANVVVFGLGGIGLNVIQGARMVGANMIVGVDINPSKRALAEKFGMTHFVNPQEVEGDLVAYLVDLTKGGADYSFECIGNVNVMRQALECCHKGWGVSVIIGVAGAGQEISTRPFQLVTGRVWKGSAFGGARGRTDVPKIVDWYMDGKINIDDLITHVMPIEKINDAMDLMHRGESIRSVVTF

SEQ ID NO: 1493 - protein, 381 aa, Oryza sativa
MASSTQGQVITCKAAVAWEANKPMTIEDVQVAPPQAGEVRVKILFTAFCHTDHYTWSGKDPEGLFPCILGHEAAGIVESVGEGVTEVQPGDHVIPCYQAECRECKFCKSGKTNLCGKVRAATGVGVMMNDRKSRFSINGKPIYHFMGTSTFSQYTVVHDVSVAKINPQAPLDKVCLLGCGVSTGLGAVWNTAKVEAGSIVAIFGLGTVGLAVAEGAKSAGASRIIGIDIDSKKFDVAKNFGVTEFVNPKDHDKPIQQVIVDLTDGGVDYSFECIGNVSVMRSALECCHKGWGTSVIVGVAASGQEISTRPFQLVTGRVWKGTAFGGFKSRSQVPWLVEKYLNKEIKVDEYVTHSMNLTDINKAFDLLHEGGCLRCVLATDK

SEQ ID NO: 1494 - protein, 381 aa, Zea mays
MASPTQGQVITCKAAVAYEPNKPLVIEDVQVAPPQAGEVRVKILFTALCHTDHYTWSGKDPEGLFPCILGHEAAGIVESVGEGVTDVQPGDHVIPCYQAECKECKFCKSGKTNLCGKVRSATGVGVMMNDMKSRFSVNGKPIYHFMGTSTFSQYTVVHDVSVAKINPQAPLDKVCLLGCGVPTGLGAVWNTAKVESGSVVAVFGLGTVGLAVAEGAKAAGASRVIGIDIDNKKFDVAKNFGVTEFVNPKEHDKPIQQVLVDLTDGGVDYSFECIGNVSIMRAALECSDKGWGTSVIVGVAASGQEISTRPFQLVTGRVWKGTAFGGFKSRTQVPWLVDKYMKKEIKVDEYITHNMNLADINDAFHLLHEGGCLRCVLAMQI

SEQ ID NO: 1495 - protein, 386 aa, Zea mays
MSDTAGKTITCKAAVAWEAGKDLVVEDIEVLPPRAHEVRIQVYYTGVCHTDAYMLSGKDPEGAFPVIAGHEGAGIVESVGEGVTNVKVGDTVVALYTPECKECKFCKSGKTNLCGKIRATQGKGVMPDGTSRFKCKGKDLLHFMGCSTFSQYTVLADISVVAVTPDAPMDRTCLLGCGITTGYGAAVITAGRGGVEKGSNVAIFGAGCVGLSVIQGAVKQGASKIIVVDVNDAKKEWAKKFGATDFVNPAKDLKEGENIQSRLIDMTDGGCDYTFDCTGNVHVMRSALEACHKGWGESIIIGVAAAGQEISTRPFQLVTGRVWKGCAFGGVKGRSQMGQLVQDYMDNKLKVDEFITHRQPLGGINEAFHDMHAGDCIRCVVDMRKV

SEQ ID NO: 1496 - protein, 379 aa, Zea mays
MATAGKVIKCRAAVAWEAGKPLSIEEVEVAPPQAMEVRIKILYTALCHTDVYFWEAKGQTPVFPRILGHEAGGIVESVGEGVTELAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNVNAMISAFECVHDGWGVAVLVGVPHKDDQFKTHPMNFLSEKTLKGTFFGNYKPRTDLPNVVEMYMKKELELEKFITHSVPFSEINTAFDLMLKGESLRCIMRMED

SEQ ID NO: 1497 - protein, 379 aa, Glycine max
MSTAGQVIKCRAAVAWEAGKPLSIETIEVAPPQKGEVRLRILFNSLCRSDVYWWDAKDQTPLFPRILGHEASGIVESVGEGVTHLKPGDHALPIFTGECGECTYCKSEESNLCELLRINTDRGVMLSDGKTRFSKNGQPIYHFVGTSTFSEYTVLHEGCVAKINPNAPLDKVAIVSCGFCTGFGATVNVAKPKPNNTVAVFGLGAVGLAACEGARVSGASRIIGVDLLPNRFEQAKKFGVTDFVNPKDHNKPVQEVIAEMTNGGVDRAIECTGSIQASISAFECTHDGWGTAVLVGVPKKDVEFKTNPMKFMEGRTLKGTFYGHYRPRTDIPGVVEKYLNKELELDKFITHSVPFSKINTAFDLMLKGEGIRCLICMEE

SEQ ID NO: 1498 - protein, 394 aa, Sorghum bicolor
MGGAGGGGEAKRSEIYTYEAAWHIYAMNWSVRRDKKYRLAIASLLEQVTNRVEVVQLDEASGDIAPVLTFDHQYPPTKTMFMPDPHALRPDLLATSADHLRIWRIPSPDDADDGAASANNNNGSVRCNGTPQPGIELRCELNGNRNSDYCGPLTSFDWNDADPRRIGTSSIDTTCTIWDVEREAVDTQLIAHDKEVYDIAWGGAGVFASVSADGSVRVFDLRDKEHSTIIYESGSGGGGGGSNSGAGDGGTASPTPLVRLGWNKQDPRYMATIIMDSPKVVVLDIRYPTLPVVELHRHHAPVNAIAWAPHSSCHICTAGDDMQALIWDLSSMGTGSNGSGNGNGNAAAAAAAEGGLDPILAYTAGAEIEQLQWSATQPDWVAIAFANKLQILRV

SEQ ID NO: 1499 - protein, 416 aa, Zea mays
MGGVGEGDAWADQEQGNGGGSRGVGGGGGEAKRSEIYTYEAAWHIYAMNWSVRRDKKYRLAIASLLEQVTNRVEVVQLDEASGDIAPVLTFDHQYPPTKTMFMPDPHALRPDLLATSADHLRIWRIPSSDDAEDGAASANNNNGSVRCNGTQQPGIELRSELNGNRNSDYCGPLTSFDWNDADPRRIGTSSIDTTCTIWDVEREAVDTQLIAHDKEVYDIAWGGAGVFASVSADGSVRVFDLRDKEHSTIIYESGSGGSSGGGSNSGAGDGGTASPTPLVRLGWNKQDPRYMATIIMDSPKVVVLDIRYPTLPVVELHRHHAPVNAIAWAPHSSCHICTAGDDMQALIWDLSSMGTGSNGSGNGNGNTAAGAAAEGGLDPILAYTAGAEIEQLQWSATQPDWVAIAFANKLQILRV

SEQ ID NO: 1500 - protein, 256 aa, Agrobacterium tumefaciens
MLQSGTLKCKVHNIKMNQGNGADYEIPVPFFLITHPAGHTVIDGGNAIEVATDPRGHWGGICDVYWPVLDKDQGCVDQIKALGFDPADVKYVVQSHLHLDHTGAIGRFPNATHIVQRSEYEYAFTPDWFAGGGYIRKDFDKPGLKWQFLNGAQDDYYDVYGDGTLTTIFTPGHAPGHQSFLVRLPNSKPLLLTIDAAYTLDHWEEKALPGFLASTVDTVRSVQKLRTYAEKHDATVVTGHDPDAWANFKKAPEFYA

SEQ ID NO: 1501 - protein, 279 aa, Xylella fastidiosa
MITVTPFQTGTVRIKTAQQAGQDSKSGIGRKLDIFRDPNWTEVLPIFCFLIEHPEGRFLVDTGDTWRNSIPGYLPRWNPFLTKQVIVKVALHEEIGPQLLAKNIDPSRDVEAVILTHMHHDHAGGLDHFPHTRIIVTKENYDASRGFFGRVAGCLPQHWPIWLKPELIEPTGPAVGPFASSYPITRDGRIVLVPTPGHVKGHVSVLVRNDDLSIFIAGDATYAEDILRSGKVDGVTFDPVLSKDTLRRITEYATSTPTVIMPSHDPDGPARLVVRQTFI

SEQ ID NO: 1502 - protein, 308 aa, Xanthomonas campestris
MSDDAVAMLARQARSVPMRVHHLNCISTCPLGGHLMDGRTHGVLERGHLSCHCLLVETNAGLVLIDTGFGLRDVAEPRARLSAFFLALVKPDLREDMTAIRQIQRLGFDPRDVRHIVLTHLDFDHAGGLDDFPHARVHLMTRERDAALAQHTWMDRQRFRPQQWSTRGQWRTYDSTSGAAWMGLECVHDLHGLPPEILLVPLPGHTFGHAAVAVRTPERWLLLAGDAYFYHREMDPQPYCTPGLRFYQWMLEKDRTARLHNQQRLRALRQQHGAEVEVFCSHDVVEFERVAGLPARLPAGALQHAPTA

SEQ ID NO: 1503 - protein, 487 aa, Arabidopsis thaliana
MQPWRRKFPLFETGVTMKQRKNSNLSIFVVVFSVFLFGIFMYNEDVKSIAEFPFSTSKPHDVHDEATPITEITTLPVQESIKNSDPIQESIKNADSVQDSVKDVAEPVQEEVSKTEEVKKIELFAATEDEEDVELPPEECDLFTGEWVFDNETHPLYKEDQCEFLTAQVTCMRNGRRDSLYQNWRWQPRDCSLPKFKAKLLLEKLRNKRMMFVGDSLNRNQWESMVCLVQSVVPPGRKSLNKTGSLSVFRVEDYNATVEFYWAPFLVESNSDDPNMHSILNRIIMPESIEKHGVNWKGVDFLVFNTYIWWMNTFAMKVLRGSFDKGDTEYEEIERPVAYRRVMRTWGDWVERNIDPLRTTVFFASMSPLHIKSLDWENPDGIKCALETTPILNMSMPFSVGTDYRLFSVAENVTHSLNVPVYFLNITKLSEYRKDAHTSVHTIRQGKMLTPEQQADPNTYADCIHWCLPGLPDTWNEFLYTRIISRS

SEQ ID NO: 1504 - protein, 531 aa, Arabidopsis thaliana
MDKFSYNSYPDSAESSPRSRDVEFENPSPWEDQQQQNYKVKLMCSYGGKIQPRPHDNQLTYVNGDTKIMSVDRGIRFPALVSKLSAVCSGGGDGGEISFKYQLPGEDLDALISVTNDEDLEHMMHEYDRLLRLSTKPARMRLFLFPSSPISGGFGSEGSTKSDRDTLNPIPSRPESEKSVTAPPNNADFLFGSEKVAPIPPSPVKVPQPVPEPVVLEPPQMFVDQRMLQPEHGVNPAEIQRQIQEFQMIQIRDQEQQMLHQNQLHQQQQQQEAIHQNQLHHQQEVIHQNQLLQQEAIHQNQMLQQQQQQEAMYRRKTEDEAGRYFPPTYTQNPAPVTNQQPPVGYWQGNTNNSNIQGNIYTTTSQNLPEQQQQQQQVYMIPAQSQAPGTLYQSVMRPTVQGNQGYYPSPVQRLHHPDAYMEQQNQPGYNVVQPQPTFSGGPQVMTSVGPQVMTSVGPPMGLQEPYSQMGKPVYYTVAGEGMMVQPPPAQPQQQQQQYQGMGQPVSGMTDLRTGPDGKVAVNMAAPQVSDSV

SEQ ID NO: 1505 - protein, 421 aa, Glycine max
MTSHSHYPPDLDADSVTSSPRSDHFHDAPPRIRFMCSFGGKILPRPHDNQLRYVGGDTRIVAVNRSITFSALILKLSKLSGMSNITAKYQLPNEDLDALISVTTDEDVENMMDEYDRVAHNQNPRSARLRLFLFPEGEDSRASSISSLLNGSAKRENWFLDALNGGVSGLERGRSEASSMVSEVPDYLFGLDNSEEITNHQRDPRPKPGPIIQDNVSVSDPGSPAPVVSSPYCSTSSAPPVPSLPNLPYVKTKPLNLNPVPDTDSKENQTEPETEPHPNLNLNQNPNMYSNNPVVHYPPEAAYSAHSVNPVPVYYVSGPVRPGSVPVPMQTPYHYVQQSYHAVVPPQVPIGYHPLVPGSGQVYGAGVRHMTPLQPYSPSTTAVVHDGLKQHVYHAVPNSGPVPVHPVIPMTGLDEPQRGGA

SEQ ID NO: 1506 - protein, 476 aa, Glycine max
MENYQYPASYPDSGESSPRSREIDFENPPPWDEQQNQNYKAKFMCSYGGKIQPRTHDNQLSYVGGDTKILAVDRSVKFSAFLSKLSALCDSPPQDLTFKYQLPGEDLDALISVTNDDDLEHMMHEYDRLYRPNLKPVRMRLFLFTLSNSNPNSSFSSERDRFVEALNSGPVPSQPDPIKTPPVTPSNVDYLFGLDKAVAPPNLPPNFAAVKFHDPVPEPVAPTPVEYQSRVSDRVVGSDPNVNSMEIQRQMQQEMQRLQIAENEYRRRSEDGFATGYAAAAGGDYYMQKVQEKVPPQNAAVPPPAAYWSEKQFSGEGYQTTVTTAAPGGGDQPMYVMAAPGTFYHHSPVMRPPAAAQGYYAVQRMGSDGYREQQAVYGGMAAPKAGFSTAGMVKGPAYSEGYSGGVVRPAGLPDNAAYAQVAYDSASGRQVYYTAQGGVVHAPPQYQGGPPQDVRPGGVSVGQDGKVVNKVNQGSV

SEQ ID NO: 1507 - protein, 641 aa, Glycine max
MDPPPLSAATQKNHPESVESFSPCFRVAETWTDETLPAVPGAKLRLMCSYGGHIMPRPHDKSLSYIGGDTRIVVVDRHSSLKDLCSRLSRTILNGRPFTLKYQLPNEDLESLITVTTDEDLDNMVEEYDRIMAKGSASSRLRVFLFFTKPEATVSMGSLLDDAKSETWFVDALNNSGMISRVVSDSAAGDSFVNLDGVGVGGVSASGSSNNLESLPDANKVKNFPEVVQVQSTPGSPMMENSSSSPSFSPSLVNLPPIRVHVDDNGSRLQQENKVGLVVEEQFAQMTIASGVKPDDGLVNVVSSAVAVPVIPASVTMASAGVITTSDNVMNRVVCEDDRSDPGFQKPPLPLQLVQPRTSGGVGLPSPDSVASDSSIAAANSFSKTVYYQDQVQAALLDNKIVAMPNAKSEISDQMIQVQGQLQDSGYTLPPQLDPNKQHFQQQKPFVHASTHYIHHPAATGPVPVSSYYPVYAPPQPQQLHPPIGQQQYPVYVMPVGPTQVTQPYNMALQPNIADPNVVASSRSLMPQSIVTSAAYKDGTPPIYPTKSVSSTMASNSGYAPIPTNQFQPQYVGLHQFHHPPQSIAVAPSSTTTNNNYGYEYGGHVQDQAYYTQQTTTAPLLPQYQSMTPAAAAAALSDASK

SEQ ID NO: 1508 - protein, 540 aa, Oryza sativa
MTTVASLSLLPHLLIKPSFRCCSRKGVGRYGGIKVYAVLGDDGADYAKNNAWEALFHVDDPGPRVPIAKGKFLDVNQALEVVRFDIQYCDWRARQDLLTIMVLHNKVVEVLNPLAREFKSIGTLRKELAELQEELAKAHNQVHLSETRVSSALDKLAQMETLVNDRLLQDGGSSASTAECTSLAPSTSSASRVVNKKPPRRSLNVSGPVQPYNPSLKNFWYPVAFSSDLKDDTMVPIDCFEEQWVIFRGKDGRPGCVMNTCAHRACPLHLGSVNEGRIQCPYHGWEYSTDGKCEKMPSTKMLNVRIRSLPCFEQEGMVWIWPGNDPPKSTIPSLLPPSGFTIHAEIVMELPVEHGLLLDNLLDLAHAPFTHTSTFAKGWSVPSLVKFLTPSSGLQGYWDPYPIDMEFRPPCMVLSTIGISKPGKLEGKSTKQCSTHLHQLHICLPSSRNKTRLLYRMSLDFAPWIKHVPFMHILWSHFAEKVLNEDLRVVLGQQDGCQWRKCLELASIICKLGIRYRLWRDAIERGVDRLPFSNQSESGS

SEQ ID NO: 1509 - protein, 539 aa, Saccharomyces cerevisiae
MPLNEKYERPPQPPPAYDPNHRPPSSSENSAAANVNDGQTPYHFRQDQYYNLNSKTSGAPIGSFDEAFPTENDNKPRWNDWPFTIFFLCTVGGFIAIAAITLRAWSQTYSSTGSGIYDGVNTGTLNTNAAILLVFVCIIALVFSVLGLTLCRIFPKQFIYCGMVINLVASLGTAIMYMSLRYWSAGIVFLVFTFMTAWCYWGMRSRIPLSVAVLKVVVDAMKKCPQIFFVSFVGALVASAFGFLFSAVIVATYIKYDPNSSNGGCDVSGGSCSHSKLIGVLVVVFFCGYYISEVIRNVIHCVISGVFGSWYYMSKSDQGMPRWPAFGALKRAMTYSFGSICFGSLLVALIDLLRQILQMIRHDVTSSGGGQIAIQILFMVFDWIIGFLKWLAEYFNHYAYSFIALYGKPYLRAAKETWYMLREKGMDALINDNLINIALGLFSMFASYMTALFTFLYLRFTSPQYNSNGAYNGALMAFSFVIALQICNIATEAIRSGTATFFVALGNDPEVFHHSYPHRFDEIFRAYPDVLRKLSHQNV

SEQ ID NO: 1510 - protein, 563 aa, Saccharomyces cerevisiae
MSIRNDNASGGYMQPDQSSNASMHKRDLRVEEEIKPLDDMDSKGAVAADGEVHLRKSFSLWSILGVGFGLTNSWFGISTSMVAGISSGGPMMIVYGIIIVALISICIGTSLGELSSAYPHAGGQFWWSLKLAPPKYKRFAAYMCGSFAYAGSVFTSASTTLSVATEVVGMYALTHPEFIPKRWHIFVCFELLHLFLMFFNCYGKSLPIISSSSLYISLLSFFTITITVLACSHGKFNDAKFVFATFNNETGWKNGGIAFIVGLINPAWSFSCLDCATHMAFEVEKPERVIPIAIMGTVAIGFVTSFCYVIAMFFSIQDLDAVLSSTTGAPILDIYNQALGNKSGAIFLGCLILFTSFGCVIACHTWQARLCWSFARDNGLPLSRLWSQVNPHTGVPLNAHLMSCAWITLIGLLYLASSTAFQSLITGCIAFLLLSYIIPVICLLAKKRNIAHGPFWLGKFGFFSNIVLLGWTVFSVVFFSFPPVLPVTKDNMNYVCVVIVGYTAYSILYWKYKGKKEFHALEESENEQAEYSNNFDTIEDSREFSVAASDVELENEHVPWGKK

SEQ ID NO: 1511 - protein, 80 aa, Zea mays
MARIGASHLLLVVLLLSAVLSSGSARVPRERPDAMLPAGQTAAMAEMTVPGEGQSSGPAFGVAAHESKRLSPGGPDPQHH

SEQ ID NO: 1512 - protein, 78 aa, Zea mays
MKLVLCFCICVVLVIASSPVTLSDSRPAMGRRWLRDEVVIARGPEGNTTSAWSEEAPGMIPYDGSKRLSPGGPNPQHH

SEQ ID NO: 1513 - protein, 88 aa, Triticum aestivum
MRMAKACLLRGVGLVVCALLLLSPSFMAAEATGRKWDHGREATVAVMPMAGGRFARKVLREEMVQADGDVDIAGSKRKSPGGPDPQHH

SEQ ID NO: 1514 - protein, 96 aa, Zea mays
MVRNPLKARPTLVLISLLLMADLATVGYSRRVAELGALAVSDSGGGGGGSPPGKGCCLPNQSSSSASGRHLGDDCCKQMRIVSKRLVPQGPNPLHN

SEQ ID NO: 1515 - protein, 132 aa, Zea mays
MASRMGMVAILSLFVCALVASTSVNANVWQTDEDAFYSTNKLGVNGNMEMAQQQGGFIGHRPRLALFNRASKQLDREKRPVPSGPDPIHHSIPSHAPQHPPSYGKAPYEDDKSIASPGLSNPIGPPPFLDRY

SEQ ID NO: 1516 - protein, 333 aa, Zea mays
MVVLSQPALNQFFLLKTCKPTPLFAGIPVVDLTDPDAKTHIVNACRDFGFFKLVNHGVPLQFMANLENETLGFFKKPQSEKDRAGPPDPFGYGSKRIGPNGDVGWVEYLLLNTNPDVISPKSQFIFREGPQNFRAVVEEYIRAVKNMCYEVLELMAEGLGITQRNVLSRLLKDEKSDSCFRLNHYPPCPEVQALNGRNLVGFGEHTDPQIISVLRSNSTSGLQICLTDGTWVSVPPDQTSFFINVGDTLQVMTNGRFKSVKHRVLADPTKSRLSMIYFGGPPLCEKIAPLPSLMLKGEESFYKEFTWWEYKKAAYASRLADNRLGPFEKSAAD

SEQ ID NO: 1517 - protein, 382 aa, Oryza sativa
MVVPSATTPARQETVVAAAPPAAAASGVVGGGGGVTIATVDMSAERGAVARQVATACAAHGFFRCVGHGVPAAAPVAARLDAATAAFFAMAPAEKQRAGPASPLGYGCRSIGFNGDVGELEYLLLHANPAAVAHRARTIDAMDPSRFSAIVNEYIEAMKKLACEILDLLGEGLGLKDPRYFSKLTTNADSDCLLRINHYPPSCNIHKLDHDDQCNIKSLVSTKASNGGNLMAGGRIGFGEHSDPQILSLLRANDVEGLQVFVPDHEGKEMWVQVPSDPSAIFVNVGDVLQALTNGRLISIRHRVIATACRPRLSTIYFASPPLHARISALPETITASSPRRYRSFTWAEYKTTMYSLRLSHSRLELFKIDDDDSDNASEGKA

SEQ ID NO: 1518 - protein, 505 aa, Zea mays
MASPAMVPLRQLFVDGEWRPPAQGRRLPVVNPTTEAHIGEIPAGTAEDVDAAVAAARAALKRNRGRDWARAPGAVRAKYLRAIAAKVIERKPELAKLEALDCGKPYDEAAWDMDDVAGCFEYFADQAEALDKRQNSPVSLPMETFKCHLRREPIGVVGLITPWNYPLLMATWKIAPALAAGCTAVLKPSELASVTCLELADICKEVGLPSGVLNIVTGLGPDAGAPLSAHPDVDKVAFTGSFETGKKIMASAAPMVKPVTLELGGKSPIVVFDDVDIDKAVEWTLFGCFWTNGQICSATSRLLIHTKIAKKFNERMVAWAKNIKVSDPLEEGCRLGPVVSEGQYEKIKKFISNAKSQGATILTGGVRPAHLEKGFFIEPTIITDITTSMEIWREEVFGPVLCVKEFSTEDEAIELANDTQYGLAGAVISGDRERCQRLSEEIDAGCIWVNCSQPCFCQAPWGGNKRSGFGRELGEGGIDNYLSVKQVTEYISDEPWGWYQSPSKL

SEQ ID NO: 1519 - protein, 506 aa, Oryza sativa
MAPPQTIPRRGLFIGGAWREPCLGRRLPVVNPATEATIGDIPAGTAEDVEIAVAAARDAFSRDGGRHWSRAPGAVRANFLRAIAAKIKDRKSELALLETLDSGKPLDEASGDMDDVAACFEYYADLAEALDGKQQSPISLPMENFKSYVLKEPIGVVGLITPWNYPLLMATWKVAPALAAGCTTILKPSELASVSCLELGAICMEIGLPPGVLNIITGLGPEAGAPLSSHSHVDKVAFTGSTETGKRIMISAAQMVKPVSLELGGKSPLIVFDDIGDIDKAVEWTMFGIFANAGQVCSATSRLLLHEKIAKKFLDRLVAWAKNIKVSDPLEEGCRLGSVISEGQYEKIKKFISTARSEGATILYGGGRPQHLRRGFFLEPTIITDVSTSMQIWQEEVFGPVICVKEFRTESEAVELANDTHYGLAGAVISNDQERCERISKALHSGIIWINCSQPCFVQAPWGGNKRSGFGRELGEWGLDNYLTVKQVTKYCSDEPWGWYQPPSKL

SEQ ID NO: 1520 - protein, 869 aa, Saccharomyces cerevisiae
MSSCKTTLSEMVGSVTKDRGTINVEARTRSSNVTFKPPVTHDMVRSLFDPTLKKSLLEKCIALAIISNFFICYWVFQRFGLQFTKYFFLVQYLFWRIAYNLGIGLVLHYQSHYETLTNCAKTHAIFSKIPQNKDANSNFSTNSNSFSEKFWNFIRKFCQYEIRSKMPKEYDLFAYPEEINVWLIFRQFVDLILMQDFVTYIIYVYLSIPYSWVQIFNWRSLLGVILILFNIWVKLDAHRVVKDYAWYWGDFFFLEESELIFDGVFNISPHPMYSIGYLGYYGLSLICNDYKVLLVSVFGHYSQFLFLKYVENPHIERTYGDGTDSDSQMNSRIDDLISKENYDYSRPLINMGLSFNNFNKLRFTDYFTIGTVAALMLGTIMNARFINLNYLFITVFVTKLVSWLFISTILYKQSQSKWFTRLFLENGYTQVYSYEQWQFIYNYYLVLTYTLMIIHTGLQIWSNFSNINNSQLIFGLILVALQTWCDKETRLAISDFGWFYGDFFLSNYISTRKLTSQGIYRYLNHPEAVLGVVGVWGTVLMTNFAVTNIILAVLWTLTNFILVKFIETPHVNKIYGKTKRVSGVGKTLLGLKPLRQVSDIVNRIENIIIKSLVDESKNSNGGAELLPKNYQDNKEWNILIQEAMDSVATRLSPYCELKIENEQVETNFVLPTPVTLNWKMPIELYNGDDWIGLYKVIDTRADREKTRVGSGGHWSATSKDSYMNHGLRHKESVTEIKATEKYVQGKVTFDTSLLYFENGIYEFRYHSGNSHKVLLISTPFEISLPVLNTTTPELFEKDLTEFLTKVNVLKDGKFRPLGNKFFGMDSLKQLIKNSIGVELSSEYMRRVNGDAHVISHRAWDIKQTLDSLA

SEQ ID NO: 1521 - protein, 206 aa, Saccharomyces cerevisiae
MKESVQEIIQQLIHSVDLQSSKFQLAIVCTMFNPIFWNIVARMEYHKHSLTKMCGGARKGCYMLAATIFSLGIVRDMVYESALREQPTCSLITGENWTKLGVALFGLGQVLVLSSMYKLGITGTYLGDYFGILMDERVTGFPFNVSNNPMYQGSTLSFLGIALYKGKPAGLVVSAVVYFMYKIALRWEEPFTAMIYANRDKAKKNM

SEQ ID NO: 1522 - protein, 501 aa, Zea mays
MDTVSVPVVAVANGIGEVERKVQKSYWEEHSKCLTVESMMLDSRAADLDKEERPEILSLLPSYKGKSVLELGAGIGRFTGDLAKEAGHVLALDFIESVIKKNQSINGHHKNITFRCADVTSNDLKIEDNSVDLIFSNWLLMYLSDEEVQKLVGKMVKWLKVGGHIFFRESCFHQSGDSKRKVNPTHYREPRFYTKVFKEGHSFDQDGGSFELSLVTCKCIGAYVKNKKNQNQICWLWEKVKSTEDRDFQRFLDNVQYKTSGILRYERVFGEGFVSTGGIETTKEFVGMLDLKPGQKVLDVGCGIGGGDFYMAANYDVHVLGIDLSVNMVSFAIERAIGRKCSVEFEVADCTTKDYPENSFDVIYSRDTILHIQDKPALFRSFFKWLKPGGKVLISDYCKNPGKPSEEFAAYIKQRGYDLHDVKAYGQMLKDAGFHNVIAEDRTEQFLNVLQRELGEVEKNKDAFLADFTQEDYDDIVNGWNAKLKRSSAGEQRWGLFIATK

SEQ ID NO: 1523 - protein, 677 aa, Escherichia coli
MTDLSHSREKDKINPVVFYTSAGLILLFSLTTILFRDFSALWIGRTLDWVSKTFGWYYLLAATLYIVFVVCIACSRFGSVKLGPEQSKPEFSLLSWAAMLFAAGIGIDLMFFSVAEPVTQYMQPPEGAGQTIEAARQAMVWTLFHYGLTGWSMYALMGMALGYFSYRYNLPLTIRSALYPIFGKRINGPIGHSVDIAAVIGTIFGIATTLGIGVVQLNYGLSVLFDIPDSMAAKAALIALSVIIATISVTSGVDKGIRVLSELNVALALGLILFVLFMGDTSFLLNALVLNVGDYVNRFMGMTLNSFAFDRPVEWMNNWTLFFWAWWVAWSPFVGLFLARISRGRTIRQFVLGTLIIPFTFTLLWLSVFGNSALYEIIHGGAAFAEEAMVHPERGFYSLLAQYPAFTFSASVATITGLLFYVTSADSGALVLGNFTSQLKDINSDAPGWLRVFWSVAIGLLTLGMLMTNGISALQNTTVIMGLPFSFVIFFVMAGLYKSLKVEDYRRESANRDTAPRPLGLQDRLSWKKRLSRLMNYPGTRYTKQMMETVCYPAMEEVAQELRLRGAYVELKSLPPEEGQQLGHLDLLVHMGEEQNFVYQIWPQQYSVPGFTYRARSGKSTYYRLETFLLEGSQGNDLMDYSKEQVITDILDQYERHLNFIHLHREAPGHSVMFPDA

SEQ ID NO: 1524 - protein, 680 aa, Xenorhabdus sp.
MNIGDSPKNTQKDSLNSVVFFTSAALIILFSLFTLFFTDATSIWIKNTLNWVSKTFGWYYLLAATLYIVFVIFVAASRFGAIKLGPEQSKPEFSLLSWAAMLFAAGIGIDLMFFSVAEPITQYMRPPTGEGETIEAARQAMVWTLFHYGLTGWSMYALMGIALGYFSYRYNLPLTIRSALYPIFGNRIKGPIGHTVDIAAVIGTIFGIATTLGIGVVQLNYGLKVLFGLPQGLGVQGGLILLSVIVATISVTSGVNKGIRFLSELNVLLALGLVLFILFVGDTEFLLNGLVQNVGDYISRFMGMTLNSFAFERPTEWMNSWTLFFWAWWVAWSPFVGLFLARISRGRTIRQFVMGTLIIPFVFTLIWLSVFGNSALYEIIHGNHELAETVLVHPERGFYNLLALYPAFTLSASVATITGLLFYVTSADSGSLVLGNFTSNLSDINNDAPNWLRIFWSVAIGVLTLGILMTDGISALQNMTVIMGLPFSFVIFFIMAGLYKSLRVEDFRKASALQNTSPTLVHDNGSLNWKQRLSRMMHFPGTKSTQRMLDMVCRPAMQEVAKELELRGASVQFNMLPSEEDKRLTPIELIVDLGDEQNFIYQIWPQRYSVPGFTYRARLGKSYYFRLETFLIEGTQGNDLMGYTKEQIISDILDHYEKHLNFIHLNRESPGQTLIFPNGV

SEQ ID NO: 1525 - protein, 323 aa, Zea mays
MGVLEDLVARAGGCAVIDGGFATQLEALGADINDPLWSAACLITRPHLVKEVHMQYLEAGADVIISSSYQATIPGFIARGMSVAEAEDLLRTSVKLANEARDEFWKSTLRKSKPIYNRALVAASIGSYGAYLADGSEYSGSYGADITAEKLKDFHRRRLQVLASAGPDLIAFEAIPNQMEAQALVELLEEEKVQIPSWICFSSVDGKNLCSGESFADCLKILNASEKVAVVGVNCTPPQFIEGIICEFRKQTKKAIAVYPNSGEVWDGRAKRWLPVECLGHKSFDALAKRWQEAGASLIGGCCRTTPSTIRAVSKILKGRTGH

SEQ ID NO: 1526 - protein, 338 aa, Zea mays
MVGTAEGGAERAVRRWVDAAGGRLVLDGGLATELEANGADLNDPLWSAKCLLSSPHLIRKVHMDYLEAGANIIITASYQATIQGFESKGFSKEQSENLLTKSVQIALEAREMFLKEHLEKSTPIQHPILVAAALGSYGAYLADGSEYSGDYGEAGTKEFLKDFHRRRLQVLAEAGPDLIAFETIPNKLEAQAYVELLEECNINIPSWLSFNSKDGVHVVSGDSLIECATIADKCAKVGAVGINCTPPRFIHGLILSIRKVTDKPILIYPNSGERYDGEKKEWVESTGVSDGDFVSYVNEWCKDGAALIGGCCRTTPNTIRAIHRTLNQGCHKHQLPVA

SEQ ID NO: 1527 - protein, 310 aa, Escherichia coli
MSQNNPLRALLDKQDILLLDGAMATELEARGCNLADSLWSAKVLVENPELIREVHLDYYRAGAQCAITASYQATPAGFAARGLDEAQSKALIGKSVELARKAREAYLAENPQAGTLLVAGSVGPYGAYLADGSEYRGDYHCSVEAFQAFHRPRVEALLDAGADLLACETLPNFSEIEALAELLTAYPRARAWFSFTLRDSEHLSDGTPLRDVVALLAGYPQVVALGINCIALENTTAALQHLHGLTVLPLVVYPNSGEHYDAVSKTWHHHGEHCAQLADYLPQWQAAGARLIGGCCRTTPADIAALKARS

SEQ ID NO: 1528 - protein, 324 aa, Saccharomyces cerevisiae
MKRIPIKELIVEHPGKVLILDGGQGTELENRGININSPVWSAAPFTSESFWEPSSQERKVVEEMYRDFMIAGANILMTITYQANFQSISENTSIKTLAAYKRFLDKIVSFTREFIGEERYLIGSIGPWAAHVSCEYTGDYGPHPENIDYYGFFKPQLENFNQNRDIDLIGFETIPNFHELKAILSWDEDIISKPFYIGLSVDDNSLLRDGTTLEEISVHIKGLGNKINKNLLLMGVNCVSFNQSALILKMLHEHLPGMPLLVYPNSGEIYNPKEKTWHRPTNKLDDWETTVKKFVDNGARIIGGCCRTSPKDIAEIASAVDKYS

SEQ ID NO: 1529 - protein, 424 aa, Oryza sativa
MVLLNSEEVSCNDHHQVDVVAAAGLQCSGDMLGDKQLVSQVILEGLEIEEPPADEMEAAEKKAGISRLMAGYVQHLQHRSAYHLGYPLNFDYDFSPLAPFLNFSLNNAGDPFAKVNNSVHSRQFEVAVLNWFANFWDVQRDQFWGYITSGGTEGNLYGLLVGRELFPDGILYASNDSHYSVFKAAKMYRVKCIRIATTVSGEMNYADLKSKLQHNTNSPAIINANIGTTFKGAVDDIDQIISTLEKCGFQNRYYIHCDSALSGMMTPFMKQAPKVSFKKPIGSISVSGHKFLGCPMPCGVVITRLEHAEVLSTDIEYIASRDSTITGSRNGHAPIFLWWQLACEGNLAHIVVMPNVTFEKLTVFVEELAEKRKDWYQDKGFDIPCLAILPKSLWGHLTLTLYCSSTPTTTSAMETTRGGGSGFL

SEQ ID NO: 1530 - protein, 452 aa, Zea mays
MELDPSEALVAAAVEAKGEEAANGRREFVMGRNVHTSCFAVKEPDADDEETGEREATMASVLALYRRSLVERTKHHLGYPYNLDFDYGALTQLQHFSINNLGDPFIESNYGVHSRQFEVGVLDWFARLWELEKDEYWGYITNCGTEGNLHGILVGREVFPDGILYASRESHYSVFKAARMYRMDCVKVDTLMSGEIDCADFQRKLLQNRDKPAIINVNIGTTVKGAVDDLDLVIKTLEENGFKDRFYIHCDGALFGLMIPFVKKAPQVTFKKPIGSVSVSGHKFVGCPMPCGVQITRLEHINALSSNVEYLASRDATIMGSRNGHAPIFLWYTLNRKGYRGFQKEVQKCLRNAHYLKDRLKEAGIGAMLNELSSTVVFERPKDEEFVRRWQLACEGNIAHVVVMPSVNIDKLDYFLNELVEKRATWYQDGISQPPCIARDVGVENCLCGLHK

SEQ ID NO: 1531 - protein, 483 aa, Glycine max
MVVDALNEDLRINGAVEPLPEDFDATAVIIDPVPLAVVDNGIVKEEAQIIKGKEKREIVLGRNIHTSCLEVTEPEADDEVTGDREAHMASVLARYKRALTERTKHHLGYPYNLDFDYGALTQLQHFSINNLGDPFIESNYGVHSRQFEVGVLDWFARLWELEKNEYWGYITNCGTEGNLHGILVGREVFPDGILYASRESHYSVFKAARMYRMECEKVDTLWSGEIDCDDFKAKLLSHQDKPAIINVNIGTTVKGAVDDLDLVIKKLEEAGFSHDRFYIHCDGALFGLMMPFVKRAPKVTFKKPVGSVSVSGHKFVGCPMPCGVQITRLEYVNALARDVEYLASRDATIMGSRNGHAPIFLWYTLNRKGYRGFQKEVQKCLRNAHYFKGRLVEAGIGAMLNELSSTVVFERPHDEEFIRKWQLACKGNIAHVVVMPNITIEKLDDFLNELLEKRATWFQDGKDQPYCISSDVGEKNCLCALHK

SEQ ID NO: 1532 - protein, 485 aa, Zea mays
MALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEDYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRY

SEQ ID NO: 1533 - protein, 340 aa, Saccharomyces cerevisiae
MTAPLVVLGNPLLDFQADVTAEYLAKYSLKENDAILVDAKSGDAKMAIFDELLQMPETKLVAGGAAQNTARGAAYVLGAGQVVYFGSVGKDKFSERLLNENEKAGVKSMYQVQNDIGTGKCAALITGHNRSLVTDLGAANFFTPDHLDKHWDLVEAAKLFYIGGFHLTVSPDAIVKLGQHAKENSKPFVLNFSAPFIPHVFKDALARVLPYATVIIANESEAEAFCDAFQLDCANTDLEAIAQRIVKDSPVEKTVIFTHGVEPTVVVSSKGTSTYPVKPLDSSKIVDTNGAGDAFAGGFMAGLTKGEDLETSIDMGQWLAALSIQEVGPSYPSEKISYSK

SEQ ID NO: 1534 - protein, 342 aa, Zea mays
MAASEGVLLGMGNPLLDISAVVDDAFLAKYDIKLNNAILAEEKHLPMYDELASNSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAATNNKVFLMNLSAPFICEFFCDAQEKVLPYADFIFGNETEAKIFAKVRGWETENVEEIALKISQLPLASGKQKRTAVITQGADPVVVAEDGKVKTFPVILLPKEKLVDTNGAGDAFVGGFLSRLVQGKSIEDCVTAGCYAANVIIQRPGCTYPEKPDFN

SEQ ID NO: 1535 - protein, 341 aa, Glycine max
MELDGVLLGMCNPLLDISAVVDDAFLQKYGIKLNDAILAEDKHKPMYEELANNPNVEYIAGGATQNSIRVAQWMLQAPGATSYIGCIGKDKFGEEMKKKCTLDGVKVNYYEIDNTPTGTCAVCVVGGERSLVANLSAANCYKSEHLTRPENWALVEKAKYYYISGFFLTVSPDSIQLVAEHAAANNKIFMMNLSAPFICEFFKGALDKVLPYMDYVFGNETEARTFSKAQGWETDNVEEIALKISQLPKASEKHKRITVITQGADPVCVAEDGKVKLYPVILLPKEKLIDTNGAGDAFVGGFLSQLVKQKPIEECVRAGCYAANVIIQRPGCTYPEKPDFH

SEQ ID NO: 1536 - protein, 333 aa, Synechocystis PCC6803
MGHKYDVYGMGNALVDMEFEVTPEQLASLGIDKGVMTLVEEARENELIAQLAQQRGKQSSGGSAANTLVSLAQLGGTGFYACKVGKDEAGAFYLQDLNDCGLDTNPHHETAGEGITGKCLVFVTPDADRTMNAFLGISGSLSVTEMDWSALKQSQYLYLEGYLVTSPSAKAACIEAKAIAEQSGVKTCLSLSDPNMAKFFQDGLKEMLGSGVDLLFANEAEALEMAGTSDLNQAIAYCKSIAKNFALTRGGAGSLIFDGENLLTIGTPKVQPIDTVGAGDMYAGGFLYGLTHGMDYEKAGQLASETAAKVVTCYGPRLDTEILQEILQSVQAV

SEQ ID NO: 1537 - protein, 485 aa, Zea mays
MALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEEYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRY

SEQ ID NO: 1538 - protein, 449 aa, Saccharomyces cerevisiae
MSAPAQNYKIADISLAAFGRKEIELAEHEMPGLMAIRKAYGDVQPLKGARIAGCLHMTIQTAVLIETLVALGAEVTWSSCNIYSTQDHAAAAIAASGVPVFAWKGETEEEYLWCIEQQLFAFKDNKKLNLILDDGGDLTTLVHEKHPEMLEDCFGLSEETTTGVHHLYRMVKEGKLKVPAINVNDSVTKSKFDNLYGCRESLVDGIKRATDVMLAGKVAVVAGYGDVGKGCAAALRGMGARVLVTEIDPINALQAAMEGYQVVTMEDASHIGQVFVTTTGCRDIINGEHFINMPEDAIVCNIGHFDIEIDVAWLKANAKECINIKPQVDRYLLSSGRHVILLANGRLVNLGCATGHSSFVMSCSFSNQVLAQIALFKSNDKSFREKHIEFQKTGPFEVGVHVLPKILDEAVAKFHLGNLGVRLTKLSKVQSEYLGIPEEGPFKADHYRY

SEQ ID NO: 1539 - protein, 425 aa, Synechocystis PCC6803
MVATPVKQKYDIKDISLAPQGRQRIEWAAREMPVLKQIRERFAQEKPFAGIRLVACCHVTTETANLAIALHAGGADSLLIASNPLSTQDDVAACLVADYGIPVYAIKGEDNETYHRHVQIALDHRPNIIIDDGSDVVATLVQERQHQLSDIIGTTEETTTGIVRLRAMFNDGVLTFPAMNVNDADTKHFYDNRYGTGQSTLDGIIRATNILLAGKTIVVAGYGWCGKGVAMRAKGMGADVIVTEISPVPAIEAAMDGFRVMPMAEAAHQGDIFITVTGNKHVIRPEHFAVMKDGAIVCNSGHFDIEIDLKSLKEQAKEVKEVRNFTEQYILPNGKSIIVIGEGRLVNLAAAEGHPSAVMDMSFANQALACEHLVKNKGQLEPGMHSIPVEVDQEIARLKLQAMGIAIDSLTPEQVEYINSWASGT

SEQ ID NO: 1540 - protein, 443 aa, Zea mays
MVSPGSNRGGLSRVSTRGGVAGPGSPRASPAATAFAALRRRWRWAPPGSSTLERAARAFLLASAALVLSCALYLYVLRYVGRGGRAFAAAGFVGDAVLGLGGEPCDVFDGAWVPDDTGLRPLYNSSGCPFAERGFDCLANGRNDTGYLKWRWKPRRCGVPRFAARTALERLRGKRVVFVGDSMSRSQWESFICMLMAGVDDPRTVFEVNGNEITKTIRHLAVRFASHGLTVEFFRSVFLVQEHPAPRHAPKRVKSTLRLDRMDNFSRKWVNSDVLIFNTGHWWTPTKLFDTGCYFQAGRSLKLGTSIDAGFRMALETWASWVQKRVDLNRTHVFFRTYEPSHWGDTSQKVCEVTEQPSSEAKGNDKSEFGAILADVVTNMKVPITVLNVTLMGSFRSDAHVGTWSYPPTILDCSHWCLPGVPDAWNELVFSYLLTNGWRNMAG

SEQ ID NO: 1541 - protein, 393 aa, Zea mays
MKVLVLAVLALVAAASAAGQGEEGGGPPLPFALGAAPAGCDVAQGEWVRDDDARPWYQEWECPYIQPQLTCQAHGRPDKAYQSWRWQPRGCSLPSFNATLMLEMLRGKRMLFVGDSLNRGQYVSLLCLLHRAIPDGAKSFETVDSLSVFRAKNYDATIEFYWAPMLAESNSDDAVVHSADDRLIRGAPMDRHYSFWKGADVLVFNSYLWWVAGDKIQILRGADNDPSKDIVEMKSEEAYRLVLHQVVRWLERNVDPGKSRVFFVTASPTHTDGRAWGDDDAEGSSNCYNQTSPISAASSYRGGTSREMLRATEEVLATSRVPVGLVNITRLSEYRRDAHTQTYKKQWVEPTAEQRADPRSYADCTHWCLPGVPDTWNELLYWKLFFPSNDQVL

SEQ ID NO: 1542 - protein, 430 aa, Zea mays
MRSTMKAQHANGRGSRSPFLTSYALTLAFITFVSVLYFKDFSSTLHRPFLHRPRRHAAPDKSQAGRRAAAERLPFAVGAAPAGCDVGRGEWVYDDAARPWYQEEECPYIQPQLTCQAHGRPDRAYQHWRWQPRGCSLPSFNATLMLEMLRGKRMLFVGDSLNRGQYVSLVCLLHRIIPESSKSMETVDSLTVFKAKDYNATIEFYWAPFLAESNSDDAVVHRIADRIVRGTSIEKHAKFWKGADILVFNTYLWWMTGQKMKILRNSFEDKSKDIIEMETEEAYEMVLNAVLKWVESNMNPRTSRTFFVTMSPTHTRSRDWGDDTDGNCYNQTAPIEDLSYWGPDTSKGLMRVIGEVFSASKSRIPVGVVNITQLSEYRKDAHTQIYKKQWNPLTPEQVADPKSYADCTHWCLPGLQDTWNELLYSKLFFP

SEQ ID NO: 1543 - protein, 406 aa, Zea mays
MKKLHWLVRFLFGPVPVYFSALAILIVLTNAQYFGLVGVGVAPRTAKLASSAPVVSVMKYCDIFRGEWVPDAEAPYYNHKTCHMIQEHQNCLKYGRPDLGFLKWRWRPSGCELPRFDPLQFLQFARGKSLAFVGDSLARNHMQSLLCLLSQVAYPKDLSANPSDQNKVYHYRAYNFTISMFWSPFLVRAREPDHDGPAHTGHWSLYLDEPDDKWVSQMPRFDYVLVSAANWFSRPSLFYERRRLVGCSFCSRQYGVPDLTLYYSQRRAWRVALRAINDLERLRGRVIVRMLSPMSHFENGTWDHGGDCRRTQPLRANQTAMEGRDLHFYTAQMEEFRAAEKAAAEKGRRLMLMDATAAMLMRPDGHPSRYGHWPNEKVQLYNDCIHWCLPGPIDIWNDMLFQMLLA

SEQ ID NO: 1544 - protein, 555 aa, Zea mays
  unsure (1)..(555): unsure at all Xaa locations
MXQRRKSVFASAPFAMKQAALGAGVAARKNGAPLSLAAVVFALFVFATFLYNEDIKSITDFQFSSGAIRAKSPDLHLLQEAEAAAHAAVNTLAKRGEEVIVRVLEVEAPPVVNTSSVLAAAAKASAKANAVDVGQEKERDVTLPTVTGGRGGADEARRRADEEVAEKAASAKAAAATAALRGVVSVPQTCDLYRGSWVYDEVSAPVYKEGECEFLTEQVTCMRNGRRDDSYQKWRWQPAGCDLPRFDARLLLERLRNKRLMFVGDSLNRNQWESMVCLVQSVIPDRGQKTLTKFVNGGSSNVFYAHEYNATVEFYWAPFLVESNSDNPKVHSVPDRVIQWHAIAKHARNWIGVDYLVFNTYIWWLNTLDIKVLKQGSSFDDQGSTDYVEVDRPVAYKEVLTTWAKWVDRNIDPNRTTVFFMGMSPNHITPEAWGNKGGIKCAMETLPIASNRSAALDVGTDWRLYAGAREVLPTLRRVPVHFVDITALSELRKDAHTSVHTLRQGKLLTPEQQADPKTYADCIHWCLPGLPDTWNQFLYARIASSPWPNDAQAQQ

SEQ ID NO: 1545 - protein, 537 aa, Arabidopsis thaliana
MMMKISFNTCFQILLGFIVFIASITLLGRIFSRPSKTKDRCRQLPPGRPGWPILGNLPELIMTRPRSKYFHLAMKELKTDIACFNFAGTHTITINSDEIAREAFRERDADLADRPQLSIVESIGDNYKTMGTSSYGEHFMKMKKVITTEIMSVKTLNMLEAARTIEADNLIAYIHSMYQRSETVDVRELSRVYGYAVTMRMLFGRRHVTKENMFSDDGRLGKAEKHHLEVIFNTLNCLPGFSPVDYVDRWLGGWNIDGEEERAKVNVNLVRSYNNPIIDERVEIWREKGGKAAVEDWLDTFITLKDQNGNYLVTPDEIKAQCVEFCIAAIDNPANNMEWTLGEMLKNPEILRKALKELDEVVGKDRLVQESDIRNLNYLKACCRETFRIHPSAHYVPPHVARQDTTLGGYFIPKGSHIHVCRPGLGRNPKIWKDPLAYEPERHLQGDGITKEVTLVETEMRFVSFSTGRRGCVGVKVGTIMMAMMLARFLQGFNWKLHRDFGPLSLEEDDASLLMAKPLLLSVEPRLASNLYPKFRP

SEQ ID NO: 1546 - protein, 83 aa, Oryza sativa
MAARTVAVAAALAVLLIFAASSATVAMAGRPTPTTSLDEEAAQAAAQSEIGGGCKEGEGEEECLARRTLTAHTDYIYTQQHHN

SEQ ID NO: 1547 - protein, 119 aa, Oryza sativa
MSTTRGVSSSSAAAALALLLLFALCFFSFHFAAAARAVPRDEHQENGGVKAVAAVAADQLVLQLEGDTGNGDEVSELMGAAEEEAAACEEGKNNDECVQRRLLSDAHLDYIYTQHKNKP

SEQ ID NO: 1548 - protein, 89 aa, Oryza sativa
MVNPGRTARALCLLCLALLLLGQDTHSRKLLLQEKHSHGVGNGTTTTQEPSRENGGSTGSNNNGQLQFDSAKWEEFHTDYIYTQDVKNP

SEQ ID NO: 1549 - protein, 102 aa, Oryza sativa
MRPTGRRSSPPVAAALALLLLLVLFFFSHCASAARPLPASAAAELVLQDGATGNGDEVSELMGAAEEEAAGLCEEGNEECVERRMLRDAHLDYIYTQKRNRP

SEQ ID NO: 1550 - protein, 577 aa, Zea mays
MAQACKKRRGVYISSESGDSDTDSDVEGSKHSQKSGVTSISTCEHQSSYNLKAASMKSSRMIRLCGNIVRKLIDHKCGWLFKEPVDPDLYGIPDYFDVIRSPMDLGTIKNKLTKKKYVSIEEFAADVRLTFSNAMKYNPPGNDVHIFAKELNEMFDSEWESVERKFRGRNLGQDQQTMKAIKVRAMMDSKSTVARGPVACSNPKTLVTRGPVACSNSIAKKTLTDALSSKVKIKFSVRSSAHTSSKDILVQAAGSKEGSLNHSVPTGNKEASSNCTIPIAKEAKISRAREIERCSGSIGKQSWSCNDTSTSPLASSVQGEESYLHDEPLSPSRALRAAMLRSRFAGTIVKAQQKALLDHGKNIDPVKLQLEKERLEKRQQEEKARIEAQVKAAEAAAQQKFEEEMRMKRKQEREAARLALRMMKKTVDIDNSDFLKELENFSKTWQANPPGKLIVDFISGDLPPGLGSPLERLGLFMKEDFEDEVEQEMEDRVSPSMDVDIRKDFQEDLGHEMQDSASPVTVIGTKNDVQGVAGHEMEDSGSPATVIDTKKEETEHEMVDSVSPLMDVDTEEGEISC

SEQ ID NO: 1551 - protein, 326 aa, Zea mays
MKRQSKRPTASRESPETGEKQKLAFAEEEAPPARKVEPDDEAEMDEDEDELGPGLGGGRAARSPCGLGEKKRRLALEQVRALERCFETDNKLDPDRKARIARDLALQPRQVAVWFQNRRARWKTKTLERDFAALRARHDALRADCDALRRDKDALAAEIRELRQKLLPKPEATVKLEATTGNDTAEERRQATAGAPPAGACKDGSSDSDSSVVFSDVEASPYSGGAAFEPPALAGLGAPFLDTSVAPTGCSSPPVFVETKWQQHGPTQYPFPFDSYKACAGYGFTEEWLASSDLIGSDGGAAGFFSEDHASSLNFNWCPSGIQGWE

SEQ ID NO: 1552 - protein, 282 aa, Zea mays
MKKCASELELEAFIRESGEDARAAAGGSSPGCGGSSDPGGSGVFSPGFGFADSDTMDGGSWWYGNVRTPNPVMSQAASISASPGLTTSANHALESESDSDSESLYEVEGVPYERGNRSIETKRIRRMVSNRESARRSRRRKQAQLSDLESQVERLKGENATLFQQLSDANQQFSTAVTDNRILKSDVEALRIKVKMAEDMVARSAVSCGLGDLGLAPYVNSRKMCQALNVLTGLDLLGSDAFRGPTAGTRVQNSPVQSTASLESLDNRKSNEVTSCAADIWP

SEQ ID NO: 1553 - protein, 377 aa, Zea mays
MAQDEAVATQKTGNTTSPSKDYPTPSPYPDWSTMQAYYGPGVLPPTYFTPAIAPGHPPPYMWGPQPIMPPPFGTPYAAVYPHGGAYPHPLVPMMSTPMSVEPAKSTNSKEKNSNKKLKEIDRTAVSAGSGNSKRTVSSIEDYSAEGSSDVNDQNVNETSRKRSSDGGPGAETTTGGNTECVLAPNHTLGNATILPQHCFSAPVIKPSATNVANSRAIGTALSPPPGVMVPVHNAVPSDLSVKDERELKREKRKQSNRESARRSRLRKQAETEELATQVESLAAENTSLRSEIGQLTESSEKLRLENSALMVKLKDTAEPSPIKASASPSSPRASAENFLSMIDSANAPSVSRHTEHGGPRLRQLLDSSPATDVAAVS

SEQ ID NO: 1554 - protein, 518 aa, Zea mays
MEYERIEKPFPVQGGGFSPKRLRAMLLGVDKRRKGQDGAAEEDEDGGGGGDYGALPKAHARSGAGDGGGATCEEYKDVDVVSTTSEFSSSLETAGGHRPRDAHPVATGSRTRVPPEEDSCDSESVASNFEFHKERRAAAAASVVPPFSKPAPSKWDDAQKWIASPTANCPGRGGAAPAPKKTEKPGSGIGRLPLPATKVVVEATEEIDTKRMDPSQEKREIGWQKAARWAPPDPCPEVEPCPTKTTLLAVETTVAAASAAAVNFNRHDASTTLQSAATCIPPPTTVRSVSMRDMGTEMTPIASQEPSRTGTPVRATSPNCSQPTTPRRTLGGPSAVGSFISHGGECSSSELSEQELQTKTRREIMLLGTQLGKTSIAAWASKKEEEKDASLSLKPVPMDQSTQNITAIRAAAWEEAEKAKYLARFKREEIKIQAWEDHQKAQIEAEMRKIEVEVERMRARAQDKLMTKLASARHSADEKRATAELKRNRAAARTAEQAEHIRRTGRVPPSFGCWNWCS

SEQ ID NO: 1555 - protein, 199 aa, Zea mays
MAEEEAKKVEVEVTKEPEAAAKEDVADDKAVIPASDPPPPPPPADDSKALAIVEKVADEPAPEKPAPAKQGGSNDRDLALARVETEKRNSLIKAWEENEKTKAENKAAKKVSAILSWENTKKANIEAELKKIEEQLEKKKAEYAEKMKNKVAMIHKEAEEKRAMVEAKRGEEVLKAEEMAAKYRATGHAPKKLIGCFGA

SEQ ID NO: 1556 - protein, 255 aa, Zea mays
MFPPGLIHHRPDATAPGDGPPRSGPGGPSLVLTADPKPRLRWTADLHERFVDAVAQLGGPEKATPKTILRTMGVKGLTLFHLKSHLQKYRLGKQSGKEGSEQSKDASYLLDAQSGMSVSPRVAAQDMKESQEVKEALRAQMEVQRRLHEQVEVQKRVQIRMEALEKYIDSILESACKMVTEQFASSGFSISNPDLPEISPGGVMCGSTDTLGSSVLNQLSVSSIDSHSPGGKPSPSGMEGPTLLQKSPELKRRSS

SEQ ID NO: 1557 - protein, 270 aa, Zea mays
MHPSAVSFDSGDGRRRGGAQMLLFGGGGSANSNGFFRGVPMAVLAMDDATRVGKRPFFTTHEELLEEEYYDEQAPEKKRRLTAEQVQLLERSFEEENKLEPERKTELARRLGMAPRQVAVWFQNRRARWKTKQLETDYDRLKAAYNALAADHQGLLADNDSLRAQVICLTEKLQGKETSLSATIAAQEVDQPNEHTTGTEKLLAQQLKDDLHSSCGCTGHGALSSEEEDGGVVSDEGCNFDLPDAMFAVGVTNHGAEEAQLANWTSWFWN

SEQ ID NO: 1558 - protein, 272 aa, Zea mays
MDPSAVSFDSGGTRRGGGAQMLLFGGGGSANSNGFFRGVPMAVLGMDDATRVGKRAFFTTHEELLEEEYYDEQAPEKKRRLTAEQVQLLERSFEEENKLEPERKTELARRLGMAPRQVAVWFQNRRARWKTKQLETDYDRLKAAYDALAADHQGLLADNDNLRAQVISLTEKLQGKETYPSATTAAQEVDQPDEHTAVSGTEELLAQQLKDNLHSSGDCTGHGTLSSEEDDGGVVSDEGCSFALPDAMFAAGFTHHGAEEVQLANWTSMFWN

SEQ ID NO: 1559 - protein, 267 aa, Zea mays
MAAGGGGGSAAPFVWKTYTMVEDPGTAGVIGWGSGNNSFVVADPFVFSQTLLPAHFKHNNFSSFVRQLNTYGFRKVHPDRWEFAHASFLRGQTHLLRNIVRRGSSAAGAGGGKRKDASPTELASGDDMTMVATEVVRLKQEQRAIDDRVASMWRRVQETERRPKQMLAFLLKVVGDRDRLHRLVGDAPVPDNGFASGGAAEPPAAEVGEKRARLLLDGDSMVALGPEAVDFAGFYSGGGAFGDVAVDAAAGSRGGGFSFAFGVDAGY

SEQ ID NO: 1560 - protein, 227 aa, Zea mays
MIKRRKPPSAVAPLRQQRAPASCLEVGEFGFEEEIDRLKRDKNILITEVVKLRQEQQSTKDHVRAMEERLRVAEQKQVQMMGFLARAMRNPEFFQQLAQQQDKRKELEDTISKKRRRPIDNTPFYSDGESEQLDSQLKMFESGVLNGLNEPELENLAVNIQELGKGSIDDGNLTQVSDQSELNDDFWAELLVEDFGDKAGQPELEGRTEDVNDLAQQLGYLSSSSPK

SEQ ID NO: 1561 - protein, 257 aa, Zea mays
MDSNRSMATSGVAPFVAKTYRMVDDPATDGVVAWGRDNNSFVVADPFAFSQTLLPAHFKHSNFSSFVRQLNTYGFRKVDPDRWEFAHVSFLRGQTHLLGQIVRRSSGGKRKDDGNGAGAGSADDEDAVAMEVVRLRREQRAIEEQVAAMWRRVQETERRPKQMLAFLVKVAGDPQVLRRLVSGAGGDAVFAAAEPEDGASIKRARLLLDAGSGGDGAVDFSGLYSTTAGSEDDGVGFGSDYLQPPPPYVFPVNSGGY

SEQ ID NO: 1562 - protein, 298 aa, Zea mays
MVEEGATAAASRSGPAPFLSKTHQMVEEPGTDEVISWAEQGRSFVVWKPVELARDLLPLHFKHCNFSSFVRQLNTYGFRKVVPDRWEFANENFRRGEQGLLSGIRRRKSTTPQPSKYGGGSVVNTAFPPPLPFPPPASVTTSGGGGGAGAGNERSSSSASSPPRTDDLTSENEQLKKDNRTLSTELAQARRHCEELLGFLSRFLDVRQLDLGLLMQEDVRAGAGDDAAPRRAMVSQLERGGEEGKSVKLFGVLLKDAARKRARCEEAAASERPIKMIRIGEPWIGVPSSGPGRCGGGN

SEQ ID NO: 1563 - protein, 220 aa, Zea mays
MSVETERSSTESSGASGLDFEDTALTLTLRLPGSAPSAAAAAAASLSLSSSSSSAFPDPDRKRASSDADPGRSSPLAASSDAAPAPKARVVGWPPVRSYRKNALADAAGSGKAAKFVKVAVDGAPYLRKVDLQAYAGYDQLLRALQDKFFSHFTIRKFADDERKLVDAVNGTEYVPTYEDKDGDWMLVGDVPWKMFVETCQRLRLMKGSEAVNLAPRAAR

SEQ ID NO: 1564 - protein, 229 aa, Zea mays
MAWRGPLGAGEEALDSGLELSLGLPAYFARPSGLDAAREEPAEASAYAIQAASGSNVSKARVRPAGAAPVVGWPPVRSFRRNLAASSSRPSSGKHTRQEGSAKDGLFVKINMDGVPIGRKVDLTAYGGYADLSAAVGKLFRGLLAAQRDRAATAGGEEEEEGEGPVIGGDYTLVYEDDEGDRVLAGDVPWEMFVATAKRLRVLKSSDVPASSVTLGAGGPERSAADCCC

SEQ ID NO: 1565 - protein, 203 aa, Zea mays
MGRGRVELKRIENKINRQVTFAKRRNGLLKKAYELSVLCDAEVALIVFSNRGKLYEVLQNSRNEYLKLKAKVDNLQRTQRNLLGEDLGSLGVKELDQLEKQIDSSLSHIRSTRTQHMLDQLTDLQRREQMMCEANKCLRRKLEETSNQVHGQVWEHGANLLLGYERHSSPQQAPSHVGNGLFFHPLEAAAEPTLQIGFAPEHM

SEQ ID NO: 1566 - protein, 245 aa, Zea mays; identical to SEQ ID NO: 1297

SEQ ID NO: 1567 - protein, 223 aa, Zea mays
MVRGKTELKRIENATSRQVTFSKRRNGLLKKAFELSVLCDAEVGLVVFSPRGKLYEFASAASLQKTIDRYRTYTRENVNNKTVQQDIQQVKADAVSLASRLEALEKTKRMFLGENLEECSIEELHNLEVKLAKSLHVIRGKKTQLLEQQISKLKEKERTLLQDNKELRDKRNLQSPPEAPPDLNRCVPPWPRSLPAPSNDMDVETELYIGLPGRERSSNRDSD

SEQ ID NO: 1568 - protein, 226 aa, Zea mays
MGRGKIEIKRIENATNRQVTYSKRRTGIMKKARELTVLCDAQVAIIMFSSTGKYHEFCSPGTDIKTIFDRYQQAIGTSLWIEQYENMQRTLSHLKDINRGLRTEIRQRMGEDLDSLDFDELRGLEQNVDAALKEVRHRKYHVISTQTDTYKKKVKHSHEAYKNLQQELGMREDPAFGYVDNTGAGVAWDGAAALGGAPPDMYAFRVVPSQPNLHGMAYGFHDLRLG

SEQ ID NO: 1569 - protein, 251 aa, Zea mays
MGRGPVQLRRIENKINRQVTFSKRRNGLLKKAHEISVLCDAEVALIVFSTKGKLYEYSSHSSMEGILERYQRYSFEERAVLNPSIEDQANWGDEYVRLKSKLDALQKSQRQLLGEQLSSLTIKELQQLEQQLDSSLKHIRSRKNQLMFDSISALQKKEKALTDQNGVLQKFMEAEKEKNKALMNAQLREQQNGASTSSPSLSPPIVPDSMPTLNIGPCQHRGAAESESEPSPAPAQANRGNLPPWMLRTVK

SEQ ID NO: 1570 - protein, 209 aa, Zea mays
MGRGKIEIKRIENSTNRQVTFSKRRNGILKKAREISVLCDAEVGVVVFSSAGKLYDYCSPKTSLSKILEKYQTNSGKILWGEKHKSLSAEIDRIKKENDTMQIELRHLKGEDLNSLQPKDLIMIEEALDNGLTNLNEKLMEHWERRVTNTKMMEDENKLLAFKLHQQDIALSGSMRELELGYHPDRDLAAQMPITFRVQPSHPNLQENN

SEQ ID NO: 1571 - protein, 245 aa, Zea mays; identical to SEQ ID NO: 1297

SEQ ID NO: 1572 - protein, 354 aa, Zea mays
MGKKKKRVDKVFCYYCDREFDDEKILVQHQKAKHFKCHVCHKKLSTASGMAIHVLQVHKESVTKVPNAKPDRESTEIEIFGMQGIPAHVLAAHYGEEEDPSTKVPKVEVPQVRPVIMPNSLGMAFPPRPAYGVAPPIYNPALNPLMARPPIWPAAPAQAWYPQQAAYPQQSAVSVPPIVAGLPPQQPLFPIQNVPTPMTSAAANVLQTSFPMAPPGVPSPVAPHVSQPLFPVNTSAVNGAVNSPFLASVAPGTIPASSSAAVGVAGIGYGTNNQGTRDPAVGSSPAVSNNKASGAQPATNEVYLVWDDEAMSMEERRLSLPKYQVHDETSQMNSVDAAIDRRISESRLAGRMAL

SEQ ID NO: 1573 - protein, 204 aa, Zea mays
MSFTGTQDKCKACDKTVHIIDLLTADGVSYHKTCFKCSHCKGVLSISSYSSMDGVLYCKTHFEQLFKETGTFSKNFQGGASSNKNDQAKAPSKLSSAFSGTQDKCAACQKTVYPLEKMTLEGESYHKSCFKCSHGGCILTTSSYAALNGVLYCKIHFSQLFKEKGSYNHLIETAQTKKNEAAEAGPEPPADAGAAEPEAPAQSA

SEQ ID NO: 1574 - protein, 286 aa, Zea mays
MGAPKQRWTSEEEAALRAGVARHGVGNWRMILNDPELSSTLRYRSNVDLKDKWRNMNVIVTSSSTRDRGRTSTRRTRAAPKNNDQLLAMSTITSEVDDEIVDVKPIVSMSVEGWNTSNSKKSHSRLDNIIMEAIKNLNEPTGSHRTTIANYIEEQYWPPSDFDHLLSAKLKYLATSGKLLKVNRKYRIAPSLLEDVQREPLKLGSDASRTLTRSQVDAELVRMATMTVEAAAAAAAHAVAEAEAIMAEAEAAAREAEAAEAEARAAQAFAEAAVLTLKNRNAAKLV

SEQ ID NO: 1575 - protein, 278 aa, Zea mays
MGRQPCCDKVGVKKGPWTAEEDQKLVGFLLTHGHCCWRVVPKLAGLLRCGKSCRLRWTNYLRPDLKRGLLSDDEERLVIDLHAQLGNRWSKIAAQLPGRTDNEIKNHWNTHIRKKLVRMGIDPVTHLPLQEPPAPAPAPAEQQEQSHRQQEELQLQELQNGRELIMQEGAGEDDITPMIQPHEIMPTAAAASNCGSVSSAHAGSASVVSPSCSSSAVSGVEWPEPMYLLGMDGIMDADWGSLFPDTGAGGGGGGFDLGVDPFDQYPGGGFDQEDDHRI

SEQ ID NO: 1576 - protein, 302 aa, Zea mays
MGSEADCDRIRGPWSPEEDDALRRLVERHGARNWTAIGREIPGRSGKSCRLRWCNQLSPQVERRPFTAEEDAAIVRAHARLGNRWAAIARLLPGRTDNAVKNHWNCSLKRKLAAASAPAGSSDVDARPTKRVSLSPDSPSGSGSGSGSGSGSDRSDLSHGAGQVYRPVARSGGFEPADCAMSRPLEEEEEEKEDPLTSLSLSLPGTDQRFHHDRAHSQFQELPASPPSPSPPPPPAGPTSAYPFSPVFMEAMQELIRTEVQRYMASVGVRAGCGAAGGADLCMPQLVDGVMRAAAERVGRMQ

SEQ ID NO: 1577 - protein, 356 aa, Zea mays
MGRSPCCEKIGLKKGPWTPEEDQKLLAYIQEHGHGSWRALPVKAGLQRCGKSCRLRWTNYLRPDIKRGKFSLQEEQTIIQLHALLGNRWSAIATHLPNRTDNEIKNYWNTHLKKRLAKMGIDPVTHKSISGTRIGTTNDKSTKAAASLSHMAQWESARLEAEARLARESKIRTATPTPTALHAQPTILPASAASPCLDVLHAWQGAKIDLESPTSTLTFTGSNSGTLPTPRTNRLDVSESNCAVWHQRSDDLEDEENDWQIFSKHQLLELDSKEREEDFIGCEEPWFSEMAGVGAGFTGMLLGVSNEHDASECWGESNNGQTERSNQASDEEDKNYWNGVLDMVNSELTPKSPPFV

SEQ ID NO: 1578 - protein, 475 aa, Zea mays
MPRSGGGGNGGGISSSSRVMPNLPAGFRFHPTDEELMVHYLMRQAASMPCPVPIIAEVNIYQCNPWDLPAKALFGDKEWFFFSPRDRKYPNGARPNRAAGSGYWKATGTDKAILSSSTPTSHGGANIVVGVKKALVFYGGRPPKGTKTDWIMHEYRLSGAADDDCKGSTRRRVSSSSSSSMRLDDWVLCRIHKKSNDFQLSSSSEHEHEQEEPAAGGSATTVEELDALVVVDNSSSSDTTTTTITTNDNNSTETAATHHDPQTMMMLSKSCSLTDLLDSIDYAALSSQMLLLDAPHPHADDPPPHMVYYPPAASATHQQAIIANNTNSNDDYYDDDNLLPTAAATAVDAAAAAVLLSSSPADTNGVNKRKRVTAVDYYGAAEPPTFFHHHLDDGGNSFFSTTKKLKPPPPSDSRHGGHFGTATASSYRDSQQLVDSASSSGVFFHQYGYGYSSSNPFLNLNQQQQLLLNSHIGMQ

SEQ ID NO: 1579 - protein, 174 aa, Zea mays
MAMATSASYPPPPPFYRLYKNFEQDPSSAPEPPPPIDEPFKALGVDYTGDVVIPSLESHNVRQLYPKGPNIDFKKELRTLNRELQLHILELADILVERPSQYARRVEDITLIFKNLHHLLNSLRPHQARATLIHMLESQIRHRKEAIEDIKQRREEAQKVLGESLLILDGSQTN

SEQ ID NO: 1580 - protein, 143 aa, Zea mays
MPVPLAPYPAPPAPFTPPNGAQSQLVCTGCRNLLMYPAGATSVCCAVCSTVTAVPAPGTEMAQLVCGGCHTLLMYIRGATSVQCSCCHTVNLAMEANQVAHVNCGNCRMLLMYQYGARSVKCAVCSFVTSVGTSPGAEQKPSS

SEQ ID NO: 1581 - protein, 241 aa, Zea mays
MASCGAGDAASAQPRASISHVIFDMDGLLLDTEGFYTEVQEKILARYDKVFDWSLKAKMMGKKAAESARIFVDECGLNGLLTPEQFLEERESMLQALFPSCTKLPGVLRLVHHLHANGVPMAVATGSHKRHFALKTQNHQEMFSLMHHVVMGDDPEVKAGKPSPDIFLAAMRRFEGGVEPSKCLVFEDAPSGVAAAKNAGMSVVMVPDPRLDVSYHKGADQVLSSLLDFKPAEWGLPAFKE

SEQ ID NO: 1582 - protein, 401 aa, Zea mays
MYSPSMSAAAVNIYIPQTQSFGLGSVLPPSLHNQVSTGIIDESSSSVNFGDSAIGFMKRKNAVVAGSHNFLHGFAGSSSSVHVPQNPVHGAWNPSSQSNCLPSSAASNLPEYHNSNGWPYLEESSADASNSFSSVAACPELAPHGNYLYPACHISQSNTWVPQPAGYGVPQWGYSNAVVNPPDMSNGPLPHFCQNSMQAPQIQVPHQQSIGNNVVHGLNPSATGLPLHPRMLALPFNAEHTFGHPMHPPLINQANNGALRILPYQNATVMDHSRIYEAGHVIDEHSDMRLDVDNMTYEELVALQEQIGDVNTGLTESYIQENLRSSFHVPGAASMSDQFSELSLENDACIICQEEYKAKELIGTLECGHKYHVNCIKQWLMMKNLCPICKTTALSSDRRNG

SEQ ID NO: 1583 - protein, 324 aa, Zea mays
MSATATDEAAVEARLQELRGRLGKKQHFEEAVNELAAAVRDRYAGASPALRKAMYSTVCRVATVLQTRYTAPGFWHVGLNLFVGIEKLVSNPAEKEHLKTCISRAREHLDEKENEDSVPSNREADTRFLFEGHLTVGQEPPPPAWLVAQNLTRELSILTESSGDQDGSNNRTVPRAEEITPAIMNLLETISGDRDLETALEESLQGIIEYPQRAPPASKEVVANLPVIAVTEEVMSRLGSETECAVCRENLVVDDKMQELPCKHLFHPLCLKPWLDENNSCPICRHELRTDDHVYESRKEREREEEEDRRGAANAVRGGEFIYI

SEQ ID NO: 1584 - protein, 293 aa, Zea mays
MGGAQFPGDNDVAEVDAARDGEVDRRDVGKMKHGCEHYRRRCKIVAPCCNQVFPCRHCHNEATASGDRHTICRQDVEKVVCLLCETKQPVSQVCISCGVNMGEYFCDICKFYDDDTDKGQYHCIDCGICRVGGKENFFHCVKCGSCYSVILRDNHQCVENSMRQNCPICYEYLFDSLQGTRVLNCGHTMHLTCFEEMVAHNKYTCPICSKTALDLTHHWEMLDQEIEATIMPLVYRYKIWVLCNDCNKVSEVNFHVIGHKCSHCRSYNTRTTSRPADLSGSSSPSTDSSDNNI

SEQ ID NO: 1585 - protein, 484 aa, Zea mays
MGLLGMMGDSFGCSATGERLVSAARDGDIQEARALLELNPRLARYSTFGIRNSPLHYSAAKGHHEIVSLLIESGVNINLRNCRGQTALMQACLYGHWKVVQILVLFKANIHRRDCFSGATAIHFAALKGHTRCIRLLVADYVPSLSEFWTIMRGKSTDEMKKGAFDAASLQRLVNGKSDGGVTPLHLAALHGHAESVQLLLDLGASVSEVTVNDGSTIDLIGSGSTPLHYAACGGSAVCCQLLIAAGANMGAQNVNGLTPLLVARSWHKTSIEGILSKQPENRMRILPSPYLCLPLMSIVKIARECGWRKTSASSTCQDPCVICLEVECTVAAEGCGHEFCTKCALYLCSTTSSSTSTRGVPGSISCPLCRHAIVSFMRLTSTTPIKELPWTSASLALCAAGSNTGRPEHGGSLHRRPDLRRLRSISVQLGCSSFRSIGSGKLSSMKLNCTGAEEAVPCLVSCLRPDVQRSSSYRGRIRRYSEF

SEQ ID NO: 1586 - protein, 407 aa, Zea mays
MASLCDFCGKQRSMIYCRSDAASLCLSCDRNVHSANALSRRHTRTLLCDRCGSQPASVRCLEDNASLCQNCDWNGHDAESGASGHKRQAINCYSGCPSSAELSRIWSFITDIPTVAAEPDYEDGLSMMTIDGSDVTNRHDTSDDKRLLEIANTTLMSDPPSADKLKSPTGSSSGDGFDVMTLATDQPAGPVSATPKVPNARDDDKFNDGMYEDLCVDDADLTFEDYEELFGTSHIRTEELFDDAGIDGYFELKETPPFYFNEQPKAMQIECGNVVSADCAMSNPGARADSSLCIPVRQVRSSISHSLSGLTGESSAGDHHDCGVSPMLLMGEPPWHSPGGPEGSVAGGSRDSALTRYKEKKKRRKFDKKIRYASRKARADVRKRVKGRFIKAGEAYDYDPLSQTRSY

SEQ ID NO: 1587 - protein, 554 aa, Zea mays
MADTPTSRMVHPFGDVPRQTPKQFLYSGNPQHLCHPYQSAPDTHVVPQRRYTVRSQSHSPNNAGSQDHETHKQYTLESSAASGCSRHGSPSSQSVHAGSGSPVSHDDSHSGSTNGHGSPVSASCVTGEDPTDLKQKLKDLEAVMLGTSETDPEIVNSLEISAANQLSLEPEEWEHMVSMPRGNLKELLIACARAVERNNSYAIDLMIPELRKMVSVSGEPLERLGAYMVEGLVARLAASGSSIYKALKCKEPRSSDLLSYMHFLYEACPYFKFGYMSANGAIAEAIKGEDRIHIIDFHIAQGAQWVSLLQALAARPGGPPFVRVTGIDDSVSAYARGGGLELVGRRLTHIAGLYKVPFQFDAVAISGSEVEEEHLGVVPGEAVAVNFTLELHHIPDETVSTANHRDRILRLVKGLSPKVLTLVEQESNTNTAPFAQRFAETLDYYTAIFESIDLALPRDDRERINIEQHCLAREIVNLVACEGEERVERHEVFGKWKARLMMAGFSPSPLSALVNATIKTLLQSYSPDYKLAERDGVLYLGWKNRPLIVSSAWH

SEQ ID NO: 1588 - protein, 368 aa, Zea mays
MDRELLETFDAAKKAADAAAGDGNSPEAGRCLDALRRLRDIRVNTDILVSTQVGKRLRPLTKHPHSGIQAVAADLFGYWKKVVLEESGKKNGGSENERSSDSSGKVEKARPVKIEKNSASASMKLEKRDVDVTGQKPNNAKVEKTTSNGSKAQSVKVERISKEVIRTPDAKRPASVPNGHPKLTSLVKCNDPTRDKIRELLAEAFVRVSRETSDDDRDEVRNILDEVEACDPYRVAVTVESALFERLGPSTGTHRAKYRSIMFNLRAENNTDFRRRVLIGLVAPERLPGIPPDEMASDARKQENMQIKEKALFDCERGAAPKATTDQFKCARCGQRKTTYYQLQTRSADEPMTTFVTCVNCNNHWKFC

SEQ ID NO: 1589 - protein, 259 aa, Zea mays
MRIQCDACEAAAATVVCCADEAALCARCDVEIHAANKLASKHQRLPLGDAAALPASLPRCDVCQERPAFIFCVEDRALLCRDCDEPIHVPGTLSGNHQRYLATGIRVGFSSVCGASAEGLPPAPPKGSSKPAAVISAPAAGTTTKTRTVKDALPQEVPSSPFLPPSGWAVEDLLELSDYESSDKKDSSLGLKELEWFEDIDLFHAHSPAKTAMAEFFASPQPVSNAGFYKANGARLFKKSRMEVPDDDDEDYFIVPDLG

SEQ ID NO: 1590 - protein, 448 aa, Zea mays
MGQKDSKPSHGYGYSSYDYGSASSGYTSRNTGNSSSSYSVRYAPSSENSVQPETHARLQRKYSKIGDDYRSLSQVTEALAQAGLESSNLIVGIDFTKSNEWTGKISFNRRCLHDIGNTPNPYEQAISIIGRTLSAFDEDNLIPCFGFGDASTHDQEVFSFYPENRPCNGFEEALDRYREIVPTLRLAGPTSFAPMIETAIGIVDSTGGQYHVLLIIADGQVTRSVDTQSGQLSPQERATIDAIVRASQFPLSIVLVGVGDGPWDMMHQFDDNIPARSFDNFQFVNFTEIMSKSIAADRKEAEFALSALMEIPTQYKATIDLQLLGRRQRITPRIALPPPTRTAYSRSSSFSQQSGVYSRSSSFDQQTSGASQQRSESLKQQKKPAATKRPDTYASERALEDRILCPICMYKSKDLAFGCGHQTCYECGRNLERCPLCQQNITTRIRLY

SEQ ID NO: 1591 - protein, 411 aa, Zea mays
MGQKDSKPSHGYGYSSYDYGSASSGYTSRNTGNSSSSYSVRYAPSSENSVQPETHARLQRKYSKIGDDYRSLSQVTEALAQAGLESSNLIVGIDFTKSNEWTGKISFNRRCLHDIGNTPNPYEQAISIIGRTLSAFDEDNLIPCFGFGDASTHDQEVFSFYPENRPCNGFEEALDRYREIVPTLRLAGPTSFAPMIETAIGIVDSTGGQYHVLLIIADGQVTRSVDTQSGQLSPQERDTIDAIVRASQFPLSIVLVGVGDGPWDMMHQFDDNIPARSFDNFQFVNFTEIMSKSIAADRKEAEFALSALMEIPTQYKATIDLQLLGRRQRITPRIALPPPTRTAYSRSSSFSQQSGVYSRSSSFDQQTSGASQQRSESLKQQKKPAAPKRPDTYASERALEDRIVSVPHLHV

SEQ ID NO: 1592 - protein, 423 aa, Zea mays
MERYSDMRPKAEVSYLGRGSRFSSRNQSSEERTNHSSDKPGSSTRFNPTKARIGGNQGRPRYVCDSFKSPSSKVSPAGSSKFPLSKFEERRRQPFVPGFDIAESSRRKADAKQLQGSKKIAAENDSSDNLRGESEGFTTEQVVKPEGSHVVGHSGVSAYTVGSLVQTASLGSRTHRQKHKEVNLGTPGASSSTLTNRSTIPGNSTMGVRPAYGHVNGGQIHGLKNLGCSSVPDAQPSGCPSESVISRRRFEFMRKRAFDQESSSRSVNLSLGHSTPTDIRRIRMNEQSLCQQIPRSSSRSHQESAGSVRTRRPSPHATRMSVPDGRADGVLSLHESSTKDVQPAQEHLSLEEVSTESSIRPFFVEFDNNIFSSSHLRRSSTRAERGRPSSLFEESPRQMFHSLMGERDRHRHITMEGITEVAF

SEQ ID NO: 1593 - protein, 358 aa, Zea mays
MDGSRKRVDAEDVKGDSTGGKRLRASESFQSGVGSKVKLCTNFFSTYGCPFGEGCHFVHYFPGDYRAVSEMTNLGGATIAPPGGMMMDGPPTPIVKTRLCNKYNTAEGCKWGDRCHFAHGESELGKSMMDNYMPPPIGPPPTGYFAPPPMAPPPMAPPPMAPPPMAPLPMAPPPMAPPPMAPPPMAPPPMAPLPMAPPPMAPPPMAPPPMAPPPMAPLPMAPPPMAPPPMANPGLATPASFGAYATAKISVDASLAGGIIGKGGANIKQISSVTGAKVVIQEDRHESDTSLKNIEFEGTFDQIRNASAMVIELIVSISGIGSNFKTKMCENFAKGSCSYGGKCHFAHGESELRKPAAA

SEQ ID NO: 1594 - protein, 226 aa, Zea mays
METVVGDLMATELRLGLPGTVDDCSQPQLVKATPPSTPRGKRRATADAVEEAAGAEEASKRDAETAPPAAKAPVVGWPPVRSYRKSCFQQASSKQAAAAKQEAAAAAPGCTASSAAATNTTSSSSAAVVVGSFVKVSMDGAPYLRKVDLRMYRGYRELREALEALFVSSSSANNLSEFAVTYEDKDGDLMLVGDVPFEMFASTCKKLRIMKRSEATGLGSSSARQQ

SEQ ID NO: 1595 - protein, 205 aa, Zea mays
MRTICDVCESAPAVLFCAADEAALCRPCDEKVHMCNKLASRHVRVGLADPNKLARCDICENSPAFFYCEIDGTSLCLSCDMTVHVGGKRTHGRYLLLRQRVEFPGDKPGHMDDVPMEIKDPENQREQNTPKEQMANHHNVNDPVSDGNCDGQGNIDSKMIDLNMRPARTHGQGSNSQTQGVDLSVNNHDSPGVVPTSNSERDAIK

SEQ ID NO: 1596 - protein, 257 aa, Glycine max
MADSSREENVYMAKLAEQAERYEEMVEFMEKVAKTVEVEELTVEERNLLSVAYKNVIGARRASWRIISSIEQKEESRGNEDHVAIIKEYRGKIEAELSKICDGILNLLESNLIPSAASPESKVFYLKMKGDYHRYLAEFKTGAERKEAAESTLLAYKSAQDIALADLAPTHPIRLGLALNFSVFYYEILNSPDRACNLAKQAFDEAISELDTLGEESYKDSTLIMQLLRDNLTLWTSDITDDAGDEIKETSKQQPGE

SEQ ID NO: 1597 - protein, 117 aa, Glycine max
MADSSREENVYMAKLAEQAERYEEMVEFMEKVAKTVEVEELTVEERNLLSVAYKNVIGARRASWRIISSIEQKEESRGNEDHVAIIKEYRGKIEAELSKICDGILNLLESNLIPSAA

SEQ ID NO: 1598 - protein, 120 aa, Oryza sativa
MSPAEASREENVYMAKLAEQAERYEEMVEFMEKVAKTTDVGELTVEERNLLSVAYKNVIGARRASWRIISSIEQKEESRGNEAYVASIKEYRSRIETELSKICDGILKLLDSHLVPSATA

SEQ ID NO: 1599 - protein, 253 aa, Sorghum bicolor
MSREENVYMAKLAEQAERYEEMVEYMEKVAKTVDVEELTVEERNLLSVAYKNVIGARRASWRIVSSIEQKEESRKNEEHVAQIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDTLGEESYKDSTLIMQLLRDNLTLWTSDITEEGTEEGKEASKGDAE

SEQ ID NO: 1600 - protein, 115 aa, Sorghum bicolor
MSREENVYMAKLAEQAERYEEMVEYMEKVAKTVDVEELTVEERNLLSVAYKNVIGARRASWRIVSSIEQKEESRKNEEHVAQIKEYRGKIEAELSNICDGILKLLDSHLVPSSTA

SEQ ID NO: 1601 - protein, 262 aa, Oryza sativa
MSAQAELSREENVYMAKLAEQAERYEEMVEFMEKVAKTVDSEELTVEERNLLSVAYKNVIGARRASWRIISSIEQKEESRGNEDRVTLIKDYRGKIETELTKICDGILKLLESHLVPSSTAPESKVFYLKMKGDYYRYLAEFKTGAERKDAAENTMVAYKAAQDIALAELPPTHPIRLGLALNFSVFYYEILNSPDRACNLAKQAFDEAISELDTLSEESYKDSTLIMQLLRDNLTLWTSDISEDTAEEIREAPKRDSSEGQ

SEQ ID NO: 1602 - protein, 120 aa, Oryza sativa
MSAQAELSREENVYMAKLAEQAERYEEMVEFMEKVAKTVDSEELTVEERNLLSVAYKNVIGARRASWRIISSIEQKEESRGNEDRVTLIKDYRGKIETELTKICDGILKLLESHLVPSST

SEQ ID NO: 1603 - protein, 249 aa, Zea mays
MTETREINVFMAKLAEQAERYDEMVEAMKNVADLGQELTVEERNLLSVAYKNVIGARRASWRIITSIEQKEESKGNTAHVERIKEYRKKVENEVSKICADVLGTLDNKLIPNAQTTESKVFYYKMKGDYHRYLAEFATSEARKEAADNSLAAYKSATDIANSELAPTHPIRLGLALNASVFYYEIMGSPKQACELARKAFDDAIAELDQLNEESYKDSTLIMQLLRDNLTLWTSDLEGDKADAEPEAAN

SEQ ID NO: 1604 - protein, 116 aa, Zea mays
MTETREINVFMAKLAEQAERYDEMVEAMKNVADLGQELTVEERNLLSVAYKNVIGARRASWRIITSIEQKEESKGNTAHVERIKEYRKKVENEVSKICADVLGTLDNKLIPNAQTT

SEQ ID NO: 1605 - protein, 116 aa, Glycine max
MTASKDRENFVYIAKLAEQAERYEEMVESMKNVANLDVELTVEERNLLSVGYKNVIGARRASWRILSSIEQKEETKGNELNAKRIKEYRQKVELELSNICNDVMRVIDEHLIPSAA

SEQ ID NO: 1606 - protein, 257 aa, Oryza sativa
MAPSDDLVYMAKLAEQAERYDEMVEAMNSVAKLDEGLTKEERNLLSVGYKNLIGAKRAAMRIIGSIELKEETKGKESHVRQTAEYRRKVEAEMDKICCDVINIIDKYLIPHSSGAESSVFYYKMKGDYYRYLAEFKTGTEKIEVSELSLNAYETASKTAQTDLTPTDPIRLGLALNISVFYCEIMNSPDKACQLAKNAFDEAVAELPSLSEENYKDSTLIMQLLRDNLALWNSDMADDADDIRERTDTTGAKGDPAA

SEQ ID NO: 1607 - protein, 115 aa, Oryza sativa
MAPSDDLVYMAKLAEQAERYDEMVEAMNSVAKLDEGLTKEERNLLSVGYKNLIGAKRAAMRIIGSIELKEETKGKESHVRQTAEYRRKVEAEMDKICCDVINIIDKYLIPHSSGA

SEQ ID NO: 1608 - protein, 259 aa, Glycine max
MAAAPSPREENVYMAKLAEQAERYEEMVEFMEKVSAAADNEELTVEERNLLSVAYKNVIGARRASWRIISSIEQKEESRGNEDHVSVIRDYRSKIESELSNICDGILKLLDSRLIPSASSGDSKVFYLKMKGDYHRYLAEFKTGAERKEAAESTLSAYKAAQDIANAELPPTHPIRLGLALNFSVFYYEILNSPDRACNLAKQAFDEAIAELDTLGEESYKDSTLIMQLLRDNLTLWTSDMQDDGADEIKEAAPKQDDQ

SEQ ID NO: 1609 - protein, 120 aa, Glycine max
MAAAPSPREENVYMAKLAEQAERYEEMVEFMEKVSAAADNEELTVEERNLLSVAYKNVIGARRASWRIISSIEQKEESRGNEDHVSVIRDYRSKIESELSNICDGILKLLDSRLIPSASS

SEQ ID NO: 1610 - protein, 259 aa, Triticum aestivum
MAKAAATREEMVYLAKLAEQAERYEEMVEFMEKVVAAAGTVELTIEERNLLSVAYKNVIGARRASWRIVSSIEQKEEGRGAAGHAAAARGYRALVEAELSNICAGILRLLDERLVPAAAAVDAKVFYLKMKGDYHRYLAEFKSAAERKDAADSTLGAYQAAQDIAMKELPPTHPIRLGLALNFSVFYYEILNSPDRACSLAKQAFDEAIAELDSLGEDSYKDSTLIMQLLRDNLTLWTSDMQDDAGDEMRDSSKPEDEQ

SEQ ID NO: 1611 - protein, 119 aa, Triticum aestivum
MAKAAATREEMVYLAKLAEQAERYEEMVEFMEKVVAAAGTVELTIEERNLLSVAYKNVIGARRASWRIVSSIEQKEEGRGAAGHAAAARGYRALVEAELSNICAGILRLLDERLVPAAA

SEQ ID NO: 1612 - protein, 266 aa, Zea mays
MSPSEPTREESVYMAKLAEQAERYEEMVEFMERVARSAGGAGGGEELSVEERNLLSVAYKNVIGARRASWRIISSIEQKEEGRGNEAHAASIRTYRSKIETELARICDGILALLDSHLVPSAGGAESKVFYLKMKGDYHRYLAEFKSGAERKDAAESTMNAYKAAQDIALADLAPTHPIRLGLALNFSVFYYEILNSPDRACNLAKQAFDEAISELDSLGEESYKDSTLIMQLLRDNLTLWTSDTNEDGGDEIKDAAAPKESAEGQ

SEQ ID NO: 1613 - protein, 125 aa, Zea mays
MSPSEPTREESVYMAKLAEQAERYEEMVEFMERVARSAGGAGGGEELSVEERNLLSVAYKNVIGARRASWRIISSIEQKEEGRGNEAHAASIRTYRSKIETELARICDGILALLDSHLVPSAGGA

SEQ ID NO: 1614 - protein, 448 aa, Zea mays
MALLVRRARRAATKAAVSLAGRTGSVELAIPAHFRCPISLDLMRDPVTAPAGITYDRESIEAWLDTGRATCPVTHAPLRHEDLVPNHAIRRVIQDWCVANRSRGVERIPTPKIPVTPVQASELLFDLAGSARRRDAAARCAEVVTKIKVLARDSERNRRCFASIGTGRVLAAAFESLAAAAAADAAAPAGRVLEDILAALVCMMPLDEEAARTLALPTSLGSLVAIAENGSLAGRLNAVLAIKEVVSCDGAVTDLSGKADEIVDALAKIIKSPICPQATKAGMVATYHLALYDERVAARLAAAGLVPVLVEVLVDADKSMSEKALAVLDAVLASEEGRASARAHALAVPMLIKKMFRVSDLATQLAVSAMWRLGKAHSDGEDDGAVTRCLVEALGVGAFQKLLLLLQVGCRDATKEKATELLKLLNKYKSVGECVDAVDFRGLNKLSS

SEQ ID NO: 1615 - protein, 431 aa, Glycine max
MVLSWSRRNVFRRAKKEKSQTQLEVEVVIPNHFHCPVSLELMTDPVTLSTGITYDRVSIEKWIEGGNRTCPVTNQVLTTFDIIPNHAIRRMIQDWCVENSSYGIDRIPTPRIPISAYEVSDTCTRILSACQRGDDKRCQELVGKIKVWSRESERNKRCIVGAGAGAVLAYAFDCFSSNSIEKHVVLLEEVLEVMTWMVPLGEEGVSKLSSGASLNSLVWFLEGKDLASRQSAALLLKEVCVQELAKVGEVVEALVKMVREPIGSTSTKACLATIFNLVSLAANREGIAQRFVELGLVSLLLEAIVDGEKGVCEKALGVLDCICDCEKGKEVVKSNALALPLVVRKLLRVSPLASGFAVSILRKICDKREEGILIEALQVGLFQKLLVLLQVGCDESPKENATGLLKLLNGYRNKAECTDSSLNFEHLKKPF

SEQ ID NO: 1616 - protein, 971 aa, Zea mays
MIVQPIELRAWTAFPGSAQEGIGRMAASVSRAICVQKPGSKCTRDREATSFARRSVAAPRPPHAKAAGVIRSDSGAGRGQHCSPLRAVVDAAPIQTTKKRVFHFGKGKSEGNKTMKELLGGKGANLAEMASIGLSVPPGFTVSTEACQQYQDAGCALPAGLWAEIVDGLQWVEEYMGATLGDPQRPLLLSVRSGAAVSMPGMMDTVLNLGLNDEVAAGLAAKSGERFAYDSFRRFLDMFGNVVMDIPRSLFEEKLEHMKESKGLKNDTDLTASDLKELVGQYKEVYLSAKGEPFPSDPKKQLELAVLAVFNSWESPRAKKYRSINQITGLRGTAVNVQCMVFGNMGNTSGTGVLFTRNPNTGEKKLYGEFLVNAQGEDVVAGIRTPEDLDAMKNLMPQAYDELVENCNILESHYKEMQDIEFTVQENRLWMLQCRTGKRTGKSAVKIAVDMVNEGLVEPRSAIKMVEPGHLDQLLHPQFENPSAYKDQVIATGLPASPGAAVGQVVFTAEDAEAWHSQGKAAILVRAETSPEDVGGMHAAVGILTERGGMTSHAAVVARGWGKCCVSGCSGIRVNDAEKLVTIGGHVLREGEWLSLNGSTGEVILGKQPLSPPALSGDLGTFMAWVDDVRKLKVLANADTPDDALTARNNGAQGIGLCRTEHMFFASDERIKAVRQMIMAPTLELRQQALDRLLPYQRSDFEGIFRAMDGLPVTIRLLDPPLHEFLPEGNIEDIVSELCAETGANQEDALARIEKLSEVNPMLGFRGCRLGISYPELTEMQARAIFEAAIAMTNQGVQVFPEIMVPLVGTPQELGHQVTLIRQVAEKVFANVGKTIGYKVGTMIEIPRAALVADEIAEQAEFFSFGTNDLTQMTFGYSRDDVGKFIPVYLAQGILQHDPFEVLDQRGVGELVKFATERGRKARPNLKVGICGEHGGEPSSVAFFAKAGLDYVSCSPFRVPIARLAAAQVLV

SEQ ID NO: 1617 - protein, 499 aa, Zea mays
MTATPAVIGLSARGNRLLATSFGSAELAPPDAYPSRQFAAAAPKLTVVAHRASASASSPADIGGAGHARAHAIRALRNHSAPALAPPPPADPAPELDSKFEFEFESSLEAIVLLQRSMLEKQWELPFEDDISSTEDEDEDERSTVVVARSGVSARQRRMSGRRRGAVVGRKSVTVSPELMQSRNRIYLRGTVSKDLLTHKQVVQLSRKIKDGIWLQHQRSKLKEKLGNEPSYKQLAQSLRIPAPELRARMRESFLAREMLAMSNTRLVISIAQKYDNLGVELPDLIQGGLIGLLRGIEKFDASRGFRISTYVYWWIRQGVSRALADNSRSFRLPTYLHERLVAIRGAKYALEDQGIAPTVENIAESLNISEKKVHNATEAVHKVISLDQQAFPSLNGLPGDTLHSYIEDQNVANDPWHGFEERYLKEEVNSLINSTLNERERDIIRLYHGIGKQCHTWEDISRQFGLSRERVRQVGLVAMEKLKHAARREHLDALLEEY

SEQ ID NO: 1618 - protein, 550 aa, Zea mays
MNSSRSLLSSPLFASSSPNFRSSASVSSSPSPSRTTAVPMIHDTSSSRASTACHYSPSLVAEEQLHGSKDTLTLKGEKALLELLLGMALDQHVDGRKLITQQEAEDSDFESYLREATSRVLYQPTFMYGASEFISSEEDDDDSISESSSASLAKPAGTLDLGKLTEEPQLDVPQPHRRSVDPNHSYDQVFIRSTRLLERRSKKRNGGHRALDNGVACSGVNSKRKDKFGRVLDPDEPFRLFLRDRETTEFLTAKEEKQMFSQIQDLMKLEEAQRNLQAQCGREPTVEEWAQAVGMSCRELQSCVRTGRRCREKMARSNFRLVIHVARKYEGCGLDIQDLVQDGCCGLMKTFEKFNPSKGCRFPTYAYWWIRQSIKKSIFKNSRLIRLPESVYALLRKVGKARMECIMDGEQPTNEVVARRAGITIEKLAKLRAKTRKVRSMQDRVWSDDGVTYQEITEDPNIEGPEVSVDRLMMRQQVRSFLAGILSPREKEIIEHRFGIHDGQPKTLHVIGDMYGLSKERIRQVQNKALDKLRNSISAQGFHVYFDLLT

SEQ ID NO: 1619 - protein, 539 aa, Zea mays
MACLAPQFKWAPSAAAHMPSSSSSSSYSRCSALRVHCAVTSAAVVEDRTNGSAAQLRLAYAAPAIQRNFEATLASEALLNEEAVVAAAAAEAVALARAAAEAAQEVVQIVQRNNHQPVIRPKKCVDNYLANEILRTEMRSSSPDMYANNPLMEYLDSYGIMDAEDELDAYAQYTENIAVKSARQSERKARRTRAAIKASTTLHASQKVALSSKKKRSKGSSSSMNPLGSLWKMTGRRLLTAKEEVEFSEGIQDLLKLEAIQAELIEYNGGQPTFSQWATAAGVDEKTLRKRLNYGIYCKNRMVTSNVRLVISIAREFEGPGMDFYDLIQEGMQGLIRGAEKFDSSKGFRFSTYSHWWIKQAMRKSVSEQSQIFRLPAHMVEASYRVKECTKRLRRKLRRRPTNEEIAVDTGIPIKRVEAAVNLPKYSVSLDSKIGSTDMTYQEVTADPSAETAEEMLNRMSMKKDVHMALDTLTTREKQVVVLRFGLEDGRIRTLQEIGNIMGVSRERIRQIESGAFRKLRSKKKVKALKDYLVPVGNW

SEQ ID NO: 1620 - protein, 609 aa, Emericella nidulans
MYLSTVLFPLLALNLGLSHARFVRETLELTWEYGSPNGGTPREMVFTNGEYPGPDLIFDEDDDVEVLVINNLPFNTTVHWHGLEMRETPEADGVPGLTQTPIEPGATFTYRFRAYPAGTFWYHSHYKGLMQDGQVGAMYIRRKPDALRPYAVITEDPRELAEIQYAEDNPYLMLATDWTYLTSAEYHNIEVESGYNVFCVDSLLINGRGSVYCPGYQYLEEVSDTALLSVLEGTHLTEKGCLQPDLHNVQGDYGPWNLSAVPTEVVFNCTPSSVEPPVIYVDPEFNGWVSLNFIGGAAQKAITFSVDNHPMWVYEVDGQFVEPREVEMVGVYSGARYAVMIKLDQTPGDYAIRIAVNGADQVMSVYAILSYVNQDWIHRENVPKAAIGPHTDTVGYMNYGGGNTSADVRQLLFTENLPAFAVPPPPPSSEVSTTLRTGMIRVNNSYSWSLGNNVLYEPEMTSSTPLLFEPDPLAVIAPKYALTTENNTWVDIVLEITADPRDLIHPPHPIHKHGNRAYIIGNGVGKFRWENVSAAEAEVPDLFYVNETAALRDTFVTDFFDSRLMDGAWIVIRYFVQDKFPSILHCHIASHQMGGMALALLDGVDVWDS

SEQ ID NO: 1621 - protein, 258 aa, Xylella fastidiosa
MTQSRWRLDGRTALITGASTGIGLAVARELLGLGADVLLVARNADLLGRVRDELAEEFPERELHGLAADVADDVDRRAILDWVEDCSNGLHVLINNAGGNVTRAALEYTEDEWREIFEINLFSAFELCRYTQPLLACHASTAIVNIGSVSGLTHVRSGVPYGMSKAALHQMTRNLAVEWAEDGIRVNAVAPWYIRTRRTSEPLSDVYYYEQVIERTPMRRIGEPEEVAAAVAFLCLPASSYVTGECIAVDGGFMRYGF

SEQ ID NO: 1622 - protein, 263 aa, Zea mays
MAPGGSGERWSLAGATALVTGGSKGIGQAVVEELARLGARVHTCARSAADLEECRRRWAEKGLRVTVSVCDVAVRADRERLVLDTVSAAFDGKLDILVNNAALLLLKPAAEWAAEDYARIMATNLESCLHISQLAHPLLLNASVAGGASIVNVSSIASVLGFPQEVMYSVTKGGLNQMTRSLAVEWACDRIRVNCVAPGVIMTDMGKELPAALVEQERSRIPLRRTGEPEEVASLVSFLCMPAASYVTGQVIFVDGGRTISGA

SEQ ID NO: 1623 - protein, 269 aa, Glycine max
MAAEANFDSKSSRWSLQGMTALVTGGSKGIGYAIVEELAQLGATVHTCARNEAELNKSLNEWNTKGYRVTGSVRDVASRAERQDLIARVSNEFNGKLNILVNNVGTNIQKETLDFTEEDFTFLVNTNLESCFHLSQLAHPLLKASEAANIILISSIAGVVASNIVSVVYGATKGAMNQMTKHLACEWAKDNIRTNCVAPGPIRTPLGDKHFKEEKLNNSLIARTPLGRIGEAEEVSSLVAFLCLPAASYITGQTICVDGGFTVNGLYIS

SEQ ID NO: 1624 - protein, 271 aa, Glycine max
MANPEGSSRGSRWSLKGTTALVTGGTRGIGHAVVEELAEFGATVYTCSRNEEELNACLKEWKEKGFSVSGLVCDASSPPHRENLIQQVASAFNGKLNILVNNVGTNVRKPTIEYTAEEYSKLMATNLDSTYHLCQLAYPLLKASGNGSIVSISSVASQTSVGSGAIYAATKAAIDQLTKYFACEWAKDNIRSNGVAPWYTITSLVEPLLANKQLVSEIISRTPIKRMAETHEVSSLVTFLCLPAASYITGQIVSVDGGFTANGFQPSMRIS

SEQ ID NO: 1625 - protein, 262 aa, Emericella nidulans
MSDAYGGLSLRWTLRGKKALITGATKGIGLAVANEFLSLGAEVIIVARNSQDVDQQLIIWRELGLPAYGITADVATAEGRQAIFEQVGKTWDKLDILVNNVGTNISKKVLDYTAAEYQFIIQTNQISIFEMCRLFYPLLQNRENSSIVNISSVAGLVSNRTGAPYGMTKAAINQLTRSLSVEWACDQIRVNTVAPWAIRTPLTESVLDNQDFLKLVLSQTPMGRVGQPEEVAGLVAFLCMPAASFITGQCITVDGGFLAFGF

SEQ ID NO: 1626 - protein, 301 aa, Arabidopsis thaliana
MAKEGGLGENSRWSLGGMTALVTGGSKGIGEAVVEELAMLGAKVHTCARDETQLQERLREWQAKGFQVTTSVCDVSSRDQRVKLMETVSSLYQGKLNILVKYTYISFVLLGIGIHKNPIMLCFLLWIYTYVGQQCGNVNIKPTTEYTAEDFSFVMATNLESAFHLSQLAHPLLKASGSGSIVLISSAAGVVHVNVGSIYGATKGAMNQLARNLACEWASDNIRTNSVCPWYITTPLSNDFFDEEFKKEAVRTTPMGRVGEANEVSPLVAFLCLPSASYITGQTICVDGGATVNGFSFKTMP

SEQ ID NO: 1627 - protein, 260 aa, Oryza sativa
MATASSINKRFSLAGATALVTGGSKGIGRAIVEELASFGATVHTCARNQAELSRCQEEWTAKGLAVTVSVCDVAVRADREALAGRVSAMFDGKLSILVNNAGTAYLKPAADLTPEETSRLMTTNFESCFHLSQLFYPLLKDSGRGSIVNISSVASVLAFHSLPIYSAAKGAMNQVTRNLACEWASDGIRVNSVAPGYIQTPLLTAFVAGNDFAQVEFNRLPLGRLGKPEDISSLVAFLCMPAASYITGQIICVDGGRMLS

SEQ ID NO: 1628 - protein, 661 aa, Glycine max
MEGENASKVIELVNEIASISEYRPPVKKQYCNLARRLKLLIPMFEEIRDMNKDALPEDTSNAVLAFKEALQSARELLRFGSEGSKLYLVLERDDIMNKFYEVTAQLEQSLGGISHDKLDISDEVKEQVELVLAQFRRAKGRVDEPDVRLYEDMLSVYNSSSDAATDPSVLSQLAEKLQLMGIADLTQESLALHEMVASSGGDPGARIEKMSMLLKKIKDFVQIENLVKDDNLGGKGIFSKVYGLGTNEKSHQAPVIPDDFRCPISLELMKDPVIVSTGQTYERTCIEKWLQAGHGTCPKTQQTLTSTVLTPNYVLRSLIAQWCEANGIEPPKRPSDSQPSKSASAYSPAEQSKIESLLQKLTSVSPEDQRSAAGEIRLLAKRNADNRVAIAEAGAIPLLVGLLSVPDSRTQEHAVTALLNLSIYENNKGSIVSSGAVPGIVHVLKKGSMEARENAAATLFSLSVIDENKVTIGSLGAIPPLVTLLSEGNQRGKKDAATALFNLCIYQGNKGKAVRAGVIPTLMRLLTEPSGGMVDEALAILAILASHPEGKATIRASEAVPVLVEFIGNGSPRNKENAAAVLVHLCSGDQQYLAQAQELGVMGPLLELAQNGTDRGKRKAGQLLERMSRLVEQQQEVPIQTETQAQNEDTQPPLITNPDDS

SEQ ID NO: 1629 - protein, 431 aa, Glycine max; identical to SEQ ID NO: 1615

SEQ ID NO: 1630 - protein, 676 aa, Glycine max
MTQRDRRTLSFPAVHPCEAISPPTLVTSLITLSQSICNFQPQSFPTQRRNARETIRQISIVLMFLQEIRLIPNSTILSLAELHFTLQKIHFLLQDCTLQGSRLLLLAKSQHVASLFPALLRSVATSLDVLPLHQLHLCPEVRELADLVTKQASKAKFQLDPSDARATKTLHTLLRQFSMGTEPDLTSMQGILHYLQIRTWTDCNTEIKFLEEEITLECRDREEKEVPLLSSLVGFLCYCRGVIFETNQSQGRCSTEMTSLNLTLLTSVNPDDFRCPISLELMTDPVTVSTGQTYDRASIQKWLKAGNTNVPKTGEKLTNTDLVPNTTLKRLIQQFCADNGISVANSCNRKTNTVSAGSPAAAHAIQFLAWFLTRRLAFGTQDQKHKAAQEIRFLARTSIFNRACLIEMGTVPPLIELLASASNDNKSTQETTISALLKLSKHPNGPKNIINSGGLTVILSVLKNGLSLEARQVAAATIFYLSSVKEFRKLIGENPDVIPALVELVKEGTTCGRKNAVVAIFGLLLLPRNHQRVIAAGAVPALLDIIASSNKDELVTESLAVLAALAENVDGAREILQGSALRLIVGMLRSATSREGKEHSASILLSLCVNVGAEVVAVLAKEPSLMPLLYSLLTDGTCHAAKKARFLIKVIQDFHETRSAGLKGSSLPQERSLHVW

SEQ ID NO: 1631 - protein, 526 aa, Zea mays
MICAISGEVPDEPVVSKKSGLLFERRLIERYIEDHGKCPITKDELTMDDIVPVNTNKVVKPRPLQAASIPGLLGIFQNEWDALMLSNFALEQQLHTARQELSHALYQHDAACRVIARLKKERDEARALLAQAERQIPASVAGAAPAAVVSNGKRAMEDEIGPDGKKIRPGINPVMIDELTECNTMLSAQRKKRQVPPTLAPLDALERYTQISSHPLHKTNKPGILSMDVHPSKDVVATGGIDTNAVIFDRSSGQILCTLTGHSKKITTLKFVPRDQLFVTGSADKTVRIWQENENGNYNCVHTLKDHTAEVEAVTVHATQKYFVSASKDNSWCFYDISTGSCLTQVGEASGQEGYTSASFHPDGLILGTGTTDAVVKIWDVKTQSNVAKFEGHVGPVTAMSFSENGYFLATAAHDGVKLWDLRKLRNFRTFSPYDSDTPTNTVEFDFSGNYLAIGGSDIRVYQVANVKAEWNLIKTLPDLSGTGKVTSVKFGADAKYIAVGSMDRNLRIFGLPGDDQMEESTTAAE

SEQ ID NO: 1632 - protein, 360 aa, Zea mays
MEAWPDDFRCPITLEVMTDPVILPSGHTFERRSIQSWLDGGHLTCPVTNLPLPPSPPLIPNHALRRLIAAVSPSAAASLVPAEGGAHARQEAVSAAAAAAVPARPASPVPALLRLAKSGAAGRKEVLESGSAAVLLRHAEAGDEAAARALLHLSLDGDDTRVGLVADGAVDALSAAVSRGGAAAASAATALTSLATVDVNKCTIGAHPSAIPALAGLLRRGGPRERREAATALYELCKLPENRRRAVREGAAPALADFAAAGSARAVEVLGLLARCREGRQELCRVPGVVSVLTGAAGSGNARAIEQALLVLNWICSESNELAVEAIKLQAFDLCEALVNDDNCKIAKNAVDLARTLEKA

SEQ ID NO: 1633 - protein, 477 aa, Glycine max
MWSSTSSTAAIPSDEEPSESSSSSSFSTSLFNFSSGNPRIEETRGLMHLFPDDTPSTLPVGRKPLVCVVGVPNHMTYADFCQFCGSFIQHMLEMRIVRMDGMEDQYSVLVRFDDQDSTDSFYKHYNGRRFSSLEVEVCRVLFTLDVQYTGSIEHAQPSNATSTELPTCPVCLERLDQDTGGILTTICNHSFHCSCISKWADSSCPVCRYCQQQAEKSICFVCQTTENLWICVICGYVGCGRYKGGHAIIHWKETQHCYSLEVETKRVWDYVGDNYVHRLIQSKTDGKLIELNTQCAHADNGCGSCSCEDNAMNEAILNSKVEAIVNEYNELLATQLENQKLYFESLLQEVKEESERKISKAVQKAISLKQQKIQSKIDRCKKEKKFLDDLNENLVKNEDIWKTKILAIEEREKKTTRLMGDRVADLEMQLGDLMVCLEGGRTVEQLAASDEIKEGIILDKSIESSTTSGSDLVGRDA

SEQ ID NO: 1634 - protein, 473 aa, Zea mays
MAGEEAAEGSGTRRHMDLNLYLGLPPLPRPPVWLDPTLMPNLTGAAPESSITGEPEESLALGAAAYSPSNALSTPEEHPMLDPIVYSWLDGNRTDGEEDTDAPEPGPVDGANVSRSQLVVAATGLEGDDDLPLVRFVRPSQMVVAGGMETVNTSILQQSIQRAAAIEARTPELRFQRVIQISQQHRIVRPASVNRSQGAASTDADRLVWAIQRTHNSLEATRRQKLDDNNLCGNGSAKKDESCDCNSSFECNICLDPAKQPVVTPCGHLFCWPCLYQWLHAHSPHSECPVCKGEVLELNVTPIYGRGGEEGNSTNPDFPPRPRANRRESLRQQLQMTDTRGIATVVRQLIQNQGIISVLPSPTGIEMSVVPAGRQRARARRQQRQDNNASSSIHVVAQNMGNVAPESSNQIQLSHSNGDNAAQMVLAAPQQSSSVEQLSTSSTTAVILGEPGSSRRSRPSESPTIRRTRRRPQ

SEQ ID NO: 1635 - protein, 371 aa, Zea mays
MDEGQGVRYWCHMCQEVIDPMPEMKCPGCEGGFVEEMDSEDFEPAANARSDRSVSLLAPLLLGMMGGSSRRSRLRREAMVEADADQDDEEDDSDHELELSRRRRRRRRSSALFSVLEAMRDRDEVRGSDDTDSDTERDLERGRRERMERQRERLRQIERVSARGRERTESLILINSNNEAIILQGTFGSDDNQEDSSNTSSGVSLGDYFLGPALDTLLQRLAESDLSRSGTPPAKKEAVAALPTVNIEEALGCSVCLEDFEMGGEAKQMPCQHKFHSHCILPWLELHSSCPICRFQLPTEETKNNPCESASTAGTVNGGGDNAAASGSDTESTNHNEDDHSDSPIFSALSTLFSDPFSSDDDESVPHSYEN

SEQ ID NO: 1636 - protein, 325 aa, Zea mays
MSNRATHWCYACRRPIRLRGQDIVCPNCNDGFIQEISEMGGILNTYGLIEPDFEERRARRFGMMDAMSSLMRQRMEEMGRDGLFDIRGRQGTGTEYGRRPTAVPTLVFGGIPSPGVDSGDVNVVLRGGRRVGAAQPNFSSLVVGPSLEALFEQLLLQNNRQGPAPAPQSAIDSMPVVKINRRHLDDDPQCAVCKDKFEVGAEAREMPCKHLYHTDCIIPWLVQHNSCPVCRHPLPSQRSGSTSSARPSAYYNEAADPPGVTRADLEPAPRDGGRESQERRRSFSFLWPFGPSSSRSSSYQYEQNVDEPAVYDPNQIAYSEWHYDH

SEQ ID NO: 1637 - protein, 358 aa, Zea mays
MHISLFNHSALLTPFVSVQAGRIWRMTEAAVTRYWCHGCVRVVEEAMGEEIKCPFCGGGFIEEMIGEEFDGLASQQSERDSSQWGASNNPFEQPRAEADSEDEEDDDDYDDDIGRAFESFIRRHGRPSALRRAFDSIQDDLRADRDSDFSILINAFNQALALQRSVLDADEARDDQGGSSNDDGLMEEYVLGAGLTLLLQYLTENDPSQYGTPPANKEAVDALPTVQIAEAVSCSVCLDDLELGSQAKQMPCEHKFHSPCILPWLELHSSCPVCRFELPSEETEDLDEPSNVDRTENTHEEVRADGPEDDSESSNRAWALVPWFSGLFSTPEPQTVRGAFTDQQTRSTSGTNMNAGES

SEQ ID NO: 1638 - protein, 348 aa, Zea mays
MAEQAGAGRYWCHMCAAAVSPAEGEVEMKCPFCHSGFLEEMETARGAATDDGDGDGDGAVAQVHPGADRPSSIWAHAILSTVDSSARRRRNRRQQEAASDVYDWNDPEFSLRRRRVTAFLRLLHELRDRQLQRLESAAGVALEGDQLTPFGRSLFIGAAGGEHGVALGDYFLGPSLDALVQQLAENDAARHGTPPAKKEAVEAMPTVEIAGGNDGDDAASCPVCLEDYAAGERAREMPCRHRFHGNCIVPWLEMHSSCPVCRFQLPATDDKSSCSGGDGGFVSVDADREGSDNGGGDGRASSPGNAELAEAEESGRRLPPSLQWLNSLFSPSAQSSGSGGSSSHHWEN

SEQ ID NO: 1639 - protein, 211 aa, Zea mays
MVLMAGMLPGVECARRRRVRQGGAGMGAEAAGGGTGRRSSFCLYAAGHGGAGNSGKRSGGVVHGHGWTLDSNAREAKERLDQKLRTKREAAIKRHHSTGSIKLGVPHRSAGADERGESSAPAMAGVQREVYSKKGVMRRLMRWSRPRWAAAEQAECAVCLDEFRAGDVLAHLRCGHRFHWACALPWLEGTSRCPFCRAAVDAGAAAAADGA

SEQ ID NO: 1640 - protein, 280 aa, Zea mays
MSFVFRGSRTDIEAGGFPGFAPERRAMRIHAGSRPVNSNSLAFLLTVLVLFMVLNSHQISPNLLLWLVLGVFLMATSLRMYATCQQLAHAAAANSFLGHTELRVHVPPSITLATRGRLQSLRLQLALLDREFDDLDYDTLRALDADNSPHAPSMSEEEINSLPVFKYKVQAQQRHPPARKSDGPSQLSVSSTGSGNEEKQDGLKADGTSKPSEDELTCSVCLEQVTVGDLLRSLPCLHQFHVNCIDPWLRQQGTCPICKHQVSDGWHATGNGEEDASYMV

SEQ ID NO: 1641 - protein, 155 aa, Zea mays
MGISSMPEPRDSLLGYLVYNTVISIAALAGLVRAALVFLDLQAALPPGDDGGDQLAASGPGLAERFLRAFRPALYEVLASTATTCEADGGGDDCSVCLAGFRARAVVNRLPCGHLFHRACLETWLRYERATCPLCRAHVPLPADETPLLRYPEFE

SEQ ID NO: 1642 - protein, 249 aa, Zea mays
MDPSGGAFLPPLQQGSSSFPRSSSNASLARSGSGGGGVGAGRGTRGRKMMRRVCRGVITFIFAIAGLFLGAVTGGLIGLATESGLFRGTGIGAITGALVSIEVVDSSIRLWQARRSGIWSILYVLNVIYSLLTGRLVREKVDPAVQRVVRSQMNAVDSSPFRESPDLFEVEATNGMPRASIDKLPESWITEEYRRDAVGDLSGCSVCLQDFQVGEKVRSLPDCWHVFHVPCIDGWLIKHGSCPLCRRKL

SEQ ID NO: 1643 - protein, 184 aa, Zea mays
MAMATQGQADQQQQHGRSEPTTSVAANRWGPYSGAGDFASNMAVILAALLAALALGLALNAAVRYLLRRSRRAGSVGGQGNGSGVLMPSDDPAEKPSVEVELQAPPPALLVYSAAGTTLAGAAAECAICLAEFADGDAVRVMPACGHGFHARCIERWLAEGRRSSCPTCRAPAVQRSLHASELL

SEQ ID NO: 1644 - protein, 514 aa, Zea mays
MASPRGRMSFPLRSFLMICLMAQLGASNVVLMANNTTLSFDDVEAIFTPAVKGSGVNGVLYAVEPMDACSPLRTKAIGGSVSTFALVIRGGCHFDDKVRNAQNAGFKAAVVYDTEDNGILVSMAGSSSGVHIYAVFVSKASGEELKKYSGQTDAELWIIPTYANSAWSIMAISFISLLVMSAILAACFFARRHQIRRDRARLPQTREFHGMNSRLVKAMPSLIFTKVQEDDCTSATCAICLEDYSAGEKIRVLPCRHKFHAACVDLWLTSWRTFCPVCKRDANAGTPEPPVSESTPLLSSSAIRLPEPTASVSFWSTVAAAAAASPPRPISRHPSPSRSISRKHSVSGSSIPGTPIPRFHASSSSPTCTSGSSLDLANMPSSPWPRASHLASAHSSCGGRLSPPIHIRNTSAAHVSRSAYGSPSRYVGSSHMSRGSPSCYYLGSSSGQQHPYLRHCTLSGTSLFTMVPQSPQQNQLQHGGDSEKDLSAAAPFRQLYYLQHCPDSGTSSQSLPGC

SEQ ID NO: 1645 - protein, 146 aa, Zea mays
MGISSMPAPEDSLLGFVLYNTAASVAILAGLVRAALLFLGLAAAAEDEEPRQQAEAVTVTAVGPSLADRFRSRFRPSRYGRRRGGDCRVCLVRFETESVVQRLPCGHLFHRACLETWIDYDHATCPLCRHRLLPPAAAADEVPRIA

SEQ ID NO: 1646 - protein, 655 aa, Zea mays
MQGQRNSVEHFADVFGFDIASSSGNPVMDQQSYWNNVLGSVESQNLQGYQMNHSDAAMPYGNETQQDGTFLGFWESGEASASGSSNNAKTEHLSIGGGLRIGERRLVADNGISLDVDINLNANVNDLCGQSSNVNCTSQGPEHYGGGDRSVVNSQPTDLRLHPYRTFLLDAEQADSFTLNPSENPLCDFSLMQESIDQRPGSSLDGRRLACKRKNVEGPNGQSSAGASTSFSHRNDNAFHNIASSSYNPAPIRNPSSPNCLPVPSSIDDQLPRYGTNAGLSAGTYDLNGGVNNAGNSQRSFRARITTSQQIAPCSVWPSSNAIRLPNSWNHQPPHFQSAFDDTQEVIPVVSSLNLQYQHPVNVSSVPPAANRFTGHGASSSRAGSLENRILGSQEAPTRNVVPANYSDLVPPSVVDPRRLLPEPSNWSSDVRGTAISGSIPPVSRANNSATVNPPAGFSHQNLTRRHPRNLSEEIGRLSGALRGHQPPRLRPGFLLERQGDGVWGVPLSTRGREGRRLMEIRNALEMIHRGENVRLESIFYGGVDIHDRHRDMRLDIDNMSYEELLALEERIGNVGTGLSEEAVIRLLKQRKFSSWTLKASLDPEPCCICQEEYADGDDLGRLDCGHDFHAGCIKQWLVVKNVCPICKSTALKKT

SEQ ID NO: 1647 - protein, 520 aa, Zea mays
MAFRNMVCTPQVINLTSDSERGQAQGGNGSEISEQGAQHAVRVVGNAMNIGLSGVRSYYDMSINHHHQSVHNPPPNLGVDSGFVFASNMYNPCMSSTSMNRHVSHAQSFGSGNQVLPQNQVPGTMDESSRNDSIGESAREHIKRKNAAVAGSYHFVNGFASSSSSSHAPQNPMLGPWDPSFESTVSSNVAPFNPSEYHGHNNSWPSLEGSSITGSNGFNSMVVHPDSVQRGNYTFPPTHISHSWMSHATNGIADGVPQWEYANATANIQGRFAHSGATEIANVGFHEYQNGPSTICRGPVPYFHQHAMHGMQALDPTQMQVPYQQCHSNGFLHGGINYPGNRLQLGPRNPVLFTSSERAFGPPQHPFLANPVNHRNIRILPPEHATIMDFSRLYEVSNTVDEHRDMRLDIDSMTYEELLALEEQIGDVNTGLTKSHIVDKLRTSLYVPGISSMSDQPSKSSLENDACIICQEEYQARDCVGTLDCGHRYHAECVKQWLMVKNLCPICKTTALSANRRQGQ

SEQ ID NO: 1648 - protein, 205 aa, Zea mays
MGSLLCCMGCSEDVSAAPPVSCLCLLWPFHYYHNLNSGSAACHRCDTRVAPDGGRSPPANQVDSLDTLGLPPRPLPYDDPQSSPRMVQHPLVSGHDKAPTHVQKLGQPAETKNTHTGSTCTAHKVSASSPKQHSEGSRMDDGVQFCDSSDSEDDCPVCLEEYDYENPKIALQCKHNFHLSCIYEWMERSQACPVCAKTMLFNEDE

SEQ ID NO: 1649 - protein, 171 aa, Zea mays
MGGCCCCSSRTSEAVRARAPVDIYHQQNLEEQEPLSSIFDGSSPASAIVAVDTNLDTSTPDTYRAPPAPLPYDVILAVPNNPGLEKPDTKSKTDDQQESINDQESLKVDESCKKSVTEDKADEEDVCPICLEEYDEENPRSITKCEHHFHLCCILEWMERKDTCPVCDQVW

SEQ ID NO: 1650 - protein, 396 aa, Zea mays
MASVTDETAKIEGLTSAAAFVEGGIQDACDDACSICLEAFCESDPSALTGCKHEFHLQCILEWCQRSSQCPMCWQPITMKDPTSQELLEAVERERNIRTNQTRNTTIFHHPALGDFELQHLPVGNDAELEERILQHLAAAAAMGRAHHLGRREGHRGRSGSHGRPHFLVFSTQPNSPSAGTISSSSAHMEGENDSNPATPRASESSPRAIRIGEVGNQSPGMLTYDAEQDAVVSSGNSTPVSSPRFFNRRHSTGQSTPDRAGPSDIQSFSDSLKSRLNAVSMKYKESITKSTRGWKERLFSRNSSVADLGSEVRREVNAGIASVSRMMERLETRGNSRTSDSPAASTSEVPPATESSNERVTESNSAAAAGGGGTTTTGTSASNASAPCVATSGSN

SEQ ID NO: 1651 - protein, 168 aa, Zea mays
MAEKKMVTLRSSDHEEFEVEEAVAMKSEIIRLLIEDDCADNAIPLPNVDSKTLALVIEYCNKHVHAAAADDSAAAETSNASSAAGGGDVDLKKWDAEFVKVEQATLFDLILAANYLDIKGLLDLTCQTVADMMKGKSPEEIRRTFNIKNDFTEEEEEEIRRENSWAFD

SEQ ID NO: 1652 - protein, 334 aa, Zea mays
MSESELAVIKPEALKTYIWLQCFDGSIQQVEEEVAMFCPMICREIVKNGTGSSKNHAIALPERVNPASLSLILDYCRFHQVTGRSNKERKSFDEKFVRIETERLCELTSAADSLQLKPLVDLTSRALARIIEGKTPEEIRDIFHLPDDLTEEEKLEPLKNVNDDPRIRLLNRLYAKKRKELQERQKLKDVQVQKEEKDERSLDELLCFINGDGGSGGGESSTKSKKKNKRRKDHAKNPAKADSESVNVEGAACVVPCKVDSSNVSRLPCQSPDMQDDVEYPFEDADLDDGLDPAMKEELDREVEDFARRLNSVWSESHIGGNGSVQRFPGFNHR

SEQ ID NO: 1653 - protein, 176 aa, Zea mays
MAAEGEKKMITLKSSDGEEFEVEEAVAMESQTIRHMIEDDCADNGIPLPNVNSKILSKVIEYCNKHVHAAAAAAAASKAGSDDVGAAAANSTAASGEDLKNWDADFVKVDQATLFDLILAANYLNIKGLLDLTCQTVADMIKGKTPEEIRKTFNIKNDFTPEEEEEIRRENQWAFE

SEQ ID NO: 1654 - protein, 599 aa, Zea mays
MGGEAPEPRRLTRALSIGGGGGGWVPDEMLQLVLGFVEDPRDREAASLVCRRWHRVDALSRKHVTVPFCYAVSPARLLARFPRLESLAVKGKPRAAMYGLIPDDWGAYARPWVTELAAPFECLKALHLRRMVVTDDDLAELIRARGHMLQELKLDKCTGFSTDGLRLVARSCSSLRTLFLEECQINDKGSEWIRDLAVNCPVLATLNFHMTELEVMPVDLELLAKSCKSLISLKIGDCDLSDLIGFFQSATSLEEFAGGTFNGQGELTKYGDVKFPSRICSLGLTFMGASEMPIIFPFAAILKKLDLQYTFLTTEDHCQLIAKCPNLLVLAVRNVIGDRGLGVVADTCKKLQRLRIERGDDEGGVQEEQGGVSQVGLTAIAVGCRELEYIAAYVSDITNGALESIGTFCKKLYDFRLVLLDREERITDLPLDNGVRALLRGCTMLRRFALYLRPGGLSDAGLGYIGQCSGNIQYMLLGNVGETDDGLISFALGCVNLRKLELRSCCFSERALALAILSMPSLRYVWVQGYKASQTGRDLMLMARPFWNIEFTPPSSQNAGRLIEDGEPCVDSHAQILAYGSLAGKRLDCPQSVVTLYPA

SEQ ID NO: 1655 - protein, 590 aa, Zea mays; identical to SEQ ID NO: 1352

SEQ ID NO: 1656 - protein, 573 aa, Zea mays
MAYFPDEVVGYILGYVTSHQDRNAVSLVCRAWYDIERHGRHSVLVRNCYAVCPERVHMRFPNMRALSLKGKPHFAEFNLVPAGWGATANPWVDACARACPGLEELRLKFMVVTDECLKLLSLSFTNFKSLVLVCCEGFSTTGLANIATNCRFLKELDLQKSCVKHQDHQWINCFPKSSTSLECLNFSCLTGEVNAVALEELVARSPNLKSLRLNLAVPFDVLSRILSRTPKLEDLGTGSFLQGNDPAAYASLCRALENCTSLKSISGFWDAPGFYVQGILSNCKIRNLTCLNLSYATLIQSTQLIGIIRHCKKLHVLWVLDHIGDEGLKAVSFSCPDLQELRVYPSVVAPRGTVTEEGLVALSSCRKLQRVLFSCVRMTNTALMTIARYCPRLTSFRLCIRKPRSADAVTGQPLDEGFGAIVRSCRGLRRLAMSGLLTDSVFLYIGMYAEKLEMLSVTFAGDTDDGMVYVLNGCRNLKKLVIKESPFGDAALLAGAHRYESMRSLWMSSCQITLGGCKALAATMPNINVEVIGGASFGAMDGGVSGARKVDMLYLYRTLAGPRCDTPGFVSIL

SEQ ID NO: 1657 - protein, 596 aa, Zea mays
MGGEVPEPRRLSRSLSFGCGGVPEEALHLVLGYVDDPRDREAASLVCRRWHRIDALSRKHVTVGFCYAVEPARLLARFRRLESLALKGRPRAAMYGLIPEDFGAYAAPWVAELAAPLDCLKALHLRRMTVTDEDIAVLVRARGHMLQVLKLDKCSGFSTDALRLVARSCRSLRTLFLEECIIADEGSEWLHELAVNNSVLVTLNFYMTELKVEPADLELLARNCKSLISLKMSDCDLSDLIGFLQTSKALQEFAGGAFFEVGEYTKYEKVKLPPRLCFLGGLTFMGKNEMPVIFPYSASLKKLDLQYTFLTTEDHCQLIAKCPNLLVLEVRNVIGDRGLEVVADTCKKLRRLRIERGDDDPGQEEQGGVSQIGLTAVAVGCRELEYIAAYVSDITNGALESIGTFCKNMYDFRLVLLDKQNKITDLPLDNGVRALLRSCTKLRRFALYLRPGGLSDAGLGYVGQYSGNIQYMLLGNVGESDNGLIRFAMGCANLRKLELRGCCFSERALAVAVLQMPSLRYVWVQGYRASQTGRDLMLMARPYWNIEFVPPRPESACRVMADGQPCVDTHAQVLAYYSLAGRRPDCPRWLVTLHPA

SEQ ID NO: 1658 - protein, 235 aa, Zea mays
MPSQSTHTSSSLSSSTTPILPCSSAAALFRSVMAAVATETPFHVLAVDDSLPDRKLIERLLKTSSFQVTTVDSGSKALQFLGLHDQDSTVPPVHTHQLDVAANQDVAVNLIITDYCMPGMTGYDLLKKIKESSSLRDIPVVIMSSENIPSRINRCLEEGADEFFLKPVRLSDMNKLKPHILKSRCNQEQHQQSDSHSGERRNPTISSSDSINNRKRKGAGTEEILPQLANRSRHS

SEQ ID NO: 1659 - protein, 293 aa, Zea mays; identical to SEQ ID NO: 1584

SEQ ID NO: 1660 - protein, 300 aa, Zea mays
MGALDLHLDFASAQHGQAKLKEYAKSSLLSDGNYNTDKINGSNPDDYEKFEKGIMHYGCPHYRRRCRIRAPCCNEIFDCRHCHNETKNSIKIDKMKRHELPRHEVQQVVCSLCGTEQEVRQVCINCGVCMGKYFCGLCKLFDDDVSKQQYHCNGCGICRIGGRENFFHCSKCGCCYSIALKNSHACVEGAMHHDCPICFEYLFDSTNDVSVLPCGHTIHVKCLKEMEEHCQFACPLCSKSVCDMSKAWERLDMELATLSDSCDHKMVRILCNDCGAISDVQFHLIAHKCQNCKSYNTRQI

SEQ ID NO: 1661 - protein, 306 aa, Zea mays
MPQRHSKNNNDLAFFTYEEKRKLGYGTQRERLGKDSIKPFDACCLCLKPLIGPLCCPKGHTFCKECILECLLSQKKDIKRKLAAHEAQKKQEKEEEEEKLILQKAKELDAFDQQNHGAVPQYHDRSGSQYKNGFHGANSVKVTSFEEEALRNMKAFWLPSATPEATVKVDLPSTDTVCPEGQEKLKLKSLFPISFTEETADQKSSKAGNSCSYMCPSCKSTLTNTMSLVAVSTCGHVFCKKCSDKFLVKDKACLECSKPFRERNLVPLEKGGTGFAAHDERLEARDFKYLGSGSGLGLVKPAPKTY

SEQ ID NO: 1662 - protein, 262 aa, Zea mays
MDSGYNPRTVEEVFRDFKGRRAGIIRALTTDAEDFFKQCDPEKENLCLYGFPNESWEVNLPAEEVPPDLPEPALGINFARDGMQEKEWLSMVAAHSDAWLLSVAFYFGARFGFNKNDRKRLYSLIDDLPMAFEIVSGKSETKAPAPPSSSNHSNIKPKSNNKKKPPEPKVKQPKPRAPAEEGEEEDGSASEDEHGETLCGACKESYGPDEFWICCDLCEKWFHGKCVKITAAKAEHIKQYKCPSCTGGGGVSNSGTKRARPS

SEQ ID NO: 1663 - protein, 314 aa, Zea mays
MGAVASSAGGARGGDGTVLGDLPENCVAEVLLRLDPLEICRMARLSRTFRGAASGDGVWESKLPRNYARLLAVAAAGDGEGGQAAASAPGAELLPKKELYARLCRRNRFDGGKKEFWLDKGGGGLCMSISSRALSITGIDDRRYWNFIPSDESRFRTVAYLSQIWWFEVRGEVEFFFPEGTYSLFYRIHLGRPFKRLGRRVYSSEHVHGWDMKPVRFQMSTSDGQHVQSKCYLSDPGIWINHHVGDFVVKDSSRPVNIRFAMIQIDCTHTKGGLCVDSVVVKPQHLSQKKSALDLRVDSSNKLLLLSREEGYDP

SEQ ID NO: 1664 - protein, 296 aa, Zea mays
MGAWVSVLLGMDGAAAAGPAAVGLGDLPELCAAQVLLRLDPPEICRLAQVNHAFRGAAGADFVWEAKLPENYNYLMEFVGSGDEGKRRRRRAGKKEIYARLARPVPFGDGKKEFWLDKNKGMICMALSSKALVITGIDDRRYWQHMPTSESRFQSVAYLQQIWWFEVVGEVDFCFPVGTYSLYFRVHLGKFYRRFGRRQCTSEHVHGWDKKPVRFQLSTSDGQQALSQCYLEEPGSWVLYHAGDFVASKPDQLMKLKFSMAQIDCTHTKGGLCIDSVLIYPKGKGFHQERVVRSQK

SEQ ID NO: 1665 - protein, 353 aa, Zea mays
MIECTMPSTLLDDLPNEVALQCLARVPFLFHPTLQLVCRSWRASVCSGELLKIRNQIGTTEELLCVLAFEPENMWQLYDPLRDKWITLPVMPSQIRNIARFGVASVAGKLYVIGGGSDRVDPLTGDHDRIFASNEVWSYDPLHRVWSQRAPMLVARAMFACCALDGKIIVAGGFTNCRKSISKAEIYDPEAGIWEPLPDLRLAHSSACTGLVIKGKMHVLHKGLSTVQILEDGGSHWAVEDFSWLQGPMAMVGGELYVLSNSCIMKQRGENFPDKMVSCASEFQSRIGFGMIGVGDNIYLVGGVIGPGPRNQCIKLLSDVDILNVTSERPTWRPGSPMTHCRGSICGCALLRI

SEQ ID NO: 1666 - protein, 437 aa, Zea mays
MDAASRPPPPHGAGVRVRAPLVESVSCYCRLDTGLKTVVEARKFVPGAKMCMQPEVKQNKRKSRGSKKERCRTQAPLLPGLPDDLAIACLIRVPRLEQPKLRMVCKRWNRLLSGNYFYSLRKKIGVAEEWVYVFKRDREGKISWYAFDPLHQLWKSLPPVPQEYSEALGFGCAVLSGCYLYLFGGKDPLRGSMRRVVFYNARTNKWHRAPDMMRKRHFFGSCVINNCLYVAGGECEGIQRTLQSAEVYDPNRNRWACVTEMNNGMVPFIGVVYDGKWFLKGLDSHRQVTSEVYLPSSNTWSAIDDEMVTGWRNPSISFNGRLYSADCRDGCKLRVYDENTGTWTRFMDSKHHLGSSRAFEAAALVSLNGKLCVIRNNMSITLVDVSNPTMSVETDSARMWETVVRKGQHRSFVANLWSSIAGRNLKSHIIHCHVLQV

SEQ ID NO: 1667 - protein, 363 aa, Zea mays
MINHHEIVQFGKLYNRDMESAPAHTPLIHGLPDEVALICLARVPRRYHNILRRVSRRWRALLCSEEWHLCRKRNNLDEPWIYVICREAGIKCYVLAPDPPSRCFRIMHVIEPPCSGRKGVTIEALDKKLFLLGGCSSVYDATDEVYCYDASSNRWSSAAPMPTARCYFVSASLKEKLYITDGYGLTDKSPNSWDIYDPATDSWCTHKNPLLTPDIVKFVALGEELVTIHRAAWHRMYFAGVYDPLERTWRGRGNEIALCYSSPTVVVDGTLYMLEQSMGTKLMVWREDAKEWAMLGRLSDKVTRPPCALVAIGRKIHVVGRGLSMVTVDVDTAARVDGFLVTTSVGPLVEEDLTPERCVVITI

SEQ ID NO: 1668 - protein, 283 aa, Zea mays
MAAAAAAASSSSSSEVPIAARTCVSVGEVAVGAVATGSGDRVAADCGVCAICLDRIALQETALVKGCDHAYCVTCILRWASYKENPLCPQCKHPFEFLSVHRSLDGCLHDYLFEESVCLLLRAAWFEPLIVEAHEEALEEEEFLHQQYQYDDDEDDLDEESYYMNRSPSIRIGNRRWGDNGYIRGGRKEARPVNTDVAAGPSRTPKKKEKAASSSASVSVSGSGSGSGSVSKDVAGRRAKRAQKREAADKAAAEKHLKHLQRLGLRKSPEPVVPEEVGPQVNE

SEQ ID NO: 1669 - protein, 84 aa, Zea mays
MKVKILQWHAVASWTWDAQDETCGICRMAFDGCCPDCKFPGDDCPLIWGVCNHAYHLHCILKWVNSQTSTPLCPMCRREWQFKG

SEQ ID NO: 1670 - protein, 122 aa, Zea mays
MSAMETDINAPPPPAPAGEGSSAAGSSSSRKPNKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 1671 - protein, 526 aa, Zea mays; identical to SEQ ID NO: 1631

SEQ ID NO: 1672 - protein, 433 aa, Zea mays
MGVGAEPKDQAATAAGVPAEQDEAGGKEDKAAAVSCSICLDAVLAASGERSTARLHCGHEFHLDCIGSAFNAKGVMQCPNCRKIEKGNWLYANGSRSAHDVSMDEWAHDEDLYDVSYSDMPFRFHWCPFGRLTQLPSLFEEGESSPPVTFHDFMGQHVFTEQVAVSAAAGTTNPCPYVAYLHPLTPLTSLSSSHVPDRTMDRPAYHDHWNPMAGPSDVRSMQTMQPADFHHSHWAHVPHSYGQPNSNNEQPGIPFGARAVRVDGDSQRRASVVSPSYFSNGSGSRSRPPNVPPLMPQFMRAHGSISEQYQQNSSSSLFAGAHRSGGMRPAPTPLPENPTFTLFPPGSSGHSSMETDDAGGSRFYAWEGDRFAPYPLMPVDCETSWRTSQQQSHQSTSEPTSAPRRLFGQWLAVGRPSPSPEGSSYRQLHSPRM

SEQ ID NO: 1673 - protein, 446 aa, Zea mays
MGAGAQEDEEEITTVAEGGVGEEEQAAAEGAGEEEQLEQGAGGEGEGGEEKAPAVMLCSICLDTVVAGGEERSTARLQCGHEFHLDCIGSAFNAKGIMQCPNCRTIEMGNWLYANGSRSSQDVNNDEWGYDDLYDHGHSELATFVPLRIQWCPIGRLELPSLFEEGESPAPATFNDFTGQFNSEPMVPVPATPHPGPYLAYFQPAPTPVSSSSLVAERTMDGAAYHDHWNTLAGLSDGRRPWAYYPQPNSDNGIAEQQGLPLGAMAVGGVDSESQQRGSLSLFYGNGSGRPRIPGVPPMAPQFTRAHGNINDQFQQTASLFAGSQQSGGMRPLGAVGPSVPPPPENTSFCLFPPASSVPSTMEAEDVNRANQFYAWERDRLAPYPLMPVNSEGTWWSSSQQQPPPEPAASASRRLSGQWIGRLPLPPPENRSPDGSSFRPLHIPRM

SEQ ID NO: 1674 - protein, 273 aa, Oryza sativa; identical to SEQ ID NO: 1189

SEQ ID NO: 1675 - protein, 230 aa, Zea mays
MSANVGESTSGGSSNDAAGGSFECNICFELPQEPIVTLCGHLFCWPCLYRWLHIHAHSPECPVCKALVEEDKLVPLYGRGKDRVDPRSKNMPEGEIPHRPTGQRPAPAPQADANNNFANANPNANPWFMGTGVPLANARWGNYAFSAAFGGLFPMLSFQVHGFPDAAAYAQPAGFHYGYGHGHGFHGGHMGHAHGVHRQAPLGQQQQADIYLKALLFMIGILVIASLIAF

SEQ ID NO: 1676 - protein, 609 aa, Zea mays
MEWDSDSDGGDDEEEEEVRPGGGDAGPGFSLAIEGVLGACGMVVSDALEPDFPIIYVNRGFESSTGYSAEEVLGRNCRFLQCRGPFAQRRHPLVDAAVVTRIRRCLDEGTEFHGDLLNFRKDCSPYMARLQLTPIYGDDEVITHYMGIQFFNDSNVDLGPSSGSVTKELARSTWIAPGNTDSPTPVGKGNLWEHSSLFLLSDEVICQKILSKLSPRDIASVNSVCKRLHHMTRNEDLWRMVCQNAWGTEATRALETVAGSRSLAWGRLARELTTLEAVAWRKLTVGGAVEPSRCNFSACAVGNRVVLFGGEGVNMQPMNDTFVLDLSASKPEWRHINVSAAPPGRWGHTLSCLNGSRLILFGGCGGQGLLNDVFILDLDAQHPTWREIPGLAPPVPRSWHSSCTVDGTKLVVSGGCADSGVLLSDTYLLDVTMERPVWREIPASWSPPSRLGHSLSVYDGRKILMFGGLAKSGPLRLRSSDVFTLDLSEDKPCWRCITGSRMPGAGNPAGVGPPPRLDHVVVSLPGGRVLIFGGSVAGLHSASKLYLLDPTEDKPTWRLLNVPGHPPRFAWGHSTCVVGGTKAIVLGGQTGEEWTLTEIHELSLASSLV

SEQ ID NO: 1677 - protein, 618 aa, Zea mays
MFDDAGAVAVKRMRLWEEDEVEVEEEGMEVDAEPGWPWGTPAAGLSRAAAIVVADAADPDFPVIYVNAAFESATGYRAHEVLGRNCRFLQFRDPRAQRRHPLVDPMVVSEIRRCLNEGIEFQGELLNFRKDGAPLYNRLSLIPMHGDDGYVTHVIGIQLFSEANIDLSSVSYPVYKQQTNNRPIIQDLNSASHEHAPKVQSADHCGMLQLSDEVLAHNILSRLSPRDVASIGSVCTRMHELTKNDHLRKMVCQNAWGRDATVKLEMSTKMVGWGRLARELTTLEAASWRKFTVGGRVEPSRCNFSACAVGNRLVLFGGEGVNMQPMDDTFVLNMEAARPEWRRVKVSASPPGRWGHTLSWLNGSWLVVFGGCGQQGLLNDVFVLDLDAQQPTWREVASEGPPLPRSWHSSCTLDGSKLVVSGGCTESGVLLSDTFLLDLTKEKPAWREIPTSWSPPSRLGHTMSVYGTTKLLMFGGLAKSGSLRLRSSDAYTMDVGEDSPQWRQLATTGFPNVGPPPRLDHVAVSLPCGRIIIFGGSIAGLHSPAQLFLVDPAEEKPTWRILNVPGKPPKFAWGHSTCVVGGTRVLVLGGHTGEEWILNELHELCLASRPDDDDDDRY

SEQ ID NO: 1678 - protein, 983 aa, Zea mays; identical to SEQ ID NO: 1131

SEQ ID NO: 1679 - protein, 1074 aa, Zea mays
MAANKGMVAGSHNRNEFVMIRHDGDAPVPAKPTKSANGQVCQICGDTVGVSATGDVFVACNECAFPVCRPCYEYERKEGNQCCPQCKTRYKRQKGSPRVHGDDEEEDVDDLDNEFNYKQGNGKGPEWQLQGDDADLSSSARHDPHHRIPRLTSGQQISGEIPDASPDRHSIRSPTSSYVDPSVPVPVRIVDPSKDLNSYGLNSVDWKERVESWRVKQDKNMLQVTNKYPEARGDMEGTGSNGEDMQMVDDARLPLSRIVPISSNQLNLYRIVIILRLIILCFFFQYRISHPVRNAYGLWLVSVICEVWFALSWLLDQFPKWYPINRETYLDRLALRYDREGEPSQLAPIDVFVSTVDPLKEPPLITANTVLSILAVDYPVDKVSCYVSDDGSAMLTFESLSETAEFARKWVPFCKKHNIEPRAPEFYFAQKIDYLKDKIQPSFVKERRAMKREYEEFKIRINALVAKAQKVPEEGWTMADGTAWPGNNPRDHPGMIQVFLGHSGGLDTDGNELPRLVYVSREKRPGFQHHKKAGAMNALIRVSAVLTNGAYLLNVDCDHYFNSSKALREAMCFMMDPALGRKTCYVQFPQRFDGIDLHDRYANRNIVFFDINMKGLDGIQGPVYVGTGCCFNRQALYGYDPVLTEADLEPNIVVKSCCGRRKRKNKSYMDSQSRIMKRTESSAPIFNMEDIEEGIEGYEDERSVLMSQRKLEKRFGQSPIFIASTFMTQGGIPPSTNPASLLKEAIHVISCGYEDKTEWGKEIGWIYGSVTEDILTGFKMHARGWQSIYCMPPRPCFKGSAPINLSDRLNQVLRWALGSVEILLSRHCPIWYGYNGRLKLLERLAYINTIVYPITSVPLIAYCVLPAICLLTNKFIIPEISNYAGMFFILLFASIFATGILELRWSGVGIEDWWRNEQFWVIGGTSAHLFAVFQGLLKVLAGIDTNFTVTSKASDEDGDFAELYVFKWTSLLIPPTTVLVINLVGMVAGISYAINSGYQSWGPLFGKLFFSIWVILHLYPFLKGLMGRQNRTPTIVIVWSILLASIFSLLWVKIDPFISPTQKAAALGQCGVNC

SEQ ID NO: 1680 - protein, 261 aa, Zea mays
MWSFASNAIAGSLKKKAQPSKCSISNADYSDDEVSSCTSREEGLDCPICWESFNLVENVPYVLWCGHTMCKNCILGLHWAVVKFPSLPIQLPLFISCPWCNLLSFRLVYKGNLRFPRKNYFLLWMVESMNGGRAKFHSTNHDEHHSTWHSSAGTSSSHQQRRNAAVGSESSSGRETGVGRNIFHTDNISASLQKLMVCFMQLTAKFPLVIIFLLIVLYAVPASAAVLVLYALVTFLFALPSFLILYFAYPSLDWLVREIFA

SEQ ID NO: 1681 - protein, 272 aa, Zea mays
MWGFASNAWASGLGKRSPPNCTSSSAACSDDEASSCTSREEGLECPICWESFNIVENVPYVLWCGHTLCKNCVLGLQWAVIKVPTVPMQLPFFVCCPWCNLLSLRILYKGNLTFPRKNYFLLWMVEGMNGERARSRPATHSEQHTPWLSSSSRANGNAGCSNPTRRHLPLPPPVDTTSPTNANHANHGVPVPLLNAERVQASLRKSLSFLVHLTAKFPLVFIFLLIVLYAIPASAAVLLLYILITVLFALPSFLILYFAYPSLDWLVREIFA

SEQ ID NO: 1682 - protein, 196 aa, Zea mays
MDSSTSAAAAGEAAVPPEDDVCSVCHDRFRIPCQANCSHWFCGECIIRVWNYGPPVQACKCPICRRLINLLVPAALSGQEDGPQAQRILGEIQHYNCIFGGAPRSLTQRLQDLPFFIRRLFRELMDPQRTLPLVFRARMLMMVALSAIYVLSPVDILPESMLGLFGFVDDLLILLIVFLHLAAVYRSLLLYRHGGQ

SEQ ID NO: 1683 - protein, 251 aa, Zea mays
MDSRVVDGAGGGADASLPADPPSPVPDPAAGGMDARLPSDLLRAVLQRLPPIDLARSACVCRAWRAVASDRAVVEAAFCAPWGVRRVVGEPATGAFWRAASLGRFALSHAIRRGDTVPGVALKYSVQVTDIKRFNNMMSDHGIYSRERLLVPISNPEILLGSTCYIEMDHNAKREVAIFYPEGRPGGKTDSVASIVSAERRNKRILESVRRSLHVDDGTAAYYLSVTEGDPRAAMTEYSEDLRWEQQRAGR

SEQ ID NO: 1684 - protein, 341 aa, Zea mays
MELDSIECMSYSDSMGDDDTDAVTSSQLPRPFLKSSSTAGTAAVNVVVVSDRVGAAGPVAGAGSLVISPATGVHELLECPVCTNSMYPPIHQCQNGHTLCSTCKTRVHNRCPTCRQELGDIRCLALEKVAESLELPCKYYSLGCSEVFPYYSKLKHESQCNFRPYNCPYAGSECSVVGDISFLVAHLRDDHKVDMHSGCTFNHRYVKSNPREVENATWMLTVFHCFGQYFCLHFEAFQLGMAPVYMAFLRFMGDENDARNYSYSLEVGANGRKMIWEGTPRSIRDSHRKVRDSHDGLIIQRNMALFFSGGERKELKLRVTGRIWKEQQNPDSGACIPNLFS

SEQ ID NO: 1685 - protein, 400 aa, Zea mays
MEAPRPNNGRKRKPTPPAGLGALHDDLLERVLARLPPATYFRLRAVCSRWRAAAASPTFLHACARVPSRDPWFLMLSDSDSGPRPPVAFDAAGRSWNRCHAAPGAAVPVAASAGLVLYRAPATGALTVANPLTGASRALPSPPQQAARQLQAIAMYGAGGPYRVALFAGDLPDDLSMAVYDSSSNSWEGPLPLARKPGDDSCPDAPAPDDTVYFLSKSGDVVATNMQRSASKQYSSSVVVRRDGDGDAAFAYFLSYSGTVVACDTARRTFAELPRILPVYFEYSIDVVACGAAAYAVVLSEYLGTASLRVWEFAGGAWRQVAAMPPAMSHGFHGTRPDINCVGHGDRLMVCVTSAEANACFMCDVASNQWEELPKYVNADGEASEFLAAFSFEPRVEVTV

SEQ ID NO: 1686 - protein, 337 aa, Zea mays
MAFFSHHHLQQPHPQQAPPPNQQQPVLPSFRNALPVPVDGQIPAPLTFFNPPPAFPEQPAQTTLVDAVGLTAAAGLGWRQPREQELLGENSQMSSIDFLQTGSAVSTGLALSLEDRRHGGGGAGNSSGDSPLLLLPMLDDDISREVQRLDADMDRFIKAQSERLRQSILEKVQAKQFEALASVEDKIFRKIRDKEAEVETINKRNSELEDQIKHLGVEVGAWQQRAKYNESLINALKYNLEQVCAHQSKDFKEGCGDSEVDDTASCPYGGAVNLQLMPKENRQPKNLTACRVCKSSEACMLLLPCRHLCLCKECESKLSICPLCQSSKILGMEIYYA

SEQ ID NO: 1687 - protein, 354 aa, Zea mays
MHPKARIHADPVREVDHFDCLPDSLVLLILNKVEDVRSLGRCYAVSKRLCGLVSLVHDVYVKIDRVVAVDGDAEGTLNLSSPKPRSIFSHFLRLMLFTIIKPFHNMRSPNGTARPLFPQLSQHSPAQVLRNFTHVRNLRIELPSGDVGTEEGVLLKWRAEYGSTLENCVILGGTRVDRKPVGGEHEPALEDNGSMPESFYTNGGLKLRVVWTISSLIAASTRHYLLRSIINGHPTLQSLVLTDADGQGTLCMGAKQLEEFRENQLSASACSNRTQVPACNMKLKYAPYVELPGGMALQGATLVAIKPSPEGSNGSHPNRKEAEGFVFGAFDGPFKAAVKTLMKRRTYLLEMNGF

SEQ ID NO: 1688 - protein, 254 aa, Zea mays
MAKRRRHELAPVVEELISPMNSLDDGCLMHIFSFLSPIPDRYNTALVCHRWRFLACHPRLWLRVERPIRDAMEPGVYPDLEAAVSAARPGDTILIAAGGSHVACNIQIKKPICIIGGGDLPDDTVLTCSRGFDNALEFLSTCKIANLTIRAELGCCLLHRGGRLTIQECLLQCEQNPLDHLSFPIISTAIEYDPFSSLKEQGHGVTVVRTRIEGGARAVRTNGTLALRHVRAIYSRSSVFFWFEVGEKVEAPVH

SEQ ID NO: 1689 - protein, 342 aa, Zea mays
MKFGATYEEYLRAERDKFLGQCSHVEYKRLKKVLKKCRVGRSLQADGTNGDEQQEGRDESSNICECNSCTLCDEMFFTELNKEASEIAGCFRSRVQRLLHLHVPSGLQRCIWRFRQCFIDDQQIMVQEGRMLLNYVTMNAIAIRKILKKYDKIHGSVSGRDFKSKMQTEHIELLQSPWLIELAAFHLNCDDSDADEPRAGEFFKNGFFKNFSCDLSGAQPLLTMTISETLKYEYSLTCPICLDTLFNPYALSCGHLFCKACACGAASVYIFQGVKSAPPEAKCPVCRAVGVFDRAVRMTELELLLKRRDKDYFLQRLREERSVMVKQAKEYWDSQAMLSMGI

SEQ ID NO: 1690 - protein, 371 aa, Zea mays
MSARDRETAEALVRLAASLDGAVLGLGTAAVAVASWVKYLAVSGQLRLVASAATASIADARSLLSGDGAEPRIAAVRGYVRAHDKFFRAPFSGEAGVVTKHTQMCLFTEWRGIFGWTFDLHALLFRSWKEQIVTSFRSVPFVLVSTELGNPTGVVHINVDKADQPLPLTTVFHKLIPLETTPYTLFQTIIGNGYPIALLDEEKILPIGKKITAIGLCQAKDAESVEITSCPEIPFFLSELTKDEMQAQLASRARILFWGSIVLGTLSVCLVGHAIYRGWTRIKLRREARHARQMFEEAEDAIHRDDSSDDDEIGDGQLCVVCLRKRRRAAFIPCGHLVCCSECALTIERTPHPLCPMCRQDIRYMMRVYDS

SEQ ID NO: 1691 - protein, 237 aa, Zea mays
MAGQERRTIDLEEGWAFMQKGITKLKNILEGKPEPQFSSEDYMMLYTTIYNMCTQKPPHDYSQQLYDKYRESFEEYITSMVLPSLREKHDEFMLRELVQRWSNHKVMVRWLSRFFHYLDRYFISRRSLTPLKEVGLTCFRELIYQEIKGQVKDAVIALIDKEREGEQIDRGLLKNVLDIFVEIGLGQMECYENDFEDFLLKDTTEYYSVKAQSWILEVRYGDLRAYGSCHSKGCSHL

SEQ ID NO: 1692 - protein, 277 aa, Zea mays
MEHSNTQSGAAKVSILMIGQQAIMDAYLCLLHLTAGILVESLFNAFATAAFFKFVVFSIFEMRYLLAIWKASRPLNSGEGWEIMRRELSVLYSRFYGILLGGILLMYELHNFLRPLLLLMYSFWVPQIVTNVIRDTRKPLHPQYILGMTVTRLAIPLYIFGCPSNFMRIEPDKKWSIAVTVFMGIQAAVLLLQHYLGSRCFIPRQILPEKYCYHRKVEDSTNQPIDCVICMTTIDLTQRTSEYMVAPCEHIFHSGCLQRWMDIKMECPTCRRSLPPA

SEQ ID NO: 1693 - protein, 422 aa, Zea mays
MDALPPLQRATSPPPQPRPQPPVPSRRYGVHFSASSFIQAPLTTLLEYSGILRPDPGGGTQQDGAGAGPGEVSIRIVAPGEAGTSSERPEEVIVEEEEEDGHATRTRPEDPSPAAGGGEGGRESSSSYQRYDIQQVARWVEQILPFSLLLLVVFIRQHLQGFFVTIWIAAVMFKSNDILRKQTALKRERKIPVLVGITILFVVHVSGFYWCYKNGDLIRPLMMLPPKEIPPFWHAIFIILVNDTMVRQTAMVVKCLLLMYYKNSRGRSYRRQGQMLTIVEYFLLLYRALLPTPVWYRFFLNKEYGSLFSSLTTGLYLTFKLTSVVEKVQSFLTALRALSHKDFHCGSYATSEQVAVAGDLCAICQEKMHVPILLRCKHVFCEDCVSEWFERERTCPLCRALVKPADLRSFGDGSTSLFFQLF

SEQ ID NO: 1694 - protein, 425 aa, Zea mays
MEAAGRLLLLIVSSLLLLFSPERPAEAAPPRIQPLATAALSRLYDTSNYGRLQLNNGLALTPQMGWNSWNFFACNINETVIRETADALVSTGLAALGYNFVNIDDCWSYVKRGKQDQLLPDPKTFPSGVKALADYVHGKGLKLGIYSDAGKFTCQVRPGSLGHENDDAAIFASWGIDYLKYDNCYNLGIKPQKRYPPMRDALNSTGRQIFYSLCEWGQYDPALWAGKVGNSWRTTDDITDTWKSMTDIADKNNKWASYAGPGGWNDPDMLEVGNGGMSLAEYRSHFSIWALMKAPLLIGCDVRNMTSETMEILSNKEVIQVNQDPLGVQGRKILGQGKYGCREVWAGPLSGNRLVVALWNRCSDTANVTMKLPAVGLDGYAAYSVRDLWKHETLSENVVGTFGAQVDVHDTKMYIFSPATIVASV

SEQ ID NO: 1695 - protein, 389 aa, Zea mays
MWGERTHHKHWHQGHGTSGNSNNKKHDKRQPKFIPDNYSSVDEVTTALREAGLESSNLILGIDFTKSNEWSGRHSFRRKSLHAINGTPNPYEQAISIIGRTLSPFDDDNLIPCFGFGDASTHDHSVFSFYPENRPCRGFEEVLVRYRQIVPHLNLSGPTSFAPLIYAAISVVENSNWQYHVLVIIADGQVTAANINDGRLSPQEQATIQAIVDASYYPLSIVMVGVGDGPWDAMQHFDDCIPERAFDNFQFVNFTGIMSTSKDMSKKEAAFALAALMEIPSQYKATQGLRPPEKQAQRIGSPRILPPPNKVLENDNAAAAASHPPQTASSKSTGIGKSAADEQVCPICLTNPKDMAFQCGHLTCKECGPTLSTCPLCRALITMRVRLYS

SEQ ID NO: 1696 - protein, 348 aa, Zea mays
MVTPYLPSSHNHRRRLPILLKIGFLLMMGENKLMGKRWEDMDTDVLVKIFKELNLVELSPVSQVCRLWRLACSDPLIWGTLDFGLLKSNFIQTRASPYIWVDDRSDRRLARILRVAMAISCGNVNCMIFHYNLFMKDEHLHFISERSPHLKRLVMPAWNRITKVGICNAIQRWQALESLTMPTIGHPPYIMEEIARSCKNFTELKIMGSFDQQFASAILQFLPKLKVLSLRCSKVSMDALQCLLNSMEYLEVLNISHCLLLVVAANGRKQVVHELDSQILERASRLREFHYCQSRLCVACQRMVVDEGIMRWYRYEDWFWRRDEVRSLDLQDYGKLFDVGCERLTSVD

SEQ ID NO: 1697 - protein, 390 aa, Zea mays
MEIDSLREGFDRVAEKRSLSSAKALEVVDQIVNEIEQAIVKLQMMNTDSTGNVDHPSILAELKAKLNEMAPLNQLEGSQKELNVALSKYLKLLEKSFNPDISKAYRNVDFEVHTVNNIIANHFYRQGLFDLGDMFVHECGELGGASLKLPFQEMYAILEAMKARNLEPALSWAAKNHDQLLQNGSMLEFKLYQLQFVEILSKGSRGEAKDEALLYARTHLVPFAAVHKEEFQKLMACLLWVGRLDQSPYSELMSSAHWEKLAEELTHQFCSLLGQSRESPLSVAVSAGFQGLPTLLKLTQVMAAKKQEWQVMKQLPVPIDIGPEFQYHSVFVCPVLREQSSDENPPMRMPCGHVVSKQSIMKLSKSSSRAFKCPYCPSEAMASHCKQLHF

SEQ ID NO: 1698 - protein, 235 aa, Zea mays
MRKFQDSIKALQADIDHANAMASEFLRDYDGSVIQMRVAYSAVAHFLLQWTDCKLAGALGLLKVMLYKVCADGSSALPDWEMEASIREFYGVIFPSLLQLPSGITELDDRKQRKLCLKKFRSRDEQLSEVDTERELECGICLEVSPKVVLPDCAHMLCMRCFEDWNAKSKSCPFCRACLEEVKPGSLWIYTDGSDVVDMDTLTRENIRRLFMYINKLPLVVLHVVDLDVYKYRIK

SEQ ID NO: 1699 - protein, 242 aa, Zea mays
MRKAYRDSIKVLEADIQHANTLASEFPRDYDGACLQMRLSYSPAAHIFLFLVQWTDCSLAGALGLLRILIYKVYVDGTTTMSTHERKASIKEFYAVIFPSLLQLQRGITDVEDKKQKAVCMEKYRKKDEDGRDTLSDIDVEREEECGICMEMNSKVVLPNCTHAMCIRCYQDWSSRSQSCPFCRDNLKKTCPSDLWIYVEDQDVVDMETVSSENLRRLFMYISKLPLIVPDVIFSVYDSHIK

SEQ ID NO: 1700 - protein, 419 aa, Zea mays
MELLPVEVVGNILSHLGVARDVMIASAVCRKWRDACRRHLRLLSFNSNDFPRDMTTRQLEIVITQTIFQTMGLQRLSIHIDNTHEFSAAPVIAWLMYTRETLRSLSYNVRTIPNVSILEKCGRQKLEVLDLELDHNTITGVEPSYQRFTCLKSLSLRHVSILALDLSLLVAACPRIESLALDVLEVVTSELQSTMELTSHTLKSLFAKSVGVDKIILDADNLEVLHLNALNLDLFELNGKGTLKHFKIDDVSVTHLDIGDNTDHLEAVDVSNFTIVWPKFYSMISRASNLRMLRFWGVVFDDEDEIVDSETIAVSFPLLRHLSLSYELRDGLLHYSLQGSSLLENVSVLELGWTVISEHFGPWVFGMIGRCPNLKKLVIHGVLSETKTREDRQMLASFTSFIVCVMRKYVHVDVQFEYE

SEQ ID NO: 1701 - protein, 335 aa, Zea mays
MGECEDGKEYRCWEELLPDALGLIFRNLPLQEVLTVLPRVCKSWGRVVAGPYCWQEIDIEEWSQQQSKPEQIGRMVELLVGRSGGSCRRISVSGLPCDPLFSFIADNARALGTLEIPRSEISDSVVEAVAPRLSNVTFLDISSCTKIGARALEAFGRHCRSLVGLRRVMHPIDLADKVCQHDEAHAIARSMPRLRHLEMGYMLVATEAVLEILGQCRELKFLDLRGCWAVDDRFLRERHPGLRVLGPRVVDDCYENSYWEECSDYYSDEDEDYDDDVVSWGLFVDDDDDYYYAVGSDDDEAIWDDAQGLENLEVRFYGGGGFGESFAGFDWPPSP

SEQ ID NO: 1702 - protein, 360 aa, Zea mays; identical to SEQ ID NO: 1632

SEQ ID NO: 1703 - protein, 620 aa, Glycine max
MAVTKEKEDVRNTGKRLKCMRNEEEEVYEEEESELPLKPGFFFYPTTPTSFVVSDALEPDFPIIYVNKVFEISTGYRADEALGRNCRFLQYRDPRAQRRHPLVDPVVVSEIRRCLEEGVEFQGELLNFRKDGTPLVNRLRLAPIHDDDGTVTHVIGIQLFSEANIDLNRVSYPVFKETCNQDFDKTGKYNPKSGQSLYSQHQEMCGILQLSDEVLAHNILSRLTPRDVASIGSVCRRIRQLTKNEHVRKMVCQNAWGKEVTGTLELMTKKLGWGRLTRELTTLEAVCWRKLTVGGAVEPSRCNFSACAAGNRLVLFGGEGVDMQPMDDTFVLNLDAKNPEWRRVSVKSSPPGRWGHTLSCLNGSWLVVFGGCGRQGLLNDVFVLDLDAQQPTWREVCGGTPPLPRSWHSSCTIEGSKLVVSGGCTDAGVLLSDTYLLDLTTDNPTWREIPTSWAPPSRLGHSLSVYGRTKILMFGGLAKSGHLRLRSGEAYTIDLEDEQPQWRQLEYSAFTGLASQSAVVPPPRLDHVAVSMPCGRIIIFGGSIAGLHSPSQLFLLDPSEEKPSWRILNVPGQPPKFAWGHSTCVVGGTRVLVLGGHTGEEWILNELHELCLASRQDSDL

SEQ ID NO: 1704 - protein, 682 aa, Zea mays
MIACANLKFANSAKLDRGPIEASHKLCSLKIVFPGSISPRTKPAKPLAHAEERERGCAGRRPASDDAGRRGVVAVKRMRLWEEEDEEGMEVDGEAEDEPGWPCGAPEAGLGETRPAAILVADAAEVDFPVIYVNAAFEAATGYRAHEVLGRNCRFLQFRDPHAQRRHPLVDPMVVSEIRRCLSEGIEFQGELLNFRKDGAPLHNRLRLVPMHGDDGYVTHVIGIQLFSEANIDLSSVSYPVYKQKSSSRPSIQDLNSSPHEHAPKIQSADHCGMLQLSDEVLAHNILSRLSPRDVASIGSVCTRMHELTKNDHLRKMVCQNAWGRDVTVRLEMSTKMVGWGRLARELTTLEAASWRKFTVGGRVEPSRCNFSACAVGNRLVLFGGEGVNMQPMDDTFVLNLEAATPEWRRVKVSASPPGRWGHTLSWLNGSWLVVFGGCGQQGLLNDVFVLDLDAQQPTWREVASEGPPLPRSWHSSCTLDGSKLVVSGGCAESGVLLSDTFLLDLTKEKPAWREIPTSWSPPSRLGHTTSVYGATKLFMFGGLAKSGSLRLRSSDAYTVDVSEDSPQWRQLATTTGFPNVSPPPRLDHVAVSLPCGRIIIFGGSIAGLHSPAQLFLIDPAEEKPIWRILNVPGQPPKFAWGHSTCVVGGTRVLVLGGHTGEEWILNELHELCLASRPDEDG

SEQ ID NO: 1705 - protein, 103 aa, Zea mays
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 1706 - protein, 211 aa, Zea mays
MAAKMFALFALLALCATATSATHIPGHLSPLLMPLATMNPWMQYCMKQQGVANLLAWPTLMLQQLLALPLQPCQMPMMMPGMMPPMTMMPMPNMMPSMMVPTMMSPITIASMMPPMMMPNMVSPMMMPSMMPSTMTPSMMPPIMMPSMIPPMMMPSMVSSMIMPNMMTVPQCYSDSISHIIQQQQLPFMFSPTAMAISPMFLQQPFVGAAF

SEQ ID NO: 1707 - protein, 307 aa, Zea mays
MEGTAAARKRSRPETANGAAAAGKRSKDTESFQTGLSSKSKPCTKFFSTIGCPFGEGCHFLHFVPGGYPAVAKMLNLSSSAVSAPSRTHVDHAALTGASHPASTVKTRMCTKYNTTEGCKFGDKCHFAHSERELAKPAYMSQEGPPMGGRYGRAEPMQPAAMGPPAGNFGASATAKISVDASLAGGIIGKGGVNTKQISRITGVKLSIRDHESNPNLKNIELEGNFDQIKQASDLVRDLIATISASMPAKNPSAAAAPAGGGRGGGPGGKSSNYKTKLCENFLKGACTFGDRCHFAHGETEQRRGAA

SEQ ID NO: 1708 - protein, 676 aa, Zea mays
MRPEERDAAVGRVRDQFPVGMRVLAVDDDPVCLKVLENLLRRCQYHVTTTNQAVVALSMLRQNRDLFDLVISDVHMPDMDGFKLLELVGLEMDLPVIMLSVNGETKTVMKGITHGACDYLLKPVRLEELRNIWQHVVRRKFSNCDRANNDGYEECNRPSNADFDLAHSQITAGPPDQSGRPSKKRKEYHSEEEDEGEESNGQDNDDPSAPKKPRVVWSVELHRKFVAAVNQLGIDKAVPKRILELMNVERLTRENVASHLQKYRLYLKRLSAVASQQASIVAALGGNDPFMRMSAFEGLHGYQSFVSSAALPSFSPQGLLNRNNPASFAIQGVSASRPIQIATGNTTMSHSIGDPNNKYHLSLPGTSSLQGNLAQGLPTPVGQVQLPQKWIHEETDDLSTILSASGQANNGVPGTLQSVTNSHLLQQGFVERRQDKVVIQPSSSASSDRPEGTVGVSSSLMDSCASHQRVVPLSAFSSSAAPMNGSFCSNGVAELGAASSGGTSIFPSNDLRIERDSKVGASSFGSVILLSPDTVPNQKYLNFGGGSDLRPNMEGGNAGNLLNPKLLWSCLPASQPPNLIGSHHPMSQRLNLGGSMVRQTTASASAAAPQTRIDMFISGDAPKSASDLSFPKVHSELSSSSCSFDGLLNSIIKVEKDDASFSDDLGCDLYSLGACI

SEQ ID NO: 1709 - protein, 473 aa, Zea mays; identical to SEQ ID NO: 1634

SEQ ID NO: 1710 - protein, 638 aa, Oryza sativa
MQRICPAHCSVTHSLTMKSMRLSYIPPAASAAPQSPSYGRKKNASAAPPSAAASTTVLTSPLVTTTRTPKQTEQEDEQLVAKTKTTRTVIATTNGRAAPSQSRPRRRPAPAAAASAASLPMTFCNALEEVINTFIDPPALRPAVDPRNVLTSNFVPVDELPPTPCPVVRGAIPRCLAGGAYIRNGPNPQHLPRGPHHLFDGDGMLHSLLLPSPASSGDDPVLCSRYVQTYKYLVERDAGAPVLPNVFSGFHGVAGMARGAVVAARVLTGQMNPLEGVGLANTSLAYFAGRLYALGESDLPYAVRVHPDTGEVTTHGRCDFGGRLVMGMTAHPKKDPVTGELFAFRYGPVPPFVTYFRFDPAGNKGADVPIFSVQQPSFLHDFAITERYAIFPEIQIVMKPMDMVVGGGSPVGSDPGKVPRLGVIPRYATDESEMRWFEVPGFNIMHSVNAWEEAGGEELVLVAPNVLSIEHALEHMELVHSCVEKVRINLRTGVVTRTPLAAGNFDFPVINPAFLGRRNRYGYFGVGDPAPKIGGVAKLDFDRAGEGDCTVAQRDFGPGCFAGEPFFVADDVEGNGNEDDGYLVCYVHDEATGENRFVVMDARSPDLEIVAEVQLPGRVPYGFHGLFVTQAELQSQHQ

SEQ ID NO: 1711 - protein, 576 aa, Oryza sativa
MEVPIAAMTFAHPANVMTLASRQPKSKRSHISPATTAHRNLQTRLAHHHHATPASLPMAICNTVDKVINRFIDLPEQRPTVDPRRVLSGNFAPVDELPPTSCHVIRGSIPSCLAGGVYIRNGPNPQHRLPQRTHHLFDGDGMLHSLLIPSASSTLLSEPVLCSRYVHTYKYLLERETGGPVLPNFFAGFHGVAGLARAVVMIARVLAGQINLNKGFGLANTSITLFADCLYALCESDLPYSMHINPANGEVTTLGRCDFGGDLSFRMTAHPKKDPVTMELFAFRYNVFQPFITYFWFDRAGSKVADVPILSLQKPSVMHDFAITERYAIFPESQLIVNPMDMVMRGSSLVGLDRTMVPRIGVLPRYAKDESDMRWFEVPRFNMLHTTNGWEEADGEEIVLVAPNILSIEHMLGNMELMRARVDMVRINLCTGDVSCTALSPESLEFGVIHQGYVGRKNRYGYFGVSGPLPKIKGIRKLDFDLVGSGDCTVGRRDFGLGCFAGEPFFVPDNIDGYGNEDSGYVVCYTHEEDTGESWFVVMDAKSPELDIVAEVQLPSRIPYGFHGIFVKQAELLAQQ

SEQ ID NO: 1712 - protein, 55 aa, Synechocystis PCC6803
MAKRRNLKKEKAERNRAYARQFRSASRTQNRRYSGGQRQQGDSNGSSNNGAASDV

SEQ ID NO: 1713 - protein, 71 aa, Synechocystis PCC6803
MFKPSLLLSLLVVGCLLTVTGCGGGNQREEGQPTQQNIEQQENNNGNANTNDDDNDNNDDDEEDDNKDGDD

SEQ ID NO: 1714 - protein, 242 aa, Arabidopsis thaliana
MGRGRVQLKRIENKINRQVTFSKRRSGLLKKAHEISVLCDAEVALIVFSSKGKLFEYSTDSCMERILERYDRYLYSDKQLVGRDVSQSENWVLEHAKLKARVEVLEKNKRNFMGEDLDSLSLKELQSLEHQLDAAIKSIRSRKNQAMFESISALQKKDKALQDHNNSLLKKIKEREKKTGQQEGQLVQCSNSSSVLLPQYCVTSSRDGFVERVGGENGGASSLTEPNSLLPAWMLRPTTTNE

SEQ ID NO: 1715 - protein, 251 aa, Zea mays; identical to SEQ ID NO: 1569

SEQ ID NO: 1716 - protein, 244 aa, Glycine max
MGRGRVQLKRIENKINRQVTFSKRRSGLLKKAHEISVLCDAEVALIVFSTKGKLFEYSSDPCMERILERYERYSYAERQLVASDQPQTENWTLEHAKLKARLEVLQKNQRNFMGQDLEGLSIKELQNLEHQLDSALKHIRSRKNQIMHESISELHKKDKVLQEQNNTLAKKIKEKEKALAQHAQMEQRGDEMDLTSSALVPHPLETSNIRESSQIRGEGDNEGTPTPTRANAILPSWMLRPSNE

SEQ ID NO: 1717 - protein, 239 aa, Glycine max
MGRGRVDLKRIENKINRQVTFSKRRSGLLKKAREISVLCDADVALIVFSTKGKLFDYSNEPCMKRILERYERYSYAERQLAGDDQAPNENWVIEHEKLKARVEVLQRNQRNFMGEDLDSLNLRGLQSLEQQLDSALKLIRSRKNQAMNESISALQKKDKSLREHNNLLSKKIKDKEKELAPQEQDGLQNNMDVTSVLVTQPPESLTIGGFPEAKCNEETPTSSRPKTILPPWMPLPTNE

SEQ ID NO: 1718 - protein, 245 aa, Zea mays
MGRGKVQLKRIENKINRQVTFSKRRSGLLKKAHEISVLCDAEVALIIFSTKGKLYEYSTDSCMDKILDRYERYSYAEKVLISVESETQGNWCHEYRKLKAKVETIQKCQKHLMGEDLETLNLKELQQLEQQLESSLKHIRTRKSQLMLESISELQRKEKSLQEENKVLQKELAEKQKAQRKQVQWGQTQQQTSSSSSCFMIREAAPTTNISIFPVAAGGRLVEGAAAQPQARVGLPPWMLSHLSS

SEQ ID NO: 1719 - protein, 266 aa, Zea mays
MGRGKVQLKRIENKINRQVTFSKRRNGLLKKAHEISVLCDAEVAVIVFSPKGKLYEYATDSRMDKILERYERYSYAEKALISAESESEGNWCHEYRKLKAKIETIQKCHKHLMGEDLESLNPKELQQLEQQLESSLKHIRSRKSHLMAESISELQKKERSLQEENKALQKELAERQKAVASRQQQVQRDQQTHAQAQTSSSSSSFMMRQDQQGLPPPHNICFPPLTMGDRGEELAAAAQQQPLPGQAQPQLRIAGLPPWMPSHLNA

SEQ ID NO: 1720 - protein, 266 aa, Zea mays
MGRGKVQLKRIENKINRQVTFSKRRNGLLKKAHEISVLCDAEVAVIVFSPKGKLYEYATDSRMDKILERYERYSYAEKALISAESESEGNWCHEYRKLKAKIETIQKCHKHLMGEDLESLNPKELQQLEQQLESSLKHIRSRKSHLMAESISELQKKERSLQEENKALQKELAERQKAVASRQQQVQWDQQTHAQAQTSSSSSSFMMRQDQQGLPPPHNICFPPLTMGDRGEELAAAAQQQPLPGQAQPQLRIAGLPPWMLSHLNA

SEQ ID NO: 1721 - protein, 642 aa, Oryza sativa
MASGGGSSNWLGFSLSPHMPAMEVPSSSEPSTAAHHHHHHHPPAAAAAAGAMSSPPDSATTCNFLFSPPAAQMVAPSPGYYYVGGAYGDGTSTAGVYYSHLPVMPIKSDGSLCIMEGMMPSSSPKLEDFLGCGNGSGHDPATYYSQGQEAEDASRAAYQHHQLVPYNYQPLTEAEMLQEAAAAPMEDAMAAAKNFLVTSYGACYGNQEMPQPLSLSMSPGSQSSSCVSAAPQQHQQMAVVAAAAAAGDGQGSNSNDGGEQRVGKKRGTGKGGQKQPVHRKSIDTFGQRTSQYRGVTRHRWTGRYEAHLWDNSCKKDGQTRKGRQVYLGGYDTEDKAARAYDLAALKYWGLSTHINFPLENYRDEIEEMERMTRQEYVAHLRRRSSGFSRGASIYRGVTRHHQHGRWQARIGRVAGNKDLYLGTFSTQEEAAEAYDIAAIKFRGLNAVTNFDITRYDVDKIMESSSLLPGEAARKVKAIEAAPDHVPIGRELGATEEASAATVTGTDWRMVLHGSQQQQAAACTEATADLQKGFMGDAHSALHGIVGFDVESAAADEIDVPGGKISGINFSNSSSLVTSLSNSREGSPERLGLAMLYAKHHPTAVSLAAMNPWMPMPAPAAAHVMRPPSAIAHLPVFAAWTDA

SEQ ID NO: 1722 - protein, 333 aa, Zea mays
MSKAKVYTDVNVLRPKEYWDYEALTVQWGEQDDYEVVRKVGRGKYSEVFEGINVNNYEKCIIKILKPVKKKKIKREIKILQNLCGGPNIVKLLDIVRDQHSKTPSLIFEFVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNAYLNKYHIELDPQLEALVGRHSRKPWSKFMNADNQHLVSPEAIDFLDKLLRYDHQDRLTAREAMAHPYFLQVRAVENSRTRPQ

SEQ ID NO: 1723 - protein, 372 aa, Saccharomyces cerevisiae
MKCRVWSEARVYTNINKQRTEEYWDYENTVIDWSTNTKDYEIENKVGRGKYSEVFQGVKLDSKVKIVIKMLKPVKKKKIKREIKILTDLSNEKVPPTTLPFQKDQYYTNQKEDVLKFIRPYIFDQPHNGHANIIHLFDIIKDPISKTPALVFEYVDNVDFRILYPKLTDLEIRFYMFELLKALDYCHSMGIMHRDVKPHNVMIDHKNKKLRLIDWGLAEFYHVNMEYNVRVASRFFKGPELLVDYRMYDYSLDLWSFGTMLASMIFKREPFFHGTSNTDQLVKIVKVLGTSDFEKYLLKYEITLPREFYDMDQYIRKPWHRFINDGNKHLSGNDEIIDLIDNLLRYDHQERLTAKEAMGHPWFAPIREQIEK

SEQ ID NO: 1724 - protein, 408 aa, Oryza sativa
MAWCAARSRLLPLATAPQLLRRLLLSSAAAPRYAHPHHHHSNSRRRRRPLAPTVYAAAAAAAAEAPLPMPPRIGRATRHPGGAASVARVYADANSQRPKEYWDYESLDIEWGEQDGYEVLRKLGRGKYSEVFEGFRPGGDERCVIKILKPVKKKKIKREIKILQNLYGGPNIVKLLDVVRDDESKTPSLIFEYVNNTDFKVLYPTLLDYDIRYYIYELLKALDYCHSRGIMHRDVKPHNIMIDHEKRQLCLIDWGLAEFYHPKMEYNARVASRSYKGPELLVDLLDYDYSLDLWSLGCMFAAMIFRVDPFFNGQDNYDQLVKITEVLGTEDFYNYLEKYGLELDPQLERLVGRHNRKPWSMFVNSGNRHLASPEAIDFVDRLLRYDHQERPTAKEAMAHPYFNPVRST

SEQ ID NO: 1725 - protein, 333 aa, Glycine max
MSKARVYTDVNVLRPKEYWDYESLTLQWGDQDDYEVVRKVGRGKYSEVFEGINVNSNERCIIKILKPVKKKKIKREIKILQNICGGPNIVKLLDIVRDQHSKTPSLIFEYVNSTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDELNAYLNKYHLELDPQLDALVGRHSRKPWSKFINADNQHLVSPEAIDFLDKLLRYDHQDRLTAREAMAHPYFSQVRAAESSRMRTQ

SEQ ID NO: 1726 - protein, 280 aa, Oryza sativa
MSGAYRDRGFGGAAAEMDRKRIKDVLEKHLDRSSPSTSRGAAVAKERDRLAAAGGKLPAPLGKAGKVSDGAEEFETDSEDSDVSGSEGEDTSWISWFCSLRGNEFFCEIDDDYIQDDFNLCGLSNQVPYYDYALDLILDIESSNGDVFTEEQNELIESSAEMLYGLIHARYILTSKGLAAMLEKFKNYDFGRCPRVYCCGQPCLPAGQSDIPRSSTVKIYCPKCEDLHYPRSKYQGNIDGAYFGTTFPHLFLMTYPHLKPQKPSQQYVPKVFGFKLHKQS

SEQ ID NO: 1727 - protein, 278 aa, Saccharomyces cerevisiae
MSQEFVEDYSRTGSSDDEDSGAYDEWIPSFCSRFGHEYFCQVPTEFIEDDFNMTSLSQEVPHYRKALDLILDLEAMSDEEEDEDDVVEEDEVDQEMQSNDGHDEGKRRNKSPVVNKSIIEHAAEQLYGLIHARFILTKPGLQAMAEKFDHKEFGTCPRYYCNGMQLLPCGLSDTVGKHTVRLYCPSCQDLYLPQSSRFLCLEGAFWGTSFPGVFLKHFKELEEYVERKSKESYELKVFGFRINDEAVSGPRMKWLRQYPSTEEDWEEFAKCEFETPAV

SEQ ID NO: 1728 - protein, 275 aa, Zea mays
MHRDRGVSAAAIPGDRKRIGEPMDRSSPSTSWGFSGGREKERIGVGKQPEMPRSGGGSTAMSKSKLSDESETDSEESDVSGSDGEDTSWISWFCSLKGNEFFCEVDDDYIQDDFNLCGLSNQVPYYDYALDLILDVESSHGDMLTEEQNELIESAAEMLYGLIHVRYIITSKGLSAMLDKYRNVEFGRCPRVNCSGQPCLPVGQSDVPRSSTVKIYCPRCEDIYTPRSKYLSNIDGTYFGTTFPHLFLMTYPHLKPQKPLQQYVPRVFGFKIRKP

SEQ ID NO: 1729 - protein, 272 aa, Zea mays
MYKQGGAGGGAGLDRKRINDALDKHLEKAVASPSTSRGSAGGGRDHHRLVVPSSVSSIPKGRCSEGESDSDSEASDVSGSDGEDTSWISWYCNLRGNEFFCEVDDDYIQDDFNLCGLSSQVPYYDYALDLILDIESSHGDMFTEEQNELVESAAEMLYGLIHARYILTSKGLAAMLEKYKNYDFGRCPRVYCCGQPCLPVGQSDIHRSSTVKIYCPKCEDIYYPRSKYQDIDGAYFGTTFPHLFLMTYEHLKPQKLSQRYVPRVFGFKLHKP

SEQ ID NO: 1730 - protein, 447 aa, Zea mays
MASSLAPASWALPLQMGGAGAAAAGPSCRATLAVVTEPRWAASLRRARVLVALAPRCVALDGPGASGEEEAPKIEDERKKSGETKKPARGRPVWSRILFASKKTRSIIILNALTVIYASDIPVLKEVEALTEPAVFNMVRFVVAAIPFVPFALRSFGDRSVRYAGLELGVWVSLAYLSQAIGLLSSDAGRASFITAFTVVVVPLIDGLLGASIPRLTWFGAIMSLFGIGLLECGGSPPSVGDILNFFSAVFFGIHMLRTEQISRSTDKKKFLALLGFEVLVVAFSSVLWFMFKDGYVDTSGSSFESWTFGMLWDTTVSFPWIPALYTGVLSTVLCMWAEMVAMGDVSATETAVVYGLEPVWGAAFAWFLLGERWDDAAWTGAALVLCGSLTVQLFGSAPEKSKKVKKRSSNALETPVKRRDYLSLSPIPVDSGKIIGRQLERKNKAV

SEQ ID NO: 1731 - protein, 361 aa, Zea mays
MDVEARKDAAPARGKAVRRFLVALNCGMLALGAIGGPLLSRLYFSKGGHRQWLSAWLETGGWPLLLVPVAASFGARRARDRGAPVLLTPPRILLAAAGLGVATGVDDFVYAYGLAYLPVSTSAILISTQLAFTVFFAFLVVRQRLTAASVNAVALLTVGAVVLGLHVSSDRPPGVTRGRYWLGFSLTLCAAALYGLVLPLVELAYRRAAGGGRAVTYALVVEMQLVMGFFATAFCTVGMVVNKDFQAIPREARQYELGEARYYMVLAWAAVLWQCFFLGAVGVIFCVHTLLAGILIAVFIPVTEVAAVIFLHEKFSSEKGVALALSLWGLASYSYGEWSQAKAKKEKKSEEDDGEVAQAVP

SEQ ID NO: 1732 - protein, 421 aa, Zea mays
MGGIPREPSFSRWCRDPSAASASNTAAAAATSDSDASEEFELPLLPSSSGGGGSPMDIEVGATARSDDLPISPRLLAKVIGLIACWYTLSTCLTLYNKEMLGKHMWKFPAPFLMNTVHFTMQAVASRAIVWFQQRGLEGGPSKMSWKDYCLRVVPTALATALDINLSNISLVFITVTFATMCKSASPIFILLFAFMFRLEKPSFSLLGIMLVVSFGVLLTVAKETEFNLWGFMFIMLAAVMAGFRWSMTQILLQKEEYALKNPFTLMSHVAPVMAIVTAIISIVMDPWHDFRASHFFDSSTHIIRSSLLLLLGGALAFFMVLTEYVLVSVTSAVTVTVAGIVKEAVTILVAVLFFNDPFTWLKALGLAIIIFGVSLFNIYKYKRFKKGHHSEDAGTNIQSYNGTSKYVILDDDTEDQDDSG

SEQ ID NO: 1733 - protein, 366 aa, Zea mays
MVMMMRSCLGGGLLPVAVMLCLNVVAAVMVSLVKVAMDGGMKPLVIVTLQQLTAAVFLAPIAFFKERKSRPKLTLEIFAYIFVSAALGAALRQYMIFVALRYTTATFVTAFSNIAPVLTFLLAVATRSEALDLKSRTGLAKLLGTLVSLAGAMVLTLYKGVALTHAAAASQDQQQHSHGRLPPSAADSRGKWTLGTVAILGNCVCLSCWFLLHGRLAKKYPHVYSCNALMSLLSFLQVAVVGLCTQRSISPWIVTSKFNILTVLYAGIVGCGVSFVLVTWCIEKRGAVFVAAFIPVVQIIVSVIDFSILHEQLYLGSVLGSVLVIGGLYLLLWGKRQEALHCPPPPPPKVAEEDPADKEQQQVQHN

SEQ ID NO: 1734 - protein, 356 aa, Zea mays
MLVEMGSRAAFVVAFLLRAIYAGTQILTKAAFDEGMNTSVFVFYRHLTGILFLVPIAFVLERKTAPPLSFRVSLKLFFHALYGISGAINIYGLGLSYSSATSSSAIFNLLPAVAFFLAVLLGMETLNLKRFHGIAKAAGVLFSTAGVTVLAFYQGPAFRSFIHHTAFSHHNVHAGVVTAAHPKSVWILGIFLTTLSTASWALWTVLQGPMLEAYPSKLLNTTLQMIFATVQCFFIALAAERDLSRWKLALDIRLYAVIYSGILVSGVAYYMQVWVIEKSGPVFLAMTMPITLLVTIILSLFLGEPVTLGSILGGLIMVGGLYSVLWAKRSEQVHASKQQMAAPTPPPAGDTSVGRA

SEQ ID NO: 1735 - protein, 383 aa, Zea mays
MGVGKLMNDVKPYLAMVLLQVGFSGMYIVSVASLKRGMNHFVLVVYRNLVATVVMAPFALLFERRVRPKMTPLIFLKIMGLAVLEPVLDQNMYYLGAKLTSATFASALVNILPAITFLLALALRMERLRLRSLRSQAKVVGTVCTVAGAVLMILYHGPVVPFPWSAGRLHHHVPAAAVESQSSASWLNGICMIIGSCLCWSGFFILQSNTLQSYPAELTLTTLICFLGSVLTGGVALVAERRDMSAWVIGFDTRLFTAVYSGIVCSGVAFYVQGIVTQARGPVFVTAFQPLCMIITTVLGSTILKEETTLGSVIGAAIIVVGLYCLIWGKSKDHLGSNGGKPGAAAVAELPLTSSAPAWSNGKQALAVVETTPPSSLPNKCVH

SEQ ID NO: 1736 - protein, 360 aa, Zea mays
MLRRQGRGGKFLEEVLIVGGLLLVQCVLSGYVVFTDHLLALGADPLAVVVVAGAAYAAFCFPFAVALERKRWPSTVSGTLVAQYLLIALGGTTAFQALMLLGIKKTTPAIASAMPNLSPGLIFIVAACFRLERFDRACKYTQAKMAGTVVCLAGALAMGFLHSPTSTSSSLQAAVAAEAAAGGGDYYYDWILGCCCLVAAVTVFALVTVLQAATLAAFPAPLTMCCATSATGAALTAVLRLVLEGRFLGMGSPRIDATLVAGIVVLGGAAVGACMAFQAWCLGRKGPLFVSVFGPVQTVCTAILSAALLRQVLSLGSLAGIVLMFTGLYIVLWAKSNEISADDEEQSLQGGDDAEKALLA

SEQ ID NO: 1737 - protein, 393 aa, Zea mays
MADSGEGRRVCGMPEKAQLHVAMLLLQFGYAGFHVVSRLALNMGISKLVFPVYRNIIALCLLVPFAYFLEKKDRPQLTLNFVVQFFLLALCGITANQGFYLLGLDNTSPTFASAIQNSVPAITFAMAAALRIEKVRLDRRDGVAKVAGTLACVAGASVITLYKGPTIFGPSGSGGGGGLELAAVGGDKNWTLGCVYLIGHCLSWSGWLVLQAPVLKKYPARLSVTSYTCFFGVIQFLVIAAFMERDAEAWKFHSGSELFTILYAGFIASGVAFAVQIWCIDRGGPVFVAVYQPVQTLVVAIMASLTLGEKFYLGGIIGAVLIVAGLYLVLWGKSEERARVARDAVSGGDREGLLVAAAAGGGGGGIIRSAGNKVASAATQPLLLPSSTSTDNV

SEQ ID NO: 1738 - protein, 377 aa, Zea mays
MANSRIGRYKMSTLSDPSKEDTSPEGSGTTQRNGAWSNTLNTLLQQASVYGVAAGYCLSASLLSIINKWAIMKFPYPGALTALQYFTSVAGVLLCGQLKLIEHDGLNLRTMWKFLPAAVMFYISIFTNSELLLHANVDTFIVFRSAVPIFVAIGETLYLHQPWPSLKTWLSLSTILGGSVIYVFTDNQFTVTAYTWAVAYLASMSIDFVYIKHVVMTIGLNTWGLVLYNNLEALMLFPLELLIMGEFDQMKVDSSKVSNWLSFDVVLPVALSCLFGLSISFFGFSCRRAISATGFTVLGIVNKLLTVVINLLIWDKHASFVGTIGLLICMSGGVLYQQSTMKPKAPKVEPKEENDNDEEQQKLLQMQGVQESNPTQK

SEQ ID NO: 1739 - protein, 344 aa, Zea mays
MEAEKKPPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVTVVAAGVGICTVTDVEVNAKGFICACVAVFCTSLQQITIGSFQKKYNIGSFELLSKTAPIQALSLIILGPFVDYYLNGRSLLNYPFSGGATFFILLSCSLAVFCNMSQYLCIGRFSATSFQVLGHMKTVCVLILGWILFDSALTVKNILGMLLAVMGMVVYSWAVEAEKKAAAPIPRNKGGMLDGEDVPLKARVSGVPAVDLEDGDVKG

SEQ ID NO: 1740 - protein, 364 aa, Zea mays
MSGMAARIGEWKPVMAMLIFDLISAVTTALIKKALQEGLDRLVLITLRQLVATVFLAPIAYFRERSTRPKLTLEILVYLFFSAAFGAALSQYTFFYGLQYTTATFAITFTNVAPVLTFLIAVLLRVESLSMKNKAGAAKIAGTLTSFAGVMLLTLYKGVSLTHQQAGEASPEDHNLGAAAASPSDRKSWTLGTLALLANCLCFSFWLLLQSRLTKKYPALYSSTAYMFLISSMQGGALTAAIQRRASVWLLTRPIEIVTVLYTGIMGSGVGYVLMTWCVEKRGPVFTSAFIPVIQIMVAMVDFFFLHENLYLGSVLGSILLILGLYILLWGKKRDASSSAAAKEEEDGEKEDEEEEDKEKQVRS

SEQ ID NO: 1741 - protein, 409 aa, Zea mays
MAVVAGDSESLMQRCKPYVAMISLQFGYAGMNVITKVSLNHGMSHYVLVVYRHAFATLSIAPFALVLERKVRPRMTLWAFLQIFVLALLGPVIDQNFYYAGLKFTSPTFSCAMSNMLPAMTFVLAVLFRMEKVNLKKARCVAKVVGTLVTVAGAMLMTLYKGRVVELVWTKHIHLHGPHPDAAAAAAAADKDWFTGSIFLIIATLAWASLFILQAATLKRYDAPLSLTTLICFVGTLQAIVVTFVMEREPSVWRIGFDMNLLAAAYAGIVTSSIAYYVQGLVIQSRGPVFASAFSPLMMIIVAIMGSFILAENIYLGGIIGSVLIVAGLYSVLWGKHKENEEKEGEAAMEIPVAIKAVDGNGRIMEIVELDEVQLEKAQANTNANANAAVAVTAVPAAEARMQGKDDQA

SEQ ID NO: 1742 - protein, 347 aa, Zea mays
MEFKRDVWSLLLVLLLGQLVAFSMAASSFASSLIANLGVDAPLTQSFLAYLLLTLVYVPIVLRRRQKLQIAWYWYLALAFFDVQGNYLVVKAYQYSYITSVTLLDCWTVVWVVMLTWYALGTRYSLWQFVGAGTCVAGLALVLLSDAKSQDEQDPKKIPLLGDALVIAGTVGFAFSNVGEEYCVKKKDRAEVVAMLGLFGLLISTVQILVFERKGLEAVTWSPTMISLFAGFAVAIFVFYTVAPFVLKMSGATLFNLSLLTSDMWAVAIRVLFYQQEINRLYYLAFTVVAIGLIIYSLNDRSSDDETAGSTEAPAQYQQLPIEDNSTRIGSSSGSQERTHKEEVHIC

SEQ ID NO: 1743 - protein, 499 aa, Zea mays
MRRGSAYLIGFLFKNTKLYLADEASDMMSTLIILLSDTDKATVSAALEAFSRVVASVPKEQLPTHIKLVRDAVSTARDKERRRRKGVPILLPGLCLSKALQPFLPIFQQGLISGSAETKEQAAEGLGELIDVTSEKTLKEVVVPITGPLIRILGDRFPWQVKSAILSTLTIIIMKGGIALKPFLPQLQTTFVKCLQDNNKSVRTRAAAALGKLSALSTRVDPLVSDLLSMLQSGDESVKESVLSALKGVIKHAGKSVSAPIRSRGCALLEDLLQAEADDIRSCAAKVIGTLSQYMDDREIPDLVQILLEVGTSSDWCTRHGALLALSSISMHSPSKLCDLASFPSLVDLLKDSLKDDKFPVREVATRTLGRILVFELQSEADTLQLVQLLVLALRDDSSEVRRRSLSCIKAAAKMNHSALATHHSILGPAIADALKDSSMPVRLAAERCALHVFQLTKGPDNVTTAQKYLGMTGLEVKKIAKLNEESDGSESSDDDRRT

SEQ ID NO: 1744 - protein, 373 aa, Glycine max
MMDRRHCYKDLLPLVVLVANECNNTGLFTLFKAATLQGMSNYVFVTYAYSVAFLVLLPVTFFYRRSRVVPPLTFSILSKIALLGVIGCSSQILGYAGIRYSSPTLSSAISNLTPAFTFVLAVICRMEKIAVKRRTTQAKILGSIISVLGAFVVTFYKGQSVIIADNSPSIQLPQSNGILTSVDRNWVIGGLLLTACNILLTVWFVYQVEILKEFPDELSMVFFYNLCAAIVASIVGLLGEKNSSAWKIRPDISLISIVCTGIFNKFLSSAIYAWGIHLKGPVYVAMFKPLSIVIAVAMGVMFLGDSLYVGSIIGATIISIGFYTVMWGKATEQKEEEGEEENVGSQESSITENVPLLQSYITVNSTKKIDGSV

SEQ ID NO: 1745 - protein, 351 aa, Glycine max
MGRWVNCRGNIFPFLGMVMAMLAQSGSMVVIKVAMTDGINKYVMVVYSLALSTILLLPFALFLHRSERPPLTFSALCSFFLLAFFGSSGQIMAYVGIDLSSPTLASAMLNLIPAFTFILALIFRMEEVHWKHSSSQAKFLGTIVSIAGAFVVILYKGPPIFKTHLSNSSNKFLFSQQLNWILGGMFCAGDSIVCSLWYIYQASVAYKYPAVTTIVFFQLLFSTIQCGVFALIVVQDQTEWELKLDIGLIGIVYQAIAATLIRYILCTWCVLKAGPLFCSMFKPVAIIFSVFMGAIFLGDDLSLGSLIGAVIIVIGFYAVLWGKSIEDNKIEKGVENLESSCHNVPLLQNRT

SEQ ID NO: 1746 - protein, 346 aa, Glycine max
MGKGGSLSDGVVKKIVLSYSYVAIWIFLSFTVIVYNKYILDKKMYNWPFPISLTMIHMSFCATLALLLVRVFRLVEPVSMSRDVYLSSVVPIGALYSLSLWLSNSAYIYLSVSFIQMLKALMPVAVYSIGVMLRKESYKNDTMLNMLSISLGVGVAAYGEARFDAWGVLLQLGAVAFEATRLVMIQILLTSKGISLNPITSLYYVAPCCLVFLSIPWIFVEYPVLRDTSSFHFDFVIFGTNSFCAFALNLAVFLLVGKTSALTMNVAGVVKDWLLIAFSWSVIKDTVTPINLFGYGLAFLGVAYYNHSKLQALKAKEAQKKTAQADEEEGRLLEDRDDNKRNEQQT

SEQ ID NO: 1747 - protein, 350 aa, Glycine max
MKELGLVSMMLMAELLDVIVNTLSKAAMKKGMNDFVFIMYSNAFAACLLLLLALFFYRKRTLPPLSCNTLGLFLVVGMLSCINQSIKFFGIGYSSPTLASALSDLVPAFTFILAVIFRMEKLDWKANSTLAKSIGTVVSIAGALLLSLYKGQVIINNNPPFKLFPQKLVSSMQFDWVFGALLLAAHSCFLSINYILLTRIVREYPAELVVVLSRIALTSILSVPAALISVKDLKALRLGFNMELIAIGCSAIFVLSFRGVIHIWIMGKRGPVYVAMFKPLEIVFAVILGVTFLGDSLYIGSVIGAAIIVVGFYAVIWGKSQEKVEEDCTVCSSESYDNEVPLLQNKRTGE

SEQ ID NO: 1748 - protein, 362 aa, Glycine max
MEVMCGAKVGNMVHKAKPYVLTVGLQFGMAGTYLFTMASLNHGMSRLVFIVYRNAIAALALAPFALIFERKVRPKMTWTVFIQILVLGFLEPVVDQGFTFLGMQYTSASFASAVMNAVPSVTFVLAVIFRLEHIKIRELRSQAKVIGTLVTFAGALLMTLYKGPQFDLFHHSNTTHQQGGSHTQNHSHWVAGTLFICLGCLAWSSFYILQSITVKRYPAELSLSSLICLAGALQSAVVALIADHNPRAWAIGFDYSLYGPLYTGIMSSGIAYYIQGLVMQSRGPVFVTSFNPLCMIIVTALGSFLLGEHLYLGSIIGGIIIAVGLYSVVWGKGKDYKDDTSSPATTKETETMQLPITLPNNK

SEQ ID NO: 1749 - protein, 412 aa, Glycine max
MASWWCSSPSATLTVSTTTTRHFSLLSHTSQFRIQTLTFPPSSFTRFTTAPPSLRFRVPCSNKTAFETELPEDGVDCVGTGQDVECLVNTEEKQSEPSSSSSSSSSSSSMLCLAEALWEGAVLVSPFFFWGTAMVAMKEVLPKCGPFFVSAFRLIPAGFLLVAFAASRGRTLPSGFNAWLSITLFALVDAACFQGFLAEGLQRTSAGLGSVIIDSQPLTVAVLAALLFGESIGVVGAAGLVLGVIGLVLLELPALSFDESNFSLWGSGEWWMLLAAQSMAIGTVMVRWVSKYSDPVMATGWHMVIGGLPLVLFAVLNNDPAVSLSLKEYSSTDILALLYTSIFGSAVSYGVFFYSATKGSLTKLSSLTFLTPMFASIFGFLYLGETFSPVQLVGALVTVAGIYMVNFRSTSE

SEQ ID NO: 1750 - protein, 333 aa, Glycine max
MSSVSKGDRKASIDAASWLFNVVTSVGIILVNKALMATYGFSFATTLTGLHFATTTLLTLILKSLGYIQTSHLPLSDIIKFVLFANFSIVGMNVSLMWNSVGFYQIAKLSMIPVSCFLEVVLDNVRYSRDTKLSIVLVLLGVAVCTVTDVSVNAKGFIAAVIAVWSTALQQYYVHFLQRKYSIGSFNLLGHTAPAQAASLLLVGPFMDYWLTGKRVDAYGYGLTSTLFIILSCTIAVGTNLSQFICIGRFTAVTFQVLGHMKTILVLILGFIFFGKEGLNLHVVLGMIIAIAGMVWYGSASSKPGGKERRSFSLPKTQDYSSLPVSSEPDTKE

SEQ ID NO: 1751 - protein, 329 aa, Glycine max
MATFEQFWSRKTLLGLALGQFLSLLITSTGFTSSLLAKKGINAPTSQSFLNYVFLAIVYGIIVLYRREALKAKWYYYILLGLVDVEANFLVVKAYQYTSLTSVMLLDCWSIPCVMLFTWIFLKTKYGFKKVTGVVVCIAGLVLVVFSDVHAGDRAGGSNPSIGDILVIAGATLYAVSNVSEEFLVKNADRVELMAMLGLFGGIISAIQISILERNELKSIHWSAGAVLPFVGFAVAMFMFYSLVPVLLKINGSTMLNLSLLTSDMWAVLIRIFAYHEKVDWMYYVAFGAVVVGLIIYSGGDGDENQDPHHVAEDASQRQHDEEATSGKS

SEQ ID NO: 1752 - protein, 371 aa, Glycine max
MAKRVFLYKDLVPFGAMVTMECLNVALNTLFKAATLRGMSYHVFVVYAYAVAAIVLIPGPFISQRCRSRVLPPLSFPLLRKIGLLGLIGCASQIVGYTGISFSSPTLSSAISNLVPAFTFLLAIIFRMEKVIVRNTTCQAKVLGTIVSITGAFVVTFYKGPPIIIVHTPSLSLHQPINTLNSVDRSWAIGGLLLTAEYILVPLWYIVQVQIMKVYPNELTVIFFYNLCVSIMAAIVAIFTETNAGAWKIGLDTALASIVCSGIFGSFVNNAVHTWVLRIKGPVYVAMFKPLSIAIAVALGVMFLGDTLHLGSLVGATVISIGFYTVMWGKATEENVDEDVPGQQSPPTTENVPLLQSYKTDTAEKKMHGSV

SEQ ID NO: 1753 - protein, 389 aa, Glycine max
MADLGSASSKRMWCSVPERMQLHLAMLALQFGYAGFHVVSRAALNMGVSKLVFPVYRNIIALLLLLPFAYFLEKKDRPAMTLNFVCQFFLLALVGITANQGFYLLGLENTSPTFASAIQNSVPAITFLMAAILRIEQVRLNRKDGLGKVAGTVLCVVGATVITLYKGPTIYSPTTGVNINNTRVTQVFELGSVSLGDAKGKNWTLGCLYLIGHCLSWSGWLVLQAPVLKKYPARLSVTSYTCFFGLLQFLVIALLLERDAQAWLFHSGGEAFTILYAGVVASGIAFAVQIWCIDRGGPVFVAVYQPVQTFVVAIMASIALGEEFYLGGIIGAVLIVAGLYLVLWGKSEERKFAREQLAIASTEHSIIRPASHAKASLAQPLLSSSTENV

SEQ ID NO: 1754 - protein, 306 aa, Glycine max
MKSSRRLLRIGLVSAWYSSNIGVLLLNKYLLSNYGFKYPIFLTMCHMTACSLFSYVAIAWLKMVPMQTIRSRLQFLKIAALSLIFCFSVVFGNVSLRYLPVSFNQAVGATTPFFTAVFAYVMTFKREAWLTYLTLVPVVTGVVIASGGEPSFHLFGFIVCIAATAARALKSVLQGILLSSEGEKLNSMNLLLYMAPIAVVFLLPATLIMEENVVGITLALARDDVKIIWYLLFNSALAYFVNLTNFLVTKHTSALTLQVLGNAKGAVAVVVSILIFRNPVSVTGMMGYSLTVLGVVLYSQAKKRSK

SEQ ID NO: 1755 - protein, 367 aa, Glycine max
MGAGLVAFLLMVLVQLVYAVMNITSKLAIESGMSPLVLVAYRQLFATVSIAPFAYWLEWNTLPRITQRLMIQILFSSLTGVTGNQMLYFVGLKYSSATIACALTNLLPAFTFILAVLFRQENLGIKKRAGLAKVFGTILCVSGALLLSFYHGKTIGLGQSSIHWRYAEKMEGTSSSGKGNMFLGPLVVILSTLVWAAWFIIQKDISKTFPAPYTSTGLMCFMASFQCVIIAVCVDHRASAWSLHNAMRLSSALYAGIFCTGLAYCLMSWTIERKGPLYVSVFTPLQLVLTAILSWALLREKLYVGTAVGSLLIVLGLYSVLWGKSEEVNKGDGIEEDAVKEAVKDSKNDMELQSYVPSNGNNGRVIA

SEQ ID NO: 1756 - protein, 345 aa, Glycine max
MAVSDGVVKKIVLSYTYVAIWIFLSFTVIVYNKYILDRKMYNWPYPISLTMIHMAFCSSLAYILVRVLKLVEPVSMSRDLYLKSVVPIGALYPLSLWFSNSAYIYLSVSFIQMLKALMPVAVYSIGVIFKKEAFKNETMANMVSISLGVAVAAYGEAKFDAWGVTLQLMAVAFEATRLVLIQILLNSKGISLNPITSLYYIAPCCLVFLSVPWIIMEYPSLRDNSSFHLDFAIFGTNSACAFALNLAVFLLVGKTSALTMNVAGVVKDWLLIAFSWSVIKDTVTPINLIGYGLAFLGVAYYNHCKLQALKASEAQKKALQADEEAGRLLEQKDGEGTGRKNDNQN

SEQ ID NO: 1757 - protein, 354 aa, Glycine max
MVEAQTWTTRRMSNPRLDTSTTDQVLDIPPTPPGELRNSFGSNPNNLSPTLLTALIISSWYLSNIGVLLLNKYLLSFYGYRFPIFLTMLHMLSCAAYSYASINFLELVPLQHIHSKKQFLKIFALSAIFCFSVVCGNTSLRYLPVSFNQAIGATTPFFTAIFAFLITCKKETGEVYLALLPVVFGIVVASNSEPLFHLFGFLVCVGSTAGRALKSVVQGILLTSEAEKLHSMNLLLYMAPLAAMILLPFTLYIEGNVLALTIEKAKGDPFIVFLLLGNATVAYLVNLTNFLVTKHTSALTLQVLGNAKAAVAAVVSVLIFRNPVTVMGMAGFGITIMGVVLYSEAKKRSKVTTH

SEQ ID NO: 1758 - protein, 910 aa, Oryza sativa
  unsure (1)..(910): unsure at all Xaa locations
MSAGWRTLLLRIGDRCPEYGGSVDHKEHIETCYGVLCREYEHSKDAMFEFLLQCADQLPHKIPFFGVLIGLINLENEDFSKGIVDTTHANLQDALHNENRDRIRILLXFLCGLMCSKVVLPNSIIETFEALLSSAATILDEETGNPSWQPRADFYVYCILASLPWGGSELFEQVPDEFERVLVGIQSYISIRRHFDDIAFSVFETDEGNSPNKKDFIEDLWERIQVLSRNGWKVKSVPKPHLSFEAQLVAGVSHRFSPISCPHLLSRNASSEIVKGQEKHEADLKYPQRLRRLHIFPTNKAENMQPVDRFVVEECILDVLLFFNGCRKECAFYLVSLPVPFRYEYLMAETIFSQLLLLPNPPFRPIYYTLVIIDLCKALPGAFPSVVVGAVHALFDRISNMDMECRTRLILWFSHHLSNFQFIWPWQEWAYVKDLPKWAPQRVFVQEVLEREIRLSYFDKIKQSIEDAVELEELLPPKAGPNFRYHSDEGKESTDGHRLSKELVAMVRGRKTQGDIISWVDEKIIPVNGAKFALDVVSQTLLDIGSKSFTHLITVLERYGQIISKLCPNEEMQLLLMDEVSAYWKNSTQMIAIAIDRMMGYRLLSNLAIVKWVFSPANVDQFHVSDRPWEILRNAVSKTYNRIFDLRKEIQTLRKGLQAAKEASEKAARELEEAKSIIEIVDGQPVPSENPGRLRRLQARADKAKEGEVTTEESLEAKEALLARGLEESKELLRLLFKSFVEVLTERLPPISADGDVPNLRAGDPNVNSSARDPEATTMEIDNENGGDNDSQLNGQNKKISHNVGELEQWCLCTLGYLKSFSRQYATEIWSHIAMLDQEIFVGNIHPLIRKAASPVCADLPVKGLTFDFDPSSELEFTCIIRDKFFIMLSLTGHAQKYSDVYSGTPSILL

SEQ ID NO: 1759 - protein, 858 aa, Saccharomyces cerevisiae
MILPLDFDEDENYRDFRPRMPKRQRIPPVVQLCKEMMPDIRTIGESVKAFEDDIKFLSEAIMNEYGHEDYFNNALLSTLNAVVVEQPQKQAAIALLTMVVNSKNNVAGKSIINYFFEELQKWCKQTYNDEFKSTSNETGPWNKIKLILRFLSILSPMFLVDELINIYKSLFELSIELNNLDPGNRVPLSEAIYTNTLLNIPYLFFFNRNNDGLRTKVEELLAYVEQNYLVKTTDINLLREYNGEPPYEMVELVRVVLPNVKKALINNLEQLNELFPDWNHLLTPQTGDEGFNDALTLPSVDDLKSFVRLNKNFGSVDSMWKTPRYAFHVYLPNSAGNFETVVPISTYAGQLFNDIIIDLVESLEFNRKEVARQVITLDLFFKAGIFTEPGESIAQLIATYEENPLAPTFKIEDLAIETILGLIFKLPSVSQPFAYFYTLLVDICQNSPKAIAPVFGRAFRFFYSHLDSLDFELKLRYLDWFSIQMSNFNFSWKWNEWEDDSIKFGKYFYNPKVNFAKNLIQKELRLTSNFSEVEDSLPQEFTKYLDTSYIPRDQLINYYQSLFTGYTVEEDSVRKNDLYFRQEGVPMENTVRKILDYTHKANNSREVTELESILGELKNEYGSIISDFNRFVIILLVQAVTDSGSRSLSHANKYINDLKEDLKTIFAKIELDIETKEYIIIEAVLTFWNANPQTGFLVADAFKYAGLLTSRTIFTFIFNETGLKNNGLIEATAIEAVFRNLSQQISEENESGNNFEFVFERLCTIANSTIDLLDVNADEDIEIPKVNGEMDIDDIEDDKLDLKWKYFTVIGFIKSILRRYSHEYRELADKFIANIDNAIPHESTRRTISNWIQETKEV

SEQ ID NO: 1760 - protein, 243 aa, Zea mays
MASLFKDPSKLSAYRDRRFKGTQEEYEATLHASTTLYIGNMSFYTTEEQAYELFSRAGEIKKIIMGLDKNSKTPCGFCFVLYYSREDAEDAVKYISGTMLDDRPIRVDFDWGFEEGRQWGRGRSGGQVRDEYRTDYDPGRGGYGKMVQRELEAQRELVDYGGSFQPNAPPPYERGERKRGYGDSHRNARGDYQRKRYRSSDDRSAPEESKRAPDSDPADKNPRFREKGDSDEEDDDYDKRRRR

SEQ ID NO: 1761 - protein, 208 aa, Saccharomyces cerevisiae
MSLEEFDEVKYDHSTKRLDTPSRYLLRKARRNPNGLQELRESMKSSTIYVGNLSFYTSEEQIYELFSKCGTIKRIIMGLDRFKFTPCGFCFIIYSCPDEALNALKYLSDTKLDEKTITIDLDPGFEDGRQFGRGKSGGQVSDELRFDFDASRGGFAIPFAERVGVPHSRFDNSSSQSNTNNYIPPPDAMGTFRPGFDEEREDDNYVPQ

SEQ ID NO: 1762 - protein, 671 aa, Emericella nidulans
MNDLWGLISCHSYGPRGMRVSFPIRKMCRLIGDTVSRNIERLSYASRLQARKLINTVPTDANPSGYIVASSDDLLRLVDADYGALCIRGEVKILAKSPQSQEMLALLEYLKVRKYNSVLTSNHIVKDFQDLNYPPGFKDISGLLYVPLSTDGLDFIVFFRRGQLTEVKWGGNPNEAKFTEGHLEPRKSFQTWRETVLDRCRDWTESEVDTAAVLCLVYGKFIKVWRQQEAALESSSLTKLLLANSAHEVRTPLNAIVNYLEIALEGALDGETRDHLSKSYSASKSLIYVINDLLDLTNVEKGQSLIKDEPFDLPTTFSEATAMFESEAKRKGLNYKVLSQPGIPETVIGDQRRVRQSISNLTSNAVQNTSSGGVTVEVWHAPGEGDTDKATVKIAVLDTGRGISSSTLELLFRELEQVSGEDDSHYYGGSEEGEESAPEAKASKDKAVLGLGLALVARIVRNMHGQLTVRSEEGKGSRFQISLQFPIPEGSDTKSPTAEHRPVATGDSAAPFSTGDDVILVDSTTGSKRNSQDSLTRPDVPRKSEPEDTALADGAGEQASGESEAQTRPKKTGESTASTSHEQSETARSRPSGPSSGPSAPERRPLRVLVAEDDPINAKIIEKRLEKLGHTVQRTVNGEECANAYSAESTQWDVVLMDIQVGGQCLWCLLM

SEQ ID NO: 1763 - protein, 141 aa, Arabidopsis thaliana
MADTPSSPAGDGGESGGSVREQDRYLPIANISRIMKKALPPNGKIGKDAKDTVQECVSEFISFITSEASDKCQKEKRKTVNGDDLLWAMATLGFEDYLEPLKIYLARYRELEGDNKGSGKSGDGSNRDAGGGVSGEEMPSW

SEQ ID NO: 1764 - protein, 223 aa, Zea mays
MPDSDNDSGGPSNAGGELSSPREQDRFLPIANVSRIMKKALPANAKISKDAKETVQECVSEFISFITGEASDKCQREKRKTINGDDLLWAMTTLGFEDYVEPLKHYLHKFREIEGERAAASAGASGSQQQQQQGELPRGAANAAGYAGYGAPGSGGMMMMMMGQPMYGGSQPQQQPPQPQPPQQQQQQHQQHHMAMGGRGGFGQQGGGGGSSSSSGLGRQDRA

SEQ ID NO: 1765 - protein, 185 aa, Zea mays
MAEAPASPGGGGGSHESGSPRGGGGGGSVREQDRFLPIANISRIMKKAIPANGKTIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAQGMGQQGAYNQGMGYMQPQYHNGDISN

SEQ ID NO: 1766 - protein, 166 aa, Zea mays
MADDGGSHEGSGGGGGVREQDRFLPIANISRIMKKAVPANGKIAKDAKETLQECVSEFISFVTSEASDKCQKEKRKTINGDDLLWAMATLGFEEYVEPLKIYLQKYKEMEGDSKLSTKAGEGSVKKDAISPHGGTSSSSNQLVQHGVYNQGMGYMQPQVIYRTVIC

SEQ ID NO: 1767 - protein, 608 aa, Arabidopsis thaliana
METNSSGEDLVIKTRKPYTITKQRERWTEEEHNRFIEALRLYGRAWQKIEEHVATKTAVQIRSHAQKFFSKVEKEAEAKGVAMGQALDIAIPPPRPKRKPNNPYPRKTGSGTILMSKTGVNDGKESLGSEKVSHPEMANEDRQQSKPEEKTLQEDNCSDCFTHQYLSAASSMNKSCIETSNASTFREFLPSREEGSQNNRVRKESNSDLNAKSLENGNEQGPQTYPMHIPVLVPLGSSITSSLSHPPSEPDSHPHTVAGDYQSFPNHIMSTLLQTPALYTAATFASSFWPPDSSGGSPVPGNSPPNLAAMAAATVAAASAWWAANGLLPLCAPLSSGGFTSHPPSTFGPSCDVEYTKASTLQHGSVQSREQEHSEASKARSSLDSEDVENKSKPVCHEQPSATPESDAKGSDGAGDRKQVDRSSCGSNTPSSSDDVEADASERQEDGTNGEVKETNEDTNKPQTSESNARRSRISSNITDPWKSVSDEGRIAFQALFSREVLPQSFTYREEHREEEQQQQEQRYPMALDLNFTAQLTPVDDQEEKRNTGFLGIGLDASKLMSRGRTGFKPYKRCSMEAKESRILNNNPIIHVEQKDPKRMRLETQAST

SEQ ID NO: 1768 - protein, 720 aa, Zea mays
MEMNSSGEETVVKVRKPYTITKQRERWTEAEHKRFLEALKLYGRAWQRIEEHVGTKTAVQIRSHAQKFFTKLEKEAMNNGTSPGQAHDIDIPPPRPKRKPNSPYPRKSCLSSETQTKELPNDKSTKPNMPLSNGHVKMVGDASLQNFQRKELSEKGSRSEVLNLFRDAPSASFSSVNKSSSNHGAPRRTEASKTESRDMSIMENNSFNPNTQEDVKVISDQEMERLNGIQIRSKCEHSHEGYLDISTQQMKLMPKSVETTYVDEQTARASHTLAESNGTASVPVTVPEGTHPDQTSDQVGINGSMNPCIHPMVSADPKFGSSATPQTFPHNYAAFAPMMQCNCNQDTYRSFTNMSSTFSSMLVSTLLSNPAIHAAARLAASYWPAAEGNTPIDPNQENPADGVQGRNIGSPPSMASIVAATVAAASAWWATQGLLPFFAPPVAFPFVPAPSAAFPTVDVPRPSEKDRDCPVENAQNECQEARKQVQFEGLRVAASSESDGSGKGEVSLHTELKLSPAQNADATPTTGAGTNDAFRNKKKQDRSSCGSNTPSSSDVDAGNVPEEDNANEKAKQASCSNSSAGDTNHRRFRSNGSTSDSWKEVSEEGRLAFDALFSREKLPQSFSPPQAVDSKEVAKEEEDEVTTVAVDLNKNATSIDHDDLDTMDEPRASFPNELSHLKLKSRRTGFKPYKRCSVEAKENRVPTSDMVGTKRIRLDSEAST

SEQ ID NO: 1769 - protein, 636 aa, Zea mays
MMESCDCIDTQYPPDELLVKYQYISDVLIALAYFSIPVELIYFVQKSAFFPYRWVLMQFGAFIVLCGATHFINLWTFSPHSKSVAVVMTIAKVSCAIVSCATALMLVHIIPDLLSVKRRESILKNKAEELDREMGLILTQEETGRHVRMLTHEIRSTLDRHTILKTTLVELGRTLGLEECALWMPSRSGLNLQLSHTLTYHVQVGSTVQTNNPIVNEVFNSPQAMRIPPTCPLARIRPLVGRYVPPEVVAVRVPLLNLSNFQINDWPDISAKSYAIMVLILPTDSVRKWRDHELELVDVVADQVAVALSHAAILEESMRARDQLMEQNVALDLARREAEMAIHARNDFLAVMNHEMRTPMHAIIALSSLLLETELTPEQRVMIETVLKSSNVLATLINDVLDLSRLEDGSLELEMGKFNLHGVLGEIVELIKPIASVKKLPITLILSPDLPTHAIGDEKRLTQTLLNVVGNAVKFTKEGYVSVRVSVAKPESSQDWRPPEFYPASSDGHFYIRVQVKDSGCGILPQDIPHLFTKFAQSRSGPARPSSGAGLGLAICKRFVNLMGGHIWIESEGLDKGSTATFIVKLGICGNPDPSDHQAANRSQAYSGSGGLARFKPFITDENDTGFSTRRNQRSF

SEQ ID NO: 1770 - protein, 449 aa, Saccharomyces cerevisiae
MGLCASSEKNGSTPDTQTASAGSDNVGKAKVPPKQEPQKTVRTVNTANQQEKQQQRQQQPSPHNVKDRKEQNGSINNAISPTATANTSGSQQINIDSALRDRSSNVAAQPSLSDASSGSNDKELKVLLLGAGESGKSTVLQQLKILHQNGFSEQEIKEYIPLIYQNLLEIGRNLIQARTRFNVNLEPECELTQQDLSRTMSYEMPNNYTGQFPEDIAGVISTLWALPSTQDLVNGPNASKFYLMDSTPYFMENFTRITSPNYRPTQQDILRSRQMTSGIFDTVIDMGSDIKMHIYDVGGQRSERKKWIHCFDNVTLVIFCVSLSEYDQTLMEDKNQNRFQESLVLFDNIVNSRWFARTSVVLFLNKIDLFAEKLSKVPMENYFPDYTGGSDINKAAKYILWRFVQLNRANLSIYPHVTQATDTSNIRLVFAAIKETILENTLKDSGVLQ

SEQ ID NO: 1771 - protein, 893 aa, Oryza sativa
MRSLRRVLLQLVLLAGVAFRGVRFDDAADAAAAAQGSSDLFELPSPSPTLALPGGGDEGASTEIIAAPWPGRHGLFTPPRSTSQPARAVVQPAADFGSQLQFYDNGTIQLVDLLSKLPRWQFSTGPPLSKHITTSKPDLNYVIYLDGSETSDLIEVHNGSGVRLPWKLEEFIAETPYIRDSFVTIGSKVSTTFVVNADSGEIIYKHSLPVALNEVGGPLVEEIPSKLDAARSGTSANIIVVVRTDYSISASDLGEHLFNWTRTSFTANYYARYGHQDMLAQSSCLRGNIPCIRTEGPPIKLYLPDSSSDNAIVLRPVNEVSAVDALEPLLPPKKLPQPAGESNVALDSAQNQTADIALGHFVPADTELTNSVTKFSYRWLFPTFLMLLIMACLVKLADASKYCRQFVIRFLKPFMRDEKLMDPRGKSEGTSKRRKARKKDGLINSTQIFSASDKEGNGTGGSTEAQSNKAHDSTNVELPNGLNGRQIGKLCVYSKEIGKGSNGTVVFEGSYGGREVAVKRLLRSHNDIASKEIENLIASDQDPNIVRMYGFEQDNDFVYISLERCRCSLADLIQLHSVPPFSNTKGTDIELWRQDGLPSAQLLKLMRDVVAGIVHLHSLGIIHRDLKPQNVLISKEGPLRAKLSDMGISKRLQEDMTSVSHHGTGFGSSGWQAPEQLRHGRQTRAIDLFSLGCLIFYCITKGKHPFGEYYERDMKIINNQFDLFIVDHIPEAVHLISQLLDPDPEKRPTAVYVMHHPFFWSPELCLSFLRDTSDRIEKTSETDLIDALEGINVEAFGKNWGEKLDAALLADMGRYRKYSFESTRDLLRLIRNKSGHYREFSDDLKELLGSLPEGFVQYFSSRFPKLLIKVYEVMSEHCKDEEAFSKYFLGSSA

SEQ ID NO: 1772 - protein, 415 aa, Oryza sativa
MRSLRRVLLQLVLLAGVAFRGVRFDDAADAAAAAQGSSDLFELPSPSPTLALPGGGDEGASTEIIAAPWPGRHGLFTPPRSTSQPARAVVQPAADFGSQLQFYDNGTIQLVDLLSKLPRWQFSTGPPLSKHITTSKPDLNYVIYLDGSETSDLIEVHNGSGVRLPWKLEEFIAETPYIRDSFVTIGSKVSTTFVVNADSGEIIYKHSLPVALNEVGGPLVEEIPSKLDAARSGTSANIIVVVRTDYSISASDLGEHLFNWTRTSFTANYYARYGHQDMLAQSSCLRGNIPCIRTEGPPIKLYLPDSSSDNAIVLRPVNEVSAVDALEPLLPPKKLPQPAGESNVALDSAQNQTADIALGHFVPADTELTNSVTKFSYRWLFPTFLMLLIMACLVKLADASKYCRQFVIRFLKPFM

SEQ ID NO: 1773 - protein, 479 aa, Oryza sativa
MADEKLMDPRGKSEGTSKRRKARKKDGLINSTQIFSASDKEGNGTGGSTEAQSNKAHDSTNVELPNGLNGRQIGKLCVYSKEIGKGSNGTVVFEGSYGGREVAVKRLLRSHNDIASKEIENLIASDQDPNIVRMYGFEQDNDFVYISLERCRCSLADLIQLHSVPPFSNTKGTDIELWRQDGLPSAQLLKLMRDVVAGIVHLHSLGIIHRDLKPQNVLISKEGPLRAKLSDMGISKRLQEDMTSVSHHGTGFGSSGWQAPEQLRHGRQTRAIDLFSLGCLIFYCITKGKHPFGEYYERDMKIINNQFDLFIVDHIPEAVHLISQLLDPDPEKRPTAVYVMHHPFFWSPELCLSFLRDTSDRIEKTSETDLIDALEGINVEAFGKNWGEKLDAALLADMGRYRKYSFESTRDLLRLIRNKSGHYREFSDDLKELLGSLPEGFVQYFSSRFPKLLIKVYEVMSEHCKDEEAFSKYFLGSSA

SEQ ID NO: 1774 - protein, 1115 aa, Saccharomyces cerevisiae
MRLLRRNMLVLTLLVCVFSSIISCSIPLSSRTSRRQIVEDEVASTKKLNFNYGVDKNINSPIPAPRTTEGLPNMKLSSYPTPNLLNTADNRRANKKGRRAANSISVPYLENRSLNELSLSDILIAADVEGGLHAVDRRNGHIIWSIEPENFQPLIEIQEPSRLETYETLIIEPFGDGNIYYFNAHQGLQKLPLSIRQLVSTSPLHLKTNIVVNDSGKIVEDEKVYTGSMRTIMYTINMLNGEIISAFGPGSKNGYFGSQSVDCSPEEKIKLQECENMIVIGKTIFELGIHSYDGASYNVTYSTWQQNVLDVPLALQNTFSKDGMCIAPFRDKSLLASDLDFRIARWVSPTFPGIIVGLFDVFNDLRTNENILVPHPFNPGDHESISSNKVYLDQTSNLSWFALSSQNFPSLVESAPISRYASSDRWRVSSIFEDETLFKNAIMGVHQIYNNEYDHLYENYEKTNSLDTTHKYPPLMIDSSVDTTDLHQNNEMNSLKEYMSPEDLEAYRKKIHEQISRELDEKNQNSLLLKFGSLVYRIIETGVFLLLFLIFCAILQRFKILPPLYVLLSKIGFMPEKEIPIVESKSLNCPSSSENVTKPFDMKSGKQVVFEGAVNDGSLKSEKDNDDADEDDEKSLDLTTEKKKRKRGSRGGKKGRKSRIANIPNFEQSLKNLVVSEKILGYGSSGTVVFQGSFQGRPVAVKRMLIDFCDIALMEIKLLTESDDHPNVIRYYCSETTDRFLYIALELCNLNLQDLVESKNVSDENLKLQKEYNPISLLRQIASGVAHLHSLKIIHRDLKPQNILVSTSSRFTADQQTGAENLRILISDFGLCKKLDSGQSSFRTNLNNPSGTSGWRAPELLEESNNLQCQVETEHSSSRHTVVSSDSFYDPFTKRRLTRSIDIFSMGCVFYYILSKGKHPFGDKYSRESNIIRGIFSLDEMKCLHDRSLIAEATDLISQMIDHDPLKRPTAMKVLRHPLFWPKSKKLEFLLKVSDRLEIENRDPPSALLMKFDAGSDFVIPSGDWTVKFDKTFMDNLERYRKYHSSKLMDLLRALRNKYHHFMDLPEDIAELMGPVPDGFYDYFTKRFPNLLIGVYMIVKENLSDDQILREFLYS

SEQ ID NO: 1775 - protein, 573 aa, Saccharomyces cerevisiae
MRLLRRNMLVLTLLVCVFSSIISCSIPLSSRTSRRQIVEDEVASTKKLNFNYGVDKNINSPIPAPRTTEGLPNMKLSSYPTPNLLNTADNRRANKKGRRAANSISVPYLENRSLNELSLSDILIAADVEGGLHAVDRRNGHIIWSIEPENFQPLIEIQEPSRLETYETLIIEPFGDGNIYYFNAHQGLQKLPLSIRQLVSTSPLHLKTNIVVNDSGKIVEDEKVYTGSMRTIMYTINMLNGEIISAFGPGSKNGYFGSQSVDCSPEEKIKLQECENMIVIGKTIFELGIHSYDGASYNVTYSTWQQNVLDVPLALQNTFSKDGMCIAPFRDKSLLASDLDFRIARWVSPTFPGIIVGLFDVFNDLRTNENILVPHPFNPGDHESISSNKVYLDQTSNLSWFALSSQNFPSLVESAPISRYASSDRWRVSSIFEDETLFKNAIMGVHQIYNNEYDHLYENYEKTNSLDTTHKYPPLMIDSSVDTTDLHQNNEMNSLKEYMSPEDLEAYRKKIHEQISRELDEKNQNSLLLKFGSLVYRIIETGVFLLLFLIFCAILQRFKILPPLYVLLSKIGF

SEQ ID NO: 1776 - protein, 542 aa, Saccharomyces cerevisiae
MAEKEIPIVESKSLNCPSSSENVTKPFDMKSGKQVVFEGAVNDGSLKSEKDNDDADEDDEKSLDLTTEKKKRKRGSRGGKKGRKSRIANIPNFEQSLKNLVVSEKILGYGSSGTVVFQGSFQGRPVAVKRMLIDFCDIALMEIKLLTESDDHPNVIRYYCSETTDRFLYIALELCNLNLQDLVESKNVSDENLKLQKEYNPISLLRQIASGVAHLHSLKIIHRDLKPQNILVSTSSRFTADQQTGAENLRILISDFGLCKKLDSGQSSFRTNLNNPSGTSGWRAPELLEESNNLQCQVETEHSSSRHTVVSSDSFYDPFTKRRLTRSIDIFSMGCVFYYILSKGKHPFGDKYSRESNIIRGIFSLDEMKCLHDRSLIAEATDLISQMIDHDPLKRPTAMKVLRHPLFWPKSKKLEFLLKVSDRLEIENRDPPSALLMKFDAGSDFVIPSGDWTVKFDKTFMDNLERYRKYHSSKLMDLLRALRNKYHHFMDLPEDIAELMGPVPDGFYDYFTKRFPNLLIGVYMIVKENLSDDQILREFLYS

SEQ ID NO: 1777 - protein, 420 aa, Zea mays
MSNEEYLHTDTHGLQISETVVEPQVGRSEGDLLPTSSTDDLHISGGRTKQSDAGELRKGNSIDDSTPTYLDITIGHLPERKTASRITTEGSGEFITGKGMLAGTSSVTISAMEAGRSEDGADSIYDPSGAITPYHDSQTQTVMPHENTSTGILGPPALPVGVSTRFEEKNIMQEAPEIIKTGGKDTELKRRNFQRNKQVLKDTFDEWEEAYQRDAEQRKADELFMREALLEAQRAADIWEVPVGAVLVQNGEIIARGCNLVEDHRDSTAHAEIVCIREASNKLKTWRLADTTLYVTLEPCAMCAGAILQARIDTVVWGAPNKLLGADGSWVRLFPGDGQTSTLDSTNQSQAAGPVHPFHPKIAIRRGVLSAECSEIMQQFFQLRRKKKPQSPPQAHRHGHHHPVKFFSKMHHMFGTIFCL

SEQ ID NO: 1778 - protein, 312 aa, Zea mays
MAESFVLNTGSRIPSVGLGVWQIQPDAANDAIYAAVKAGYRHIDCAAAYNNEKEVGLALKKLFEDGVVKRDDLFITSKLWAANHAPEDVEEGIDTTLQDLQLDYLDLYLIHGPIRIKKGTSTMTPENFLPTDIPATWAAMEKLYDSGKARAIGVSNFSCKKLHDLLAVARVPPAVNQVECHPVWQQDKLRKLCQSNGVHLSAFSPLGSPGSPWINGPSVLKNPIVVSVADKLQKTPAQVALRWGIQMGHSVLPKSANESRIKENIDIFGWSIPEDLMAKFSEIKQVRLLTAEFVVHPQAGYNTLEDFWDGEI

SEQ ID NO: 1779 - protein, 309 aa, Glycine max
MAITLNNGFKMPIIGLGVWRMEGNEIRDLILNSIKIGYRHFDCAADYKNEAEVGDALKEAFDSGLVKREDLFITTKLWNSDQGHVLEACKDSLKKLQLTYLDLYLVHFPVAVRHTGVGNTSSPLGDDGVLDIDTTISLETTWHAMEDLVSSGLVRSIGISNYDIFLTRDCLAYSKIKPAVNQIETHPYFQRDSLVKFCQKHGICVTAHTPLGGAAANAEWFGTVSCLDDQVLKGLAEKYKKTAAQISLRWGIQRNTVVIPKSSKLERLKENFQVFDFELSKEDMELIGSIDRKYRTNQPAVFWGIDLYA

SEQ ID NO: 1780 - protein, 196 aa, Saccharomyces cerevisiae
MVDNRRTFTAPQSLLETNLTFPNDEPSLTTITVTRERCVDPSLIDSFLRFLRHGSDDIIRQKLNNYRKGSINGKNKCKEFLKQELYPNWQIRNNIISFCEKEAAEMKNETDQQCGNNKKTTAEPLIDARIDPYAARERAEKQEAQYKDWTKVTEWVANNRKIEQILTSTTEGILRQNCEQNNDYLKEFTQFCKDNS

SEQ ID NO: 1781 - protein, 75 aa, Saccharomyces cerevisiae
MSQQQGYYQQGPPQQGYYQQGPPQQGYYQQGPPQQGYPQQQPVYVQQGQPKEESCLDSCLKCLCCCFLLELVCDN

SEQ ID NO: 1782 - protein, 137 aa, Saccharomyces cerevisiae
MNDGQFLFQRNDPIILYTFLLKSNYTVFRSIDERLCDFVFYIDHFLNKRISYRIPILIRNNNTNILNNCPSSFPPLVDLVGHRLVAAEDNPVAVDLVDNNLVVVDLVDNNLAVGVLVGSNLVVGSLVFALLTCFEDG

SEQ ID NO: 1783 - protein, 127 aa, Saccharomyces cerevisiae
MSSTNGNAPATPSSDQNPLPTRFEVELEFIQSLANIQYVTYLLTQQQIWKSPNFKNYLKYLEYWCNPPYSQCIVYPNCLFILKLLNGFMESAIVNEDGLLEGLDELPKIIQLQGPQWMNEMVERWAN

SEQ ID NO: 1784 - protein, 250 aa, Saccharomyces cerevisiae
MQHIKHMRTAVRLARYALDHDETPVACIFVHTPTGQVMAYGMNDTNKSLTGVAHAEFMGIDQIKAMLGSRGVVDVFKDITLYVTVEPCIMCASALKQLDIGKVVFGCGNERFGGNGTVLSVNHDTCTLVPKNNSAAGYESIPGILRKEAIMLLRYFYVRQNERAPKPRSKSDRVLDKNTFPPMEWSKYLNEEAFIETFGDDYRTCFANKVDLSSNSVDWDLIDSHQDNIIQELEEQCKMFKFNVHKKSKV

SEQ ID NO: 1785 - protein, 206 aa, Saccharomyces cerevisiae
MSLYFTTLFLLLTVEVVMLFIFVLPLPFRIRRGIFSTYNQLTAKQQIKTIIFITGCLVGLLFIDSWKRSQIRVSLYHNDNSGSIGSSAVTPIQALASRAYNQRNMYISGFILYFSICIPTVMSIVKRLVKYQGLINEQEKQKLNKPSSNSKKDSNEADSTKLQEELRKKQISLEGLQKQVKNLEKYFDEKNQPGNVAAAEASKKGN

SEQ ID NO: 1786 - protein, 118 aa, Saccharomyces cerevisiae
MQHTLTRTASLPERSSSAHSAATALPALRRPPDSCETLVPLLCIFWFVFVSMSPLPPARANKSDNKGLISADRNNKATLLLTIPRCTSKSYTNDLSPLKMTLLSAGKHPRPFRQEHRC

SEQ ID NO: 1787 - protein, 241 aa, Saccharomyces cerevisiae
MVKAVIFTDFDGTVTLEDSNDYLTDTLGFGKEKRLKVFEGVLDDTKSFRQGFMEMLESIHTPFPECIKILEKKIRLDPGFKDTFEWAQENDVPVIVVSSGMKPIIKVLLTRLVGQESIHKIDIVSNEVEIDAHDQWKIIYKDESPFGHDKSRSIDAYKKKFESTLKAGEQRPVYFYCGDGVSDLSAAKECDLLFAKRGKDLVTYCKKQNVPFHEFDTFKDILASMKQVLAGEKTVAELMEN

SEQ ID NO: 1788 - protein, 492 aa, Saccharomyces cerevisiae
MSDDLFSKALENPDQDLNVELPKDDVDLGLLGDGGNERKTDEPVADAERSTGLGSGSSESESDSGSDSDSDSGSSGSEDDSADQDVEGEDEGGDAIENEDEDEDPSPSGPILSKNEILEETVPELPEDYEISEKTIITPIGVLKSAFENNIIIHATMSGEKRVLKEGSIFCLEDRTLIGMLTEVFGPLQNPFYRIKLPDSKKNLFDELKVRLGEKAFIVTPDAHWIDTFELKRNKGTDASNGYDEELPEEEQEFSDDEKEALFKKMKKQQRQRKKRDNRKLANDSDNVKVKRARQPKANSLPKLVPPLGMSSNAPMQHGYKSRNARENIKRESSATSNRNGSSPVPITQHHQQQFSANNYPFPQQPNGMPYPPYSPFPQPTNFQYPPPPFGQATPAQFSNTVPYGSLPPAYNNMSPPTQQSFMPMTQSQPPLPYGVPPMNQMQNPMYIQPPPQAPPQGNGNFQQVMELHQILLQQQQQQHQYQHQHQQDPRT

SEQ ID NO: 1789 - protein, 312 aa, Saccharomyces cerevisiae
MSFHQQFFTLNNGNKIPAIAIIGTGTRWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLQKKTAQDDSQPFFEYVKELSEKYIKSEAQIILRWVTKRGVLPVTTSSKPQRISDAQNLFSFDLTAEEVDKITELGLEHEPLRLYWNKLYGKYNYAAQKV

SEQ ID NO: 1790 - protein, 103 aa, Saccharomyces cerevisiae
MLFFTGLVILSYLLGGKKDWLLIMYEASDYLEFLNRLSSMLFKFELFEHLSSTFLIFSHSKRAVKLLEIYRSRHISIYNVFLLRHPKYFQSVDIALYLTRSQT

SEQ ID NO: 1791 - protein, 838 aa, Saccharomyces cerevisiae
MSEYLAQTPCKFTIWSSEIDLIRTNLLVNAHPLSTVGRLLQYIHYQIYKQLRAIYQPEEQCTNSEIPHTPLNSINTYFLSYEGRELSATCLLKDITSSSHPDSNHFIRLQLEKRTSPSGSAFDLEYDMEGEFNSMNIQFEINTLSSQRIFNSMEPNLPIGTTLARLEKLALERIKDFEKSAGNLCGIKEDHSVSDLQGFIIKGKQTPMFLNYGSDSDYYKDLNLVDLIGIDFAPAHNSFFTFLFKMNHEQNSHIANDEERFVLEFISDATLSITQMNVKPDTTVKQVKDFICSVYTHSLNLRRNDIKLIYKGQLLHENNFAGNSSKISEYIKEPHEVKVHVQINQEYTESGPGFWNEVFNNPNIFQFMPPDTRSQSPVSFAPTQGRSPAAIRGEERGIPYVTESGNDIVPTDELYRKCIINGDEVVFIPVSELNPQSSYLSVIKGDYGEIKIPISSNDYRINGDNILLSPSAIEQLESALNFKIERPRDSTLLHPSGEHVRAADNTSSANDNNTVENDESAWNRRVVRPLRNSFPLLLVLIRTFYLIGYNSLVPFFIILEFGSFLPWKYIILLSLLFIFRTVWNTQEVWNLWRDYLHLNEIDEVKFSQIKEFINSNSLTLNFYKKCKDTQSAIDLLMIPNLHEQRLSVYSKYDIEYDTNTPDVGQLNLLFIKVLSGEIPKDALDELFKEFFELYETTRNMNTLYPQDSLNELLLMIWKESQKKDINTLPKYRRWFQTLCSQIAEHNVLDVVLRYIIPDPVNDRVITAVIKNFVLFWVTLLPYVKEKLDDIVAQRARDREQPAPSAQQQENEDEALIIPDEEEPTATGAQPHLYIPDED

SEQ ID NO: 1792 - protein, 219 aa, Saccharomyces cerevisiae
MLKLTTTSVTFHVLRYFQLGLSVTNLLLASFAIITNYKVDRILRLSLAVSIISSVYFGIVRFLPVLLIFVMEIVQTVLWFTAFVTLASKFGSMSCSSMPRGINFDYSGSCKIAKIDILPEAVLFILFLATTYASYITVLSQAKENGSSTRSVLKACVKALRDTVDRLETSLEESEPLLDLEVQEDARTETESIEDSTDSEDNANIEQEKVIDGSIEHSS

SEQ ID NO: 1793 - protein, 110 aa, Saccharomyces cerevisiae
MVSQETIKHVKDLIAENEIFVASKTYCPYCHAALNTLFEKLKVPRSKVLVLQLNDMKEGADIQAALYEINGQRTVPNIYINGKHIGGNDDLQELRETGELEELLEPILAN

SEQ ID NO: 1794 - protein, 333 aa, Saccharomyces cerevisiae; identical to SEQ ID NO: 1750

SEQ ID NO: 1795 - protein, 246 aa, Glycine max
MAEDLVLDTAIRDWVLIPLSVVMVLIGVLRYFVSKLMHSSQTPDAKIVKEGQVIVRARNLRAGANFIPSKAFRARKIYFCNEENGLLFVPKGQGQNPQAQMFSDPNMAMDMMKKNLSMIIPQTLTFAWVNFFFSGFVAAKIPFPLTQRFRSMLQNGIDLSTVDVSYVSSRSWYFLNLFGLRGLFSLILGEENAVDDTQRMMQMGGFGFDPSKGLSAEKDNLDITQHDWALPNFEQRAEAVLRKVAS

SEQ ID NO: 1796 - protein, 474 aa, Zea mays
MNLAVAAALPSVTPRTGVVLPRSSRRHCPRGVVPRAASSSVSSFTSPSAAAAPIYTPTPQDRSLRTPHSGYHFDGTARPFFEGWYFKVSIPECRQSFCFMYSVENPLFRDGMSDLDKLLYRPRFTGVGAQILGADDKYICQFSEKSNNFWGSRHELMLGNTFISNKESTPPQGEVPPQDFSRRVLEGLQVTPIWHQGFIRDDGRSNYVPNVQTARWEYSTRPVYGWGDVKSKQLSTAGWLAAFPFFEPHWQICMARGLSTGWIEWDGERFEFENAPSYSEKNWGGGFPRKWYWIQCNVFPGASGEVSLTAAGGLRKIGLGDTYESPSLIGIHYEGQFFEFVPWTGTVSWDIGLWGLWKMSGENKTHLVEIEATTAESGTALRAPTIEAGLVPACKDTCYGDLRLQLWEKKYDGSKGEMILDATSNMAALEVGGGPWFNGWKGTTVVNEVVNNIVGTPVDVESLLPIPFLKPPGL

SEQ ID NO: 1797 - protein, 422 aa, Oryza sativa
MVAAPVYAPTPRDRALRTPHSGYHYDGTARPFFEGWNFKVSIPECRQSFCFMYFCLKPFVIWNRFIHGSRFTGVGAHILGAFDKYICQFTEKFNNFWGSRHELMLGNTFIPNNGSTPPEGEVPPREFSSRVLEGFQVTPIWHQGFIRDDGRQSKYVPNVQTARWEYSTRPVYGWGDVTSKQKSTAGWLAAFPFFEPHWQICMAGGLSTGWIEWDGERFEFENAPSYSEKNWGAGFPRKWYWVQCNVFSGAFGEVALTAAGGLRKIGLGETYESPSLIGIHYEGKFYEFVPWTGTVSWDIAPWGHWKLSGENKNHLVEIEATTKEPGTALRAPTMEAGLVPACKDTCYGDLRLQMWEKRNDGGKGKMILDATSNMAALEVGGGPWFNGWKGTTVSNEIVNNVVGTQVDVESLFPIPFLKPPGL

SEQ ID NO: 1798 - protein, 488 aa, Arabidopsis thaliana
MEIRSLIVSMNPNLSSFELSRPVSPLTRSLVPFRSTKLVPRSISRVSASISTPNSETDKISVKPVYVPTSPNRELRTPHSGYHFDGTPRKFFEGWYFRVSIPEKRESFCFMYSVENPAFRQSLSPLEVALYGPRFTGVGAQILGANDKYLCQYEQDSHNFWGDRHELVLGNTFSAVPGAKAPNKEVPPEEFNRRVSEGFQATPFWHQGHICDDGRTDYAETVKSARWEYSTRPVYGWGDVGAKQKSTAGWPAAFPVFEPHWQICMAGGLSTGWIEWGGERFEFRDAPSYSEKNWGGGFPRKWFWVQCNVFEGATGEVALTAGGGLRQLPGLTETYENAALVCVHYDGKMYEFVPWNGVVRWEMSPWGYWYITAENENHVVELEARTNEAGTPLRAPTTEVGLATACRDSCYGELKLQIWERLYDGSKGKVILETKSSMAAVEIGGGPWFGTWKGDTSNTPELLKQALQVPLDLESALGLVPFFKPPGL

SEQ ID NO: 1799 - protein, 363 aa, Nostoc PCC7120
MRSPTMFKTLQTPHSGYHWDGSSRRFFEGWYYRVTLPDCGQTFAFMYSIEDPIGGKAYSGGAAQVLGADDEYICRTFPDVNKFWASPDVLALGHWGETNLNTKPIYLLPAEFERHVQQGYQATATINQGIIADPATGNYCRWRYEIQPIYGWGNQDGIQQSTAGWLSFLQIFEPGWQILMAHGLATGWIDWNGKIYQFQNAPAYGEKNWGGAFPEKWFWLNCNSFDGEPDLALTAGGGRRGVLWWMESVAMIGLHYQGKFYEFVPWNSKVEWNIQPWGRWQMKAKNLDYEVELTGTTHLPGTDLRAPTVQGLQYCCRDTMQGKLDVELRQIRGKNPLVILKAHSYLCGLEIGGDSWSNSWQSS

SEQ ID NO: 1800 - protein, 363 aa, Synechocystis sp. PCC 6803
MKFPPHSGYHWQGQSPFFEGWYVRLLLPQSGESFAFMYSIENPASDHHYGGGAVQILGPATKKQENQEDQLVWRTFPSVKKFWASPRQFALGHWGKCRDNRQAKPLLSEEFFATVKEGYQIHQNQHQGQIIHGDRHCRWQFTVEPEVTWGSPNRFPRATAGWLSFLPLFDPGWQILLAQGRAHGWLKWQREQYEFDHALVYAEKNWGHSFPSRWFWLQANYFPDHPGLSVTAAGGERIVLGRPEEVALIGLHHQGNFYEFGPGHGTVTWQVAPWGRWQLKASNDRYWVKLSGKTDKKGSLVHTPTAQGLQLNCRDTTRGYLYLQLGSVGHGLIVQGETDTAGLEVGGDWGLTEENLSKKTVPF

SEQ ID NO: 1801 - protein, 365 aa, Nostoc punctiforme PCC 73102
MLTIPLNFLQSTQTPHSGYHWDGTSRRFFEGWYYRITLPEIEQTFAFMYSIEDPIGGKPHSGGAAQILGPDDEYLCRTFPDVKKFWGSRDVLGLGHWGKTDLQIAPLYLLPAEFEHHVQEGYQATATLNQGIIRELATNNYCRWEYEIQPIYGWGNKNSIQQSTAGWLSFSQIFEPGWQILMAHGLASGKIDWNGKIYEFTNVPAYGEKNWGGAFPQKWFWINCNCFEGEPDLALTAGGGRRGVLWWMESVAMIGLHYQDKFYEFVPWNSQVDWEIQPWARWQMKATNSNYEIELTGTTDLAGTPLRAPTAEGLRYCCRDTMQGKLTLELREINGRKSQIILKAESFLCGLEVGGGSWHNVWQSR

SEQ ID NO: 1802 - protein, 501 aa, Oryza sativa
MAASSADLADDGFPAPRLFSQGVSYTYDDVIFLPGYIGFPADAVDLSTRLSRRIPLSIPCVASPMDTVSEAAMAAAMASLGAAAVVHCNTEPHLQASIVRAAKSRRLPFVSSVPLFSPASTPSLSDFAGHDYGLVTERGDSLSKLVGVAVAAETSSRQAPLPVSEYMRPAPRSVSASFDFEQAAAFLADEGLDYAPLVSDDSEVIDLITVNDVERIRSYPKLGKPSLGADGKFVVAASIGTREDDKRRLEQLVKAGANAIVVDSSQGNSIYQIDMIKYAKKMYPEVDLIGGNVVTIAQAQNLVASGVDGLRVGMGSGSICTTQEVCAVGRGQATAVYKVASYAKDHNVPVIADGGISNSGHIVKALSLGASTVMMGSFLAGSHEAPGTYEYKDGHRVKKYRGMGSLEAMTKGSDARYLGDTLKLKVAQGVVGAVADKGSVLRFIPYTMQAVKQGFQDLGASSLQSAHELLRSETIKLEVRTGAAQVEGGIHGLVSYEKKAF

SEQ ID NO: 1803 - protein, 523 aa, Saccharomyces cerevisiae
MAAIRDYKTALDFTKSLPRPDGLSVQELMDSKIRGGLTYNDFLILPGLVDFASSEVSLQTKLTRNITLNIPLVSSPMDTVTESEMATFMALLGGIGFIHHNCTPEDQADMVRRVKNYENGFINNPIVISPTTTVGEAKSMKEKYGFAGFPVTTDGKRNAKLVGVITSRDIQFVEDNSLLVQDVMTKNPVTGAQGITLSEGNEILKKIKKGRLLVVDEKGNLVSMLSRTDLMKNQNYPLASKSANTKQLLCGASIGTMDADKERLRLLVKAGLDVVILDSSQGNSIFELNMLKWVKESFPGLEVIAGNVVTREQAANLIAAGADGLRIGMGTGSICITQEVMACGRPQGTAVYNVCEFANQFGVPCMADGGVQNIGHITKALALGSSTVMMGGMLAGTTESPGEYFYQDGKRLKAYRGMGSIDAMQKTGTKGNASTSRYFSESDSVLVAQGVSGAVVDKGSIKKFIPYLYNGLQHSCQDIGCRSLTLLKNNVQRGKVRFEFRTASAQLEGGVHNLHSYEKRLHN

SEQ ID NO: 1804 - protein, 488 aa, Escherichia coli
MLRIAKEALTFDDVLLVPAHSTVLPNTADLSTQLTKTIRLNIPMLSAAMDTVTEARLAIALAQEGGIGFIHKNMSIERQAEEVRRVKKHESGVVTDPQTVLPTTTLREVKELTERNGFAGYPVVTEENELVGIITGRDVRFVTDLNQPVSVYMTPKERLVTVREGEAREVVLAKMHEKRVEKALVVDDEFHLIGMITVKDFQKAERKPNACKDEQGRLRVGAAVGAGAGNEERVDALVAAGVDVLLIDSSHGHSEGVLQRIRETRAKYPDLQIIGGNVATAAGARALAEAGCSAVKVGIGPGSICTTRIVTGVGVPQITAVADAVEALEGTGIPVIADGGIRFSGDIAKAIAAGASAVMVGSMLAGTEESPGEIELYQGRSYKSYRGMGSLGAMSKGSSDRYFQSDNAADKLVPEGIEGRVAYKGRLKEIIHQQMGGLRSCMGLTGCGTIDELRTKAEFVRISGAGIQESHVHDVTITKESPNYRLGS

SEQ ID NO: 1805 - protein, 501 aa, Agrobacterium tumefaciens
MARIIQTPTGLDALTFDDVLLQPGHSEVMPGQTNIATRIARDIDLNLPILSSAMDTVTEGRLAIAMAQAGGIGVIHRNLTPIEQAEEVRQVKKFESGMVVNPVTIGPDATLAEAQALMKAHGISGIPVVENGGAGGHKNGRLVGILTNRDVRFASDPQQKIYELMTRENLVTVKESSVDQQEARRLLHKHRIEKLLVVDGKGNCVGLITVKDIEKSQLNPNATKDAQGRLRAAAAISVGADAIERAERLIDAGVDLLVVDTAHGHSQRVLDAVAQVKKMSNSVRIIAGNVATADGTKALIDAGADAVKVGIGPGSICTTRIVAGVGVPQLAAVMAAVEAASLADIPVIADGGIKFSGDLAKAIAAGASAVMIGSLLAGTDESPGEVFLYQGRSFKAYRGMGSVGAMARGSADRYFQAEVRDTLKLVPEGIEGQVPYKGPVSGVLHQLAGGLKAAMGYVGGSNIKEFQERATFVRISSAGLRESHAHDVTITRESPNYPGAV

SEQ ID NO: 1806 - protein, 166 aa, Zea mays
MASEHAAGGEAKHDQKQSLMDKAKGFVVEKIAHIPKPEATLDGVTFKGLSRECITLHSSVNVSNPYDHRLPICEVTYTLRCAGKEVASGTMPDPGWIAASGSTALEIPAKVPYDFLVSLVRDVGRDWDIDYELQVGLTVDLPIVGNFTIPLSTSGEFKLPTLKDLF

SEQ ID NO: 1807 - protein, 131 aa, Zea mays
MSEEKHHHFFNHHKKDEEQPAGEYGYSETEVVTATGEGEYERYKKEEKEHKHKQHLGEAGAIAAGAFALYEKHEAKKDPEHAHRHKITEEVAAAAAVGAGGYVFHEHHEKKKDHKDAEEASGEKKHHHLFG

SEQ ID NO: 1808 - protein, 138 aa, Oryza sativa
MAEEKHHHHLFHHKKDDEPATGVDSYGEGVYTSETVTTEVVAGGQDEYERYKKEEKQHKHKQHLGEAGALAAGAFALYEKHEAKKDPENAHRHKITEEIAATAAVGAGGYAFHEHHEKKKDHKSAEESTGEKKHHLFG

SEQ ID NO: 1809 - protein, 180 aa, Oryza sativa
MSAAEERGDRQERDDGEGGEEERRERGGVGGLVDRAKGFVAEKIAKIPKPDATLDRVSFKGVSRECITLHSHLDVNNPYSHRIPICELTYTFKSGDKVIASGTMPDPGWIAASGTTNLELPVKVPYDFIVSLIKDVSGDWDIDYVLEVGITIDLPVVGSFTIPLATEGEMKLPTFRDLLF

SEQ ID NO: 1810 - protein, 180 aa, Zea mays
MRGAEEERSGAATDAGGEEEKRERSVGLMAGLMDKAKGFVVEKVTQIPKPEAALDHVSFQSISREGVELHSHVDISNPYSHRIPICEITYTFKSAGKVIASGTMPDPGWIAASGSTKLDLPVKVPYDFIVSLMKDLGGDWDIDYMLEVGLTVDLPAIGAFTIPLTTEGEIKLPTFRDLLF

SEQ ID NO: 1811 - protein, 141 aa, Zea mays
MAEEKHHHHHLFHHKKDEEQEEQLAGGGYGESAEYTEATVTEVVSTGENEYDEYKKEEKQHKHKQHLGEAGAIAAGAFALYEKHEAKKDPEHAHRHKIEEEVAAAAAVGSGGFAFHEHHEKKKDHKDAEEAGGEKKHHFFG

SEQ ID NO: 1812 - protein, 345 aa, Zea mays
MISFNNLFWSSLQPSFKFYRKCLTNCPYFALTMHSTTKPLGSSMPVKRAHLKPHAADIKRNPHVHELYKLVYRLPENLSWLLAPPEIPKRPASKKKKQKDEIVAGNSFGVILEWEGVVVDDDDPDLEPRVWYVLSLEEGKSFPPDALLKKIEGMRTDQAIAEVLCWSEDPAEIQRLATHKEVIYQKLQGGYYQLRPHVLDFLNTLVGFDIPIAIAAPRSRKSLEEGIKTVGLQGYFDAIVALEDFCLGKPDGEMFEVAAEQLGLEPDACVVFGNSNLTTESAHNAGMRCVAVAGRHPAYELQSANHVVRWLDQLSIVDLQRLANGEVIGRRGRESDMDMEIVIEE

SEQ ID NO: 1813 - protein, 377 aa, Glycine max
MVESIAATSLLGHRPICGGNLTRDVSVKRKSLNTVRFPTTEFLGGGRIVVSLALPKSDKQDRFVFSSIKALAVELTREAHAYREEKLPNRDTKIDRGFDQRPDSWPPANRADKPSLRNPLLRHERMGCGWLGAIFEWEGVLIEDNPDLEKQAWLALSQEEGKPSPPAFILKRIEGMKNEQAISEVLCWSRDPAQLRRMANRKEEIYQSLQGGIYRFLSGSKEFVSVLMHYKIPMALVSTRPRKALESAIGEIGIEDTFSVIVAAEDVHRGKPDPEMFVYAAQLLNFIPERCIVFGNSNLTVEAAHEARMKCVAVASKHPVYELGAADLVVRRLDELSVVDLKNLADIEMTEFGSVEPEMELEVEKDYGSSSVDDNFW

SEQ ID NO: 1814 - protein, 350 aa, Oryza sativa
MIFSVSLFGSSHQSIHKLYRKCWSSNSHSTLNVLSLAKTVGQSMRMKRIRVKPHATDLKNRPQAHEDNVFYKLVYRLPENLSWLLASPEMARRPPSKKKLKKEEMVSSNQFGVILEWEGVVVEDDDPDLEPRVWYVLSLEEAKSFPPDAVLKEIEGMRTDQAILEVLHWSEDPQEVQRLAARKEVIYKTLRGRFYQLRPGVLDFLNTLVDFDIPIAITTPRPRLSLEEGIKAVGLQGYFDAIVAAEDFCRGKPEGEMFEVTAGQLGLEPDVCLVLGNSNSTIESAHTAGMRCVAVASRYPAYELQAANHVVRWLDQLSVADLQRIANGEILGLRGRRSDMDMDMEIVIEE

SEQ ID NO: 1815 - protein, 112 aa, Escherichia coli
MKKIDAIIKPFKLDDVREALAEVGITGMTVTEVKGFGRQKGHTELYRGAEYMVDFLPKVKIEIVVPDDIVDTCVDTIIRTAQTGKIGDGKIFVFDVARVIRIRTGEEDDAAI

SEQ ID NO: 1816 - protein, 112 aa, Nostoc PCC7120
MKKVEAIIRPFKLDEVKIALVNAGIVGMTVSEVRGFGRQKGQTERYRGSEYTVEFLQKLKVEIVVEDNQVDMVVDKIIAAARTGEIGDGKIFISPVEQVIRIRTGEKNTEAV

SEQ ID NO: 1817 - protein, 197 aa, Brassica napus
MAASIAKPISATSLRFYSDRKNNISFSDCISISSGFRHSPPSSLDLVAKPPPTKARVSHLVRAQSSYDYIPDSKFYKVEAIVRPWRIQHVSSALLKIGIRGVTVSDVRGFGAQGGSKERHGGSEFSEDKFVAKVKMEIVVKKEQVESVINTIIDGARTGEIGDGKIFVLPVSDVIRVRTGERGEQAEKMTGDMLSSS

SEQ ID NO: 1818 - protein, 493 aa, Zea mays
MAGAAAVETAAAAAAANGKACCHAAKGPGYATPLEAMEKGPREKLVYVTCVYNGTGINKPDYLATVDLDPSSPTYSQVIHRLPVTHIGDELHHSGWNSCSSCHGDPSAKRRFLILPSLLSGRVYVVDTATDPRAPSLHKVVESEDIAENTGLGFPHTSHCLASGDIMISCLGDKEGNAAGNGFLLLDSEFNVKGRWEKPGHSPLFGYDFWYQPRHKTMISSSWGAPAAFRTGFDLQHVQDGLYGRHLHVYDWPGGELKQTLDLGDTGLLPLEVRFLHDPSKDTGYVGCALTSNMVRFFKTADGSWSHEVAISVKPLKVRNWILPEMPGLITDFVISLDDRYLYFVNWLHGDIRQYNIEDPAKPFLAGQVWVGGLLQKGSDVVYVTDDGQEQQYNVPQVKGHRLRGGPQMIQLSLDGKRIYVTNSLFSRWDEQFFGDDLVKKGSHMLQIDVDTEKGGLAVNPNFFVDFGTEPDGPALAHEMRYPGGDCTSDIWI

SEQ ID NO: 1819 - protein, 223 aa, Zea mays
MATPAVKVYGWAISPFVSRALLALEEAGVDYELVPMSRQDGDHRRPEHLARNPFGKVPVLEDGDLTLFESRAIARHVLRKHKPELLGGGRLEQTAMVDVWLEVEAHQLSPPAIAIVVECVFAPFLGRERNQAVVDENVEKLKKVLEVYEARLATCTYLAGDFLSLADLSPFTIMHCLMATEYAALVHALPHVSAWWQGLAARPAANKVAQFMPVGAGAPKEQE

SEQ ID NO: 1820 - protein, 556 aa, Zea mays
MGNACGGALRSKYQHSFKHAASSQRRASSEYSASAVADDSPRKPTQPPATTDAHAPPPPPATAAAAMRRGGAGAPPDLGSVLGHPTPNLRDLYALGRKLGQGQFGTTFLCTELATGVDYACKSISKRKLITREDVDDVRREIQIMHHLSGHTNVVAIKGAYEDQLYVHIVMELCAGGELFDRIIQRGHYSERKAAELTRIIVGVVEACHSLGVMHRDLKPENFLLVNKDDDLSLKAIDFGLSVFFKPGQVFTDVVGSPYYVAPEVLLKNYGPAADVWTAGVILYILLSGVPPFWAETQQGIFDAVLKGVIDFDSDPWPVISDSAKDLIRRMLNPRSAKRLTAHEVLCHPWIRDHGVAPDRPLDPAVLSRIKQFSAMNKLKKMALRVIAESLSEEEIAGLKEMFQTMDTDNSGAITYDELKEGLRKYGSTLKDTEIRDLMDAADIDNNGTIDYIEFIAATLHLNKLEREEHLVAAFSYFDKDGSGYITVDELQQACKEHNMPDAFLDDVINEADQDNDGRIDYGEFVAMMTKGNMGVGRRTMRNSLNISMRDAPGAF

SEQ ID NO: 1821 - protein, 272 aa, Zea mays; identical to SEQ ID NO: 1729

SEQ ID NO: 1822 - protein, 234 aa, Zea mays
MAAKIFCLLMLLGISASAATATIFPQCSQAPIASLLPPYLSPAVSSVCENPILQPYRIQQAIAAGILPLSPLFLQQSSALLQQLPLVHLLAQNIRAQQLQQLVLANLAAYSQQQQFLPFNQLAALNSASYLQQQQLPFSQLPVAYPQQFLPFNQLAALNSPAYLQQQQLLPFSQLAGVSPATFLTQPQLLPFYQHAAPNAGTLLQLQQLLPFNQLALTNLAVFYQQPIIGGALF

SEQ ID NO: 1823 - protein, 361 aa, Zea mays
MCGGAILAELREPAPRRLTERDIWQQKKKPKRGGAGGRRSFAAEDDEDFEADFEDFEADSGDSDLELGEGADDDVIEIKPFAAKSTFSRDGLSTMTTAGYDAPAARLAKRKRKNQYRGIRQRPWGKWAAEIRDPQKGVRVWLGTFNSPEEAARAYDAEARRIRGKKAKVNFPDAPAVGQKCRSSSASAKALKSCVEQKPIVKTDMNILANTNAPFYQSVNYASNNPFVPAMNSTVSFEDPIMNLHSDQGSNSLGCSDLGWENDTKTPDITSIAPIPTIAEGDESVFVNSNSNSSMVPPVLENNAVDLTDGLTDLESYMRFLMDGGASDSIDSLLNLDGSQDLGSNMDLWTFDDMPIAGDFF

SEQ ID NO: 1824 - protein, 377 aa, Zea mays
MAQDEAVATQKTGNTTSPSKDYPTPSPYPDWSTMQAYYGPGVLPPTYFTPAIAPGHPPPYMWGPQPIMPPPFGTPYAAVYPHGGAYPHPLVPMMSTPMSVEPAKSANSKEKNSNKKLKEIDRTAVSAGSGNSKRTVSSIEDYSAEGSSDVNDQNVNETSRKRSSDGGPGAETTTGGNTECVLAPNHTLGNATILPQHCFSAPVIKPSATNVANSRAIGTALSPPPGVMVPVHNAVPSDLSVKDERELKREKRKQSNRESARRSRLRKQAETEELATQVESLAAENTSLRSEIGRLTESSEKLRLENSALMVKLKDTAEPSPSKAAASPSSPRASAENFLSMIDSANAPSVSRHTEHGGPRLRQLLDSSPATDVAAVS

SEQ ID NO: 1825 - protein, 157 aa, Zea mays
MKGAKSKGAAKADAKLAVKSKGAEKPAKGRKGKAGKDPNKPKRAPSAFFVFMEEFRKEFKEKNPKNKSVAAVGKAAGDRWKSLSESDKAPYVAKANKLKLEYNKAIAAYNKGESTAAKKAPAKEEEEEDEEESDKSKSEVNDEDDEEGSEEDEDDDE

SEQ ID NO: 1826 - protein, 141 aa, Zea mays
MAAADVEYRCFVGGLAWATSNESLENAFASYGEILDSKVITDRETGRSRGFGFVTFSSENSMLDAIENMNGKELDGRNITVNQAQSRGGGGGGGGYGGGRGGYGGRREGGGGGYGGGGGYGGRREGGGGGYGGGGGGGWRD

SEQ ID NO: 1827 - protein, 446 aa, Zea mays
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSNKISGDSLKDLYKSFVSEYPIESIEDPFDQDDWSTYAKLTDEIGQKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 1828 - protein, 203 aa, Zea mays
MGFPVGYSESEMLLPRVLLQVLLLLGHFHRFLLWAFHAVGLGDLIDLGCNYPPPPPSASTAHEMMEHQHQHQGRDDVASPLQHQRPEFRPVAAALIEEALPVVRFDELGGAPCGGGDCAVCLSGIGGGDEVRRLGNCRHAFHRACLDRWMAHDQRTCPLCRAPLIPWAADADYDMSYPSPLPPTPLRRPHELLLLLTGLGGFQ

SEQ ID NO: 1829 - protein, 319 aa, Zea mays
MAIKRTKAEKKIAYDKKLCSLLDEYTKVLIALADNVGSKQLQDIRRGLRGDSVVLMGKNTLIRRCIKVYAEKTGNHTFDPLMDLLVGNVGLIFTKGDLKEVREEVAKYKVGAPARVGLVAPVDVVVPPGNTGLDPSQTSFFQVLNIPTKINKGTVEIITPVELIKKGEKVGSSESALLAKLGIRPFSYGLQVTSVYEDGSVFSPEVLDLSEEDLIEKFATGVSMVASLSLAISYPTLAAVPHMFINGYKNVLAVAVETDYSYPHADKIKEYLKDPSKFAVAAPVAAGDSGAAAAPKEEEKAAEPEEESDEEMGFSLFDD

SEQ ID NO: 1830 - protein, 348 aa, Zea mays
MENGGAKGDVPDDANEHCPGTQSEEAGKADACAGCPNQQICATAPKGPDPDVVAIVERLATVKHKLLVLSGKGGVGKSTFSAQLSFALAEMDHQVGLLDIDICGPSIPKMLGLEGQDIHQSNLGWSPVYVESNLGVMSIGFMLPNPDDAVIWRGPRKNGLIKQFLKDVDWGEIDYLVVDAPPGTSDEHISIVQYLQATGIDGAIIVTTPQQVSLIDVRKEINFCKKVGVPVLGVVENMSGLRQPLSDLRFIKSDEAGKTDATEWALNYIKEKAPELLSVMACSEVFDSSKGGAEKMCHEMGVPFLGKVPMDPQLCKAAEEGRSCFADQKCSASAPALRNIVKKLIKAE

SEQ ID NO: 1831 - protein, 449 aa, Zea mays
MYRAKRAALSPKVKRRVGKYELGRTIGEGTFAKVRFAKNTENGEPVAIKILDKEKVKRHRLVEQIKREICIMKLVRHPNVVRLFEVMGSKARIFIVLEYVTGGELFEIIATNGRLKEDEARKYFQQLINAVDYCHSRGVYHRDLKLENLLLDAAGNLKVSDFGLSALTEQVKADGLLHTTCGTPNYVAPEVIEDGGYDGATADIWSCGVILFVLLAGYLPFEDDNIIALYKKISEAQFSCPSWFSAGAKNMITRILDPNPTTRITISQILEHPWFKKGYKPPVFDEKYQTSLDDVDAAFGDSEDRHVKEETEDQPTSMNAFELISLNQALNLENLFEAKEEYKRETRFTSQCPPKEIITKIEEAAKPLGFDVQKKKYKMRMENPKAGRKGNLNVATEVFQIAPSLHVVELKKAKGDTLEFQKFYRSLSTQLKDVVWKCDGEVDGNSAAA

SEQ ID NO: 1832 - protein, 592 aa, Zea mays
MGLCHGKPTQIPEAEAGEDPHVASGAGDSGDGPTSPSAAAPTAKPGTPKQPKFPFYLPSPLPPSSYKGSPANSSVASTPARGGFKRPFPPPSPAKHIRALLARRHGSVKPNEASIPEGGEPELGLDKSFGFSKHFFAKYDLGEEVGRGHFGYTCSAKAKKGEHKGQDVAVKVIPKAKMTTAIAIEDVRREVRILSSLTGHSNLVQFYDAFEDEDNVYIVMELCKGGELLDRILARGGKYSEEDAKVVMVQILSVVSFCHLQGVVHRDLKPENFLFSSKDENSPLKVIDFGLSDFVKPDERLNDIVGSAYYVAPEVLHRSYATEADMWSIGVIAYILLCGSRPFWARTESGIFRAVLKAEPSFDEAPWPTLTAEAKDFVKRLLNKDYRKRMTAAQALSHPWIRNSQQVKVPLDMIIYKLMRAYISSSSLRKSALRALAKTLTTDQLFYVREQFELLGPNKNGYISLQNLKSALAKNSTDAMKDSRVVDFVNTVCALQYRKLDFEEFAASAISVYQMEALETWEQHARRAYELFDKEGNRPIVIEELASELGLGPSVPLHVVLQDWVRHADGKLSFLGFIKLLHGVSSRSIPKA

SEQ ID NO: 1833 - protein, 229 aa, Zea mays
MAARRLGSPASRWLRPSALLLLVASALLSAPSPARALRFDLESGHTKCVSDEIKVNAMAVGKYHIVGPDPNSPDAQLPESHRISLRVTSPYGNSMHYAENVQSGHFAFTAAEAGDYLACFWAPDHKPPVTIGFEFDWRSGVSAKDYPSVAKKGKVDMMELELKKLEETIKNIHEEMLYLREREEEMQDVNRRTNSRMAWLGFLSLGVCLSVAGLQLWHLKTFFERKKLL

SEQ ID NO: 1834 - protein, 173 aa, Zea mays
MARVYVGNLDSRVTSGELEDEFRVFGVLRSVWIARKPPGFAFIDFDDRRDAEDAIRDLDGKNGWRVELSRNSSGRGGRDRYGGSESKCYECGETGHFARECRLRIGSGGLGSGRRRSRSRSRSRSRSRSRSRSRSPRYRRSPSYSRRSYSPRYRSPRRRSPSPTRARSYSRSP

SEQ ID NO: 1835 - protein, 550 aa, Oryza sativa
MAAPAAESAVVGVGVDSATSAAVRDGFAELERQQQLLATCTRLYQQLTEHFGSLERRLAARSETLRTKRRFLDVRTSRRLEALRRREASIDGSVSLALSRLDSLAKGDAGTTGSASADAAGIAEGLRSLCASMDSAGFFTFVVARRKEVDALRAELPDALKRCVDPARFAMDAVSEVFPIDKRAVRSPTDLAWACVLILEAVVPSLADPDPEIGAARPMVPQAARERARGMAREWKDAAEKKGGVEGAKPPDAHAFLQHVATFAVAEKEDKELYRRIVVSFSWRRQMPRLAITLGLEDEMDDIIEELITKGQQLDAVNFAYEAGLQEKFPPAPLLKAYLEDSKKIPSNSDNLSTSTGQSGSNANKKEQSALRAVIKCVEDHKLEAEFPLEDLRERLEELEKAKTEKKKAASSSSSGGSSGPANKRIRASTGGPMPPAKAGRLTDYTGTPSSPATTTTNATFIRSPSHASYGTASPYSYDRPAAHPLYCGQNTLAMREPYAYHHPSEVSSVGLGMSYPSPPMTYPAYAGYSNGIGYSNAMAPAFHHQAYYR

SEQ ID NO: 1836 - protein, 1049 aa, Oryza sativa
MLSGNLIKKVVMPPGAISLDDVDIDQVSVDYVLNCAKKGEALDLGDAIRLFHDSLDYPYVNNSGTVEEFFLLTKPEYSGPAPAREPPPVPAIAPSPVVIPAPIVDPPPVAVHSPVSTTNLSKSQSFDSPTEKELTIDDIEDFEDEEDEFDSRRASRRHQSDANDLSLRLPLFETGITDDDLRETAYEILVAAAGASGGLIVPQKEKKKEKRNKLMRKLGRSKSESTQSQTQRQPGLVGLLETMRAQLEITESMDIRTRQGLLNAMVGKVGKRMDNLLIPLELLCCISRAEFSDMKAYLRWQKRQLNMLEEGLINHPVVGFGELGRKVNELRNLFRKIEESESLQPSAVEVQRTECLRSLREVATSLSERPARGDLTGEIHYQLQEVEEILELLKSTWRILGITETIHDTCYAWVLFRQFVFTGEQGLLKVVIEHLRKIPLKEQRGPQERLHLKSLRSSVDAEDSFQDFTFFQSFLSPVQKWVDKKLNDYHLHFSEGPSMMADIVTVAMLIRRILGEENNKGMESPDRDQIDRYITSSVKSAFVKMAHSVEAKADTSHEHVLASLAEETKKLLKKDTTVFSSVLSKWHPQSAVVSASLLHKLYGSKLKPFLEHAEHLTEDVVSVFPAADALEQYIMSVMASVVGDDGLDSICRQKLAPYQIESKSGTLILRWVNGQLERIETWVKRAAEQETWDPISPQQRHGASIVEVYRIIEEVPMRTGELNSLCRGFDKAFQVYTQLVTGPIVDREDLIPPVPVLTRYKKELGIKAFVKKEIHEVRTVDERKASEIIQLTMPKLCVRLNSLYYGISQLSKLEDSINERWARRKSESINIRRSMSEKSKSAVSSQKNQFDGSRKEINAAIDRICEFTGLKVIFWDLQQPFIDNLYKNNVSQARLDAIMEVLDTVLNQLCNVIVEQLRDRVVTGLLQASLDGLLRVILDGGPTRVFSPSDATLLEEDLEILKEFFISGGDGLPRGTVENLVSRVRPVIDLIKQETRVLIDDLREVTQGAKSKFGTDSKTLLRVLCHRNDSEASHYVKKQFKIPSSAPAT

SEQ ID NO: 1837 - protein, 584 aa, Zea mays
MDLDARHRHTPDSSSSPHAASDMGLPLAGAAYQPYVSELLSFSIERLHKEPELLRVDAERVRRQMQEVAVENYGAFIAASEALSFVRAQLESFDGHLEAMIEEIPNLTSGCTEFVESAQQILEERKLNQTLLANHTTLLDLLEIPPLMDTCIRNGNYDEALDLEAFVSKISKLHPDLPVVQGLAAEVKKTVQSLISQLLQKLRSNIQLPECLRIVAHLRRIGVFSESELRLQFLRCREAWLSGILEDLDQRNVYDYLKGMVTCHRVHLFDVVNQYRAIFNNDKSGNDENSEGGLLFSWAMQQVSNHLATLQVMLPSITEGGSLSNILEQCMYCAMGLGLVGLDFRGLLPPIFEDAVLNLFSKNMSMAVENFQVVLDSHRWVPMPSVGFVANGVVDDTSDDVTPPSVLMEHPPLAVFVNGVSAAMNELRPCTPLSLKVVLAQEVVKGLHAVSDSLVRYKAMRMLRGNESALFLSLCQAFIEVVHPYCAACFGRCYSNGATLISECQGTLDAVRQLLTIPARSNSSSIERKQSGAIERKQSVESSGTAVTYNELSADGPGLEINDAATTTTPPVEDDVSTHPPGSK

SEQ ID NO: 1838 - protein, 415 aa, Zea mays
MGQMISGDKSDEQTARDDGIIKNGREILFQAFNWESNKHNWWSILEEKVTDLAESGFTSVWLPPPTQSLSREGYLPQNLYCLDSCYGSLHELKLLLHKMSEHNVRAMADVVINHRIGTTQGSNGMYNRYDGIPVSWDEHAVTSCSGGKGNKSTGDNFDGVPNIDHTQPFVRKDIIEWLIWLRKSVGFQDFRFDFTKGYAAKFVKEYIEESKPLFAVGEYWDSCEYSPPDYRLNYNQDIHRQRIINWIDNTGGLCAAFDFTTKGILQEAVKGELWRLRDSEGKPPGVMGWWPSRSVTFIENHDTGSTQGHWPFPSDHIMEGYAYILTHPGIPTVFYDHFYDQGVPLHDEIAKLMQIRKCQDIHSRSSIKILEVGSDLYSAIIDDKLCMKIGDGSWCPSDPEWRLAVSGDRYAVWHK

SEQ ID NO: 1839 - protein, 901 aa, Oryza sativa
MDIVPVVALCCCLVLLPSWAYGLGSMASIAVSYGEDGPVFCGLNSDGSHLVTCFGADASVVYGAPSRIPFVGVTAGDGFACGLLLDTNQPYCWGSNSYVKIGVPQPMVEGAMYSELSAGDNHLCALRTSVKGFHSVNGDTSVIDCWGYNMTATHTVTGAVSAISAGSVFNCGLFARNRTVFCWGDESVSGVIGLAPRNVRFQSIGAGGYHVCGVLENAQVFCWGRSLEMQQMSTPSSTDDGDVNIVPMDAMVSVVGGRFHACGIRSLDHQVACWGFTLQNSTLAPKGLRVYAIVAGDYFTCGVPAETSLKPMCWGHSGPLALPMAVSPGICVSDSCSHGYYEYANHGEVGSGSKTCKPANSRLCLPCSVGCPDDSYESSPCNATADRVCQFDCSKCASDECVSFCLSQKRTKNRKFMAFQLRIFVAEIAFAVILVFSVTAIACLYVRYKLRHCQCSKNELRLAKNTTYSFRKDNMKIQPDVEDLKIRRAQEFSYEELEQATGGFSEDSQVGKGSFSCVFKGILRDGTVVAVKRAIKASDVKKSSKEFHTELDLLSRLNHAHLLNLLGYCEDGSERLLVYEFMAHGSLYQHLHGKDPNLKKRLNWARRVTIAVQAARGIEYLHGYACPPVIHRDIKSSNILIDEDHNARVADFGLSILGPADSGTPLSELPAGTLGYLDPEYYRLHYLTTKSDVYSFGVVLLEILSGRKAIDMQFEEGNIVEWAVPLIKAGDISALLDPVLSPPSDLEALKKIAAVACKCVRMRAKDRPSMDKVTTALERALALLMGSPCIEQPILPTEVVLGSSRMHKKVSQRSSNHSCSENDLVDGDDQRIEYRAPSWITFPSVTSSQRRKSSASEADMDGRTTTDGRNVGSSIGDGLRSLEEEISPASPQENLYLQHNF

SEQ ID NO: 1840 - protein, 768 aa, Oryza sativa
MFSLFSFVVIFLCLITNAIYSGSKFVHATDTLLPGKSLSGNQVLISKGGAFRLGFNCLSPPCYSDSTFGIWYIKSSTCRSLLVWAPVANFCIFNPWSSSFILSEDGKLNLIIDGSLSWSSNGVETSVSAVAILLDNGNLVIRDQVNSTMVFWQSFDNPIGILLPGGWLGFNRMTGKNVSLSSKYSTDGYDAYDTGNFILDINANEGRGFTINAPDFDSGNTYKIKYSGAFPRWMGVRADGGSFLLFNDADIYVQLYPDGNVTAAKLGDCGSVLWSAPENWCDFDSYCGSNSFCIIPSKESFFESPCYDFSDLGYLMNVSLNCRYNAPHKQNVSFHPMVGVYKFPQNEWSIEVRSIRECEAACYSDCSCTSFAFNKTCLLWYGELQNTIVFDSRSEGYLMYMRVVEQKQEKSEYKVAIIVVTVIGGLVLILISMILLWRGKRKLFTEKPVNSDSRLMIFSNSQLKNATKGFSEKLGEGGFGCVFKGTLPGFSVVAVKKLKDLRQGEKQFRSEVQTIGMIQHINLVRLLGFCAEGSKRLLVYEYLVNGSLNSHLFSNYSAKLTWNLRYCIAHGIAKGLAYLHEECRHCIIHCDMKPDNVLLDAEFCPKIADFGMAKLLGRDFSRALTTMRGTIGYLAPEWISGLPITHKADVYSYGMMLLEIISGRRNSEKIKEGRHTYFPIYAACKVNEGDVMCLLDRRLDGNADAEQLEKACRIACWCIQDAEDHRPMMGQVVHMLEGVMDVEVPPIPRSLQYFVGMEDNNTQSAECN

SEQ ID NO: 1841 - protein, 782 aa, Oryza sativa
MAPTLAFLLVLLLLLAGGGGGGAFLAAAASTDTVVPGKGMAGNQTLVSKNGRFELGFFTPGSGIHYFLGVRLRNMAEYSPTFWIGDRVGVIDLPGVSLEVFGDKLYIKEDGVSLWWSSVAGNGSSSSSDGGAVAVLLDTGDLVVRDQGNPSGVLWRSFDYPGDSLLPGGRLGLDAATGTNVSLTFKGFSHNGSLQVDASRRNGFVLTTDGIDSRGAFPDWMVTSQDNGSSLVLNHPDAPNSTEFLQFNLGLISLMRWSDSTAGWVARWTFPSDCKSGAFFCGDFGACTAGGGGGCECVDGFTPSYPDEWRLGYFVTGCSRSLPLSCEANGQTEHDDSFAILDNLRGLPYNAQDEPVTTDEDCRAACLNKCYCVAYSNESGCKLWYHNLYNLSSADKPPYSKIYVRLGSKLKSNRGLATRWIVLLVVGSLAVTSVMLGLVLLCRYRRDLFASSKFEVEGSLIVYTYAQIRKATGNFSDKLGEGGFGSVFRGTLPGSTTVVAVKNLKGVGQAEKQFRTEVQTVGMIRHTNLVRLLGFCVNGNRRLLVYEYMSNGSLDAHIFSEKSSLLSWHVRYQIALGIARGLAYLHEECEDCIIHCDIKPENILLDYEFCPKICDFGMAKLLGREFNSALTTVRGTMGYLAPEWIYGQPITKKADVYSFGIVLFEIISGRRSTETVKFGSHRYFPTYAAVQMNEGDVLCLLDSRLEGNANVKELDITCRVACWCIQDEENDRPSMGQVVRMLEGVVDMEMPPIPASFQNLMESEDSGIYSEESWNFRTRDQF

SEQ ID NO: 1842 - protein, 813 aa, Oryza sativa
MACSFLCKPWLPLTESAKPARSPAPSSRARTVVQQLAVLLLLLGGVGGGGGALLAAAASTTDTILPGESITGNQTLVSKNGEFELGFFNPGVGIHYFLGVRLRKLAAYSPTFWIGDRVYVVDLPRAALELFGDSLYIKEDGASLWWSSPSSSSSSSGGGRGGGAAVAVLLDTGDLVVRDQRNSSLVLWRSFDYPGDALLPGGRLGLDVATGENVSLTFEGFTHNGSLRADASRRNGFVLTTDGRDTRGAFPDWMVTTQDNGGSLVLNHPDATNSTEFLQLKVGQVSLVRWSGADAGWVPRWTFPSGCKSGGGFFCGDFGVCTTATGGECRCVDGFAPSDTKEWGLGYFVTGCSRSLPLSCDANGQTEHGDSFAILDNLQGLPYNAQDEPATTDEDCREACLNKCYCVAYSTETGCKLWYYDLYNLSSADKPPYSKIYVRLGSKLKSKRGLATRWMVLLVVGSVAVASAMLAVLLLCRYRRDLFGSSKFVVEGSLVVYSYAQIKKATENFSDKLGEGGFGSVFRGTLPGSTTVVAVKNLKGLGYAEKQFRAEVQTVGMIRHTNLVRLLGFCVKGNRKLLVYEYMPNGSLDAHIFSQKSSPLSWQVRYQIAIGIARGLAYLHEECEHCIIHCDIKPENILLDEEFRPKIADFGMAKLLGREFNAALTTIRGTRGYLAPEWLYGQPITKKADVYSFGIVLFEMISGIRSTVTMKFGSHRYYPSYAAAQMHEGDVLCLLDSRLEGNANVEELDITCRVACWCIQDREGDRPSMGHVVRMLEGVVDTEMPPIPASFQNLVDGDDSDIYEENWRLRTQD

SEQ ID NO: 1843 - protein, 749 aa, Oryza sativa
MILNVIILFVDSYVAVASDTLFPGQSLSGSETLVSENGIFELGLFPSAPAGTKHYLGIRYKNMSSNNPITFWLGNRIPITYFINATLYIDAGKLYIEELGSILWTSNSTRNESNTAVAVILNTGNFVIRDQLNSSVVTWQSFDHPADKLLPGAYLGLDMVMGTNILLTLFKPPYNCTLMIDQSRKRGFIMFIDGHDKYLGTFPEWMVTYEENGSLVRLNDPGIPNDTEYMKLQLGQLSLLRWLDNATISGWQSVWSHPSSCKVSAFHCGAFGICTSTGTCKCIDGFRPTEPNEWELGHFGSGCSRITPSNCLGVVSTDLFVLLDNLQGLPYNPQDVMAATSEECRAICLSECYCAAYSYHSACKIWYSMLFNLTSADNPPYTEIYMRIGSPSKRRMHILVFVLIFGSIGVILFLLMLLLMYKRSSCVARQTKMEGFLAVYSYAQVKKATRNFSDKLGEGSFGSVFKGTIAGSTIVAVKKLKGLGHTEKQFRTEVQTVGMIQHNNLVRLLGFCTRGTRRLLVYEYMPNGSLDSHPFSETSRVLGWNLRHQIVVGIARGLAYLHEECRDSIIHCDIKPENILLDAEFCPKIADFGMAKLLGREFSAALTTIRGTIGYLAPEWISGQAITHKADVYSFGVVLFEIISGRRSTEKIRHGNHWYFPLYAAAKVNEGDVLCLLDDRIEGNASLKELDVACRVACWCIQDDEIHRPSMRKVIHMLEGVVDVELPPIPASFQNLMDDYDSDIYSVEV

SEQ ID NO: 1844 - protein, 822 aa, Oryza sativa
MEIARQLSVAYYQRPAMAALQSAVVFADTVTAKRPLSGSQSALVSKRRKFALGFFQPENSQHWYLGIWYNQISKHTPVWVANRGTPISNPDTSQLTIATDGNMVLLDNSTTAIWSTNISKIASNSTVGVILDTGNLVLADESNTSIIHWQSFDHFGNTWLPGGKLGRNNKLAGVSTRLVAWKARNDPSPGVFSLELDPNGTSQYLLEWSITQQYWTSGNWTGRIFADVPEMTGCYPSSTYTFDYVNGENESESYFVYDLKDESVLTRFFLSEMGQIQFLTWIYAAKDWMPFWSQPKVKCDVYSLCGPFSVCTENALTSCSCLRGFSEQNVGEWLQGDHTSGCRRNVELQCSSNASVMGRTDGFYTMANVRLPSNAESVVVIGNDQCEQACLRSCSCTAYSYNGSCSLWHGDLINLQDVSAISSQGSSTVLIRLAASELSGQKQKNTKNLITIAIVATSVLVLMIAALFFIFRRRMVKETTRVEGSLIAFTYRDLKSVTKNFSEKLGGGAFGLVFKGSLPDATVVAVKKLEGFRQGEKQFRAEVSTIGNIQHVNLIRLLGFCSEKSRRLLVYEYMPNGSLDKQLFDNKKHVLSWNTRYQIALGIARGLDYLHEKCRDCIIHCDIKPENILLDGSFAPKVADFGLAKLMGRDISRVLTTARGTVGYIAPEWIAGTAVTAKADVFSYGMTLLEIVSGRRNVQGRRRRQEQQDDGGAAADRPFPLVAAGRLVGGGGGRREELVSAVVDGRLGGDADMGEAERACRVAFWCIQDDENARPAMATVVQVLEGLVEIGVPPIPRSLQFLAELADQSNYLQFFSDLLPSN

SEQ ID NO: 1845 - protein, 831 aa, Oryza sativa
MPPLLYNLFVLIVVFLGGGAPACSAATDTVKPGHVVGGKDKVVSNNGKFALGFFKAPAPNQEKWFLGIWFNTVPNRTTVWVANGGEPIMDAADAGSPELTISGDDGDLVALHPTTKSIAWSTNVSAKNSTSNSNNTAAVLLNSGNLVLQDTSNMSQPRTLWQSVDHPTDTLLPGAKLGRDKLTGLNRRLVSKKSMAGPSPGAYCFEVDEDTPQLVLKLCNSSVTYWSSGPWNGQYFTGIPELIGNSPGFHLGFFDNSREEYLQFNVSNEAVVTRNFIDVDGRNKQQVWLDSSQSWLTLYSNPKVQCDVYGVCGAFSVCSFSLLPLCSCMKGFTVGSVKDWEQGDQTGGCVRKNQLDCVGSNTSSSDSTDKFYSMSDIILPDKAESMQDVDSSDECMKVCLNNCSCTAYSYGSKGCLVWHTELLNAKLQQQNSNGEIMYLRLSARDMQRSKKRRVIIGVVVGACAAGLAVLMFILMFIIRRNKDKNRSENYGSLVAFRYKDLRSATKNFSEKIGEGGFGSVFRGQLRDSTGIAVKRLDGRSQGDKQFRAEVRSIGTIQHINLVNLIGFCSDGDSRFLVYEHMPNRSLDTHLFQSNGKFLDWNTRYQIALGVARGLCYLHESCHDRIIHCDIKPQNILLDASFLPKVADFGMAKFVGRDFSRALTTMRGTIGYLAPEWISGTAITPKVDVYSYGMVLLELVSGRRNSARSEEECTTTTTTSTSTDTDGNYSVYFPVQASRKLLDGDVMSLLDQKLCGEADLKEVERVCKIGCWCIQEDEVDRPTMGQVVQILEGVLDCDMPPLPRLLQRIFERPSSVSTSTPVFLFVGSPERQ

SEQ ID NO: 1846 - protein, 824 aa, Oryza sativa
MEAHGNRRSSPTYLVMLWMISVASLLITCRGSIQKQVLFPGFTAAQMDYIDNDGIFLLSNGSVFGFGFVTSNVSDNTFYILAVVHMATTTTVWSANPNSPVTHSDDFFFDKDGNAFLQSGGGSKYGLPISPGRDCHLYATTGLWQSVVLGKDASSPLWQSFSHPTDTLLSGQNFIEGMTLMSKSNTVQNMTYTLQIKSGNMILYAGFETPQPYWSAQQDSRIIVNKNGDRIYPANLSSASWSFYDQSGSLLSQLVIAQENANATLSAVLGSDGLIAFYMLQGGNGKSKFSITVPADSCDMPAYCSPYTICSSGTGCQCPSALGSFANCNPGVTSACKSNEEFPLVQLDSGVGYVGTNFFPPAAKTNLTGCKSACTGNCSCVAVFFDQSSGNCFLFNQIGSLQHKGGNTTRFASFIKVSSRGKGGSDSGSGKHNTIIIVIMLGTLAIIGVLIYIGFWIYKRKRHPPPSQDDAGSSEDDGFLQTISGAPVRFTYRELQDATSNFCNKLGQGGFGSVYLGTLPDGSRIAVKKLEGIGQGKKEFRSEVTIIGSIHHIHLVKLRGFCTEGPHRLLAYEYMANGSLDKWIFHSKEDDHLLDWDTRFNIALGTAKGLAYLHQDCDSKIVHCDIKPENVLLDDNFIAKVSDFGLAKLMTREQSHVFTTLRGTRGYLAPEWLTNYAISEKSDVYSYGMVLLEIIGGRKSYDPSEISEKAHFPSFAFKKLEEGDLQDIFDAKLKYNDKDGRVETAIKVALWCIQDDFYQRPSMSKVVQMLEGVCEVLQPPVSSQIGYRLYANAFKSSSEEGTSSGMSDYNSDALLSAVRLSGPR

SEQ ID NO: 1847 - protein, 157 aa, Zea mays
MAAADVEYRCFVGGLAWATSNESLENAFASYGEILDSKVITDRETGRSRGFGFVTFSSENSMLDAIENMNGKELDGRNITVNQAQSRGGGGGGGGYGGGRGGGGYGGGRRDGGYGGGGGYGGRREGGGGGYGGGGGYGGRREGGGGGYGGGGGGWRD

SEQ ID NO: 1848 - protein, 155 aa, Zea mays
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGYGGGGGYGGGGGGYGGGNRGGGYGNSDGNWRN

SEQ ID NO: 1849 - protein, 205 aa, Zea mays
MADVDEYRCFIGNLSWSTTDESLKDAFSKFGNLTEAKVVLDKFSGRSRGFGFVTFDEKQAMEDAIEGMNGLDLDGRNITVDKAQPQGPGRDRNGDRDYDRERGSRYERGRDYGGGRAPRGGGGGGGGGDCFKCGKPGHFARECPSGDGGRGDRYGGRDDRYGGGGGGGGGRYGSDRGGDRYSGRSRDGGSYGGGDRYSRDRSGPY

SEQ ID NO: 1850 - protein, 156 aa, Zea mays
MAAFNKLGGLLRHSALVSGITGGSSPAVFNAARLMSTKLFIGGLDWGVDDVKLREAFSSFGEVTEARVITDRETGRSRGFGFVNYSDSDAAKEAISAMDGKEIDGRQVRVNMANERPAGNRGGGGYGGGGYGGGGYGGGGGYGGGGYGGGSQSYDA

SEQ ID NO: 1851 - protein, 133 aa, Zea mays
MMLANKLGGLLKNATSSNMSVYQAIRCMSSSKLFVGGLSYGTDDHSLRDEFAKYGQVIEAKIILDRESGRSRGFGFITYTSSEEASAAITAMDGKTLDGRNIRVNHANERTGGFRSSGGYGGGLFKMAQGFLK

SEQ ID NO: 1852 - protein, 348 aa, Saccharomyces cerevisiae
MSKTAVKDSATEKTKLSESEQHYFNSYDHYGIHEEMLQDTVRTLSYRNAIIQNKDLFKDKIVLDVGCGTGILSMFAAKHGAKHVIGVDMSSIIEMAKELVELNGFSDKITLLRGKLEDVHLPFPKVDIIISEWMGYFLLYESMMDTVLYARDHYLVEGGLIFPDKCSIHLAGLEDSQYKDEKLNYWQDVYGFDYSPFVPLVLHEPIVDTVERNNVNTTSDKLIEFDLNTVKISDLAFKSNFKLTAKRQDMINGIVTWFDIVFPAPKGKRPVEFSTGPHAPYTHWKQTIFYFPDDLDAETGDTIEGELVCSPNEKNNRDLNIKISYKFESNGIDGNSRSRKNEGSYLMH

SEQ ID NO: 1853 - protein, 425 aa, Zea mays
MLPSHLNGHSALGRRRPRLSAAAGESPAAAGVEAAAPLEEHDRIYFQAYSHLGIHETMIKDRVRTDAYHAAIMRHQKFIEGKVVLDVGCGTGILSVFCARAGAKRVYAVEACEIVVQAREIVKANNLTDQIVVIHGRVEDVDLEEKVDVIISEWMGYMLLYESMLPSVLFARDKWLKPGGLILPSHATLFMAPVTNRERYEDSVDFWRDVYGINMSALVPLAKKFTSEEPSIETIGGENVISWPSVFKRFDCYNFTAEEFKSITSKYKVSSMMLAPIHGFGFWFEVEFNEPIESSHNFPSSLDPLEIIQKKRRRSSEDIVLSTAPEDEPTHWQQTILYFPDPIEVKQDQIIEGSVTVSQSEENPRFLNIHLECFTGGQTLVKDCAMPMNWCFYASSGLISGAQWGVGREELTIFQISLMEVENLY

SEQ ID NO: 1854 - protein, 377 aa, Zea mays
MASLPNGGGAAASGSCGARPVDKEVDFANYFCTYAYLYHQKEMLCDRVRMDAYHSAVFRNAPHFQGKVVLDVGTGSGILAIWSAQAGARKVYAVEATNMAEHARELARANGVTDIVEVIQGTVEDVDLPEKVDVIISEWMGYFLLRESMFDSVICARDRWLKPDGVMYPSHARMWLAPIRTGLGDKKREDFDIAMDDWSLFVQDTQTYYGVNMNALTKAYRAEHEKYYLKSSIWNNLHPNQVIGQPAAIKEIDCLTATVDEIREVRAQVTLPIRMEARLSALAGWFDVHFRGSAQNPGVEEVELTTAPDEHGGTHWGQQVFLLTPPLSVTKGDNVNVSFSMVRSKENHRLMDMEFTYELHELSGRKHPAVKTKMYLE

SEQ ID NO: 1855 - protein, 157 aa, Zea mays; identical to SEQ ID NO: 1847

SEQ ID NO: 1856 - protein, 374 aa, Zea mays
MSGGGVDGAPVAEFRQTVTHGGRFLQYNIFGNLFEITHKYQPPIMPIGRGAYGIVCSVMNSETKEMVAIKKIANAFDNHMDAKRTLREIKLLRHLDHENIIGIRDVIPPPVPQAFNDVYIGTELMDTDLHHIIRSNQELSEEHSQYFMYQILRGLKYIHSANVIHRDLKPSNLLVNANCDLKICDFGLARPSSESDMMTEYVVTRWYRAPELLLNSTDYSAAIDVWSVGCIFMELINRQPLFPGRDHMHQMRLITEVIGTPTDDELGFIRNEDARKYMRHLPQFPRRPFVSLFPRMQPVALDLIERMLTFNPLQRITVEEALEHPYLERLHDVADEPICTDPFSFDFEQQALTEDQMKQLIFNEAIELNPNFRY

SEQ ID NO: 1857 - protein, 397 aa, Zea mays
MDGGGQPPDTEMTDAGAGGGGQPSPPQQPAGGAGMMENIHATLSHGGRFIQYNIFGNVFEVTSKYKPPILPIGKGAYGIVCSALNSETAEQVAIKKIANAFDNKIDAKRTLREIKLLRHMDHENIVAIRDIIPPPLREAFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDVWSVGCIFMELMDRKPLFPGRDHVHQLRLLMELIGTPNEADLDFVNENARRYIRQLPCHARQSFPEKFPHVQPLAIDLVEKMLTFDPRQRITVEGALAHPYLASLHDISDEPVCSMPFSFDFEQHALSEEQMKDLIYQEALAFNPDYQ

SEQ ID NO: 1858 - protein, 370 aa, Zea mays
MAMMVDPPNGIGNQGKHYYSMWQTLFEIDTKYVPIKPIGRGAYGIVCSSINRETNEKVAIKKIHNVFDNRVDALRTLRELKLLRHLRHENVIALKDIMMPIHRRSFKDVYLVYELMDTDLHQIIKSPQGLSNDHCQYFLFQLLRGLKYLHSAEILHRDLKPGNLLVNANCDLKICDFGLARTNSSKGQFMTEYVVTRWYRAPELLLCCDNYGTSIDVWSVGCIFAELLGRKPIFPGTECLNQLKLIVNVLGTMSEADLEFIDNPKARRYIKSLPYTPGVPLVSMYPHAHPLAIDLLQKMLIFDPTKRISVTEALEHPYMSPLYDPSANPPAQVPIDLDIDENISSEMIREMMWQEMLHYHPEVATAISMS

SEQ ID NO: 1859 - protein, 588 aa, Zea mays
MQAPEQQPQQQQQRRKGSSEMDFFSEYGDANRYKIQEVIGKGSYGVVCSAVDQHTGDKVAIKKIHNIFEHLSDAARILREIKLLRLLRHPDIVEIKHIMLPPSRRDFKDIYVVFELMDTDLHQVIKANDDLTREHHQFFLYQMLRALKYIHTANVYHRDLKPKNILANANCKLKICDFGLARVAFNDTPTTVFWTDYVATRWYRAPELCGSFFSKYSPAIDIWSIGCIFAEILTGKPLFPGKNVVHQLDLMTDLLGTPSLDTVSRIRNEKARRYLSSMRKKQPVPFTEKFPKADPAALKLLQRLLAFDPKDRPTAEEALADPYFKGLAKVEREPSCQPITKMEFEFERKKATKEDVKELIFREILEYHPQLLKDYMNGTEKTNFLYPSAVDHFRRQFANLEENGGKSGAHAASSDRKHVSLPRTTTVHSNPIPPNGTSQVPQKIPTGRPGRVVGPVIPFENAAAVDPYSQRRVSRNPVLPPTTSNMSAYAYHRKSDNSDRELQQELEKDRMQYQPAQRFMDAKVVSQMSPDLRSSYYIPKGVPKADPADRTALHSSMIHGIAPFSGIAAVGGGYNKVNAVQYGVSRMY

SEQ ID NO: 1860 - protein, 491 aa, Zea mays
MDFFTEYGEASQYQIQEVIGKGSYGVVAAAIDSHTGERVAIKKINDIFGNVSDAARILREIKLLRLLRHPNIVQIKHIMLPPTRREFKDIYVVFELMESDLHQVIKANDNLTPEHHRFFLYQLICALKYMHSAHVFHRDLKPRNILANSDSKLKICDFGLARASFNDSLSAIYWTDYVATRWYRAPELCGSFFSSYTPAIDIWSIGCIFAEVLTGTPLFPGRNVVHQLDLITDLLGTPSFRSLSQIHSDKAREYLLGMPRKRPIPFSHKFHNADPLALRLLERLLAFDPKDRPTAEEALADPYFSGLSKLELEPSAQPISKVDFEFEGRKLTKAGVREMIYREILEYHPQMLQEYIEGGDQIHFLYPSGVDRFQRQFAHLEENYRRGVASTPPRRQPTSLPRERVCSSEDGHSQDSDSEEQRAASYVARTTISPPRSQEEGGKLQPAYQSAAAAADSCAKSYLKGAASISSASRRTIKGDNGRKEKESPRL

SEQ ID NO: 1861 - protein, 294 aa, Zea mays
MEQYEKVEKIGEGTYGVVYKALDKATNETIALKKIRLEQEDEGVPSTAIREISLLKEMNHGNIVRLHDVVHSEKRIYLVFEYLDLDLKKFMDSCPEFAKNPTLIKSYLYQILRGVAYCHSHRVLHRDLKPQNLLIDRRNNALKLADFGLARAFGIPVRTFTHEVVTLWYRAPEILLGARQYSTPVDVWSVGCIFAEMVNQKPLFPGDSEIDELFKIFRVLGTPNEQSWPGVSCLPDFKTAFPRWQSQDLAIIVPNLEPAGLDLLSKMLRYEPSKRITARQALEHEYFKDLEMVQ

SEQ ID NO: 1862 - protein, 373 aa, Glycine max
MSAVESAEHNNIRGVPTHGGRYVQYNIYGNLFEVSRKYVPPIRPVGRGAYGIVCAAVNAETGEEVAIKKIGNAFDNRIDAKRTLREIKLLRHMDHANIMSIKDIIRPPQKENFNDVYLVSELMDTDLHQIIRSNQQLTDDHCRYFLYQLLRGLKYVHSANVLHRDLKPSNLLLNANCDLKIADFGLARTTSETDFMTEYVVTRWYRAPELLLNCSEYTAAIDIWSVGCILGEIITRQPLFPGKDYVHQLRLITELIGSPDDASLGFLRSDNARRYVKQLPQYPKQNFSARFPTMSPGAVDLLEKMLIFDPNRRITVDEALSHPYMSPLHDINEEPVCTRPFSFDFEQPSFTEEDIKELIWRESVKFNPATIYV

SEQ ID NO: 1863 - protein, 371 aa, Glycine max
MATPVEPPNGIRTEGKHYYSMWQTLFEFDSKYVPIKPIGRGAYGIVCSSVNRETNEKVAIKKIQNAFENRVDALRTLRELKLLRHLHHENVIALKDIMMPVHRNSFKDVYLVYELMDTDLHQIIKSSQALSNDHCQYFLFQLLRGLKYLHSANILHRDLKPGNLLINANCDLKICDFGLARTNCSKNQFMTEYVVTRWYRAPELLLCCDNYGTSIDVWSVGCIFAELLGRKPIFPGSECLNQLKLIINILGSQREEDIEFIDNPKAKKYIKSLPYSPGSPFSRLYPNAHPLAIDLLAKMLVFDPTKRISVTEALQHPYMAPLYDPNCDPPAVIPIDLDIDEDLGEEMIREMMWKEMLHYHPESAMENAGLC

SEQ ID NO: 1864 - protein, 362 aa, Zea mays
MDPWISSQPSLSLDLRVGLPPLSLHHQAPVAVALPRPKLLVEENFLLPPPKKEPEVRIYTLHSDPMCDASVAALETELQRMGEENRRLAEALAEVASKYEALRGQYTEMVAAAATACGNHPSSTSEGGSVSPSRKRKSESTDTAPPAQQLLHQHYPAVAPDQTECTSGEPCKRIREAECKPRVSKLHVHADPADLSLVVKDGYQWRKYGQKVTKDNPCPRAYFRCSFAPACPVKKKVQRSADDPTILVATYEGDHNHGQPPPQAQAPHDGSSPGASKKPPSPPRPVAAAPAPLHHQQVQQHQQQQAVGAVKCEPPVAAAASELIRRNLAEQMAMTLTRDPSFKAAFVTALSGRLFEMSPTKD

SEQ ID NO: 1865 - protein, 311 aa, Glycine max
MDCSSWINTSLDLNINPRRVHEEVPKEVESELFSLGMTKFNVEEESTSDLEEELKRVTAENKKLAEMLSVVCENYNTLRNHLMECMRKNGEKEVSPTSKKRKSESSNNNSNLMGTNNGNSESSSTDEESCKKPREEIIKAKISRVYVRTEASDTSLIVKDGYQWRKYGQKVTRDNPCPRAYFKCSFAPSCPVKKKVQRSVDDQSVLVATYEGEHNHPQFSSQMEATSGSGRSVTLGSVPCTASLSTSTPTLVTLDLTKSQGSNDSKSTKPKGDSPKVPQVLVEQMATSLTTDPNFRAALVAAISGRLLHNN

SEQ ID NO: 1866 - protein, 572 aa, Saccharomyces cerevisiae
MLSKSEKNVDYMAGNMSNLSFDGHGTPGGTGLFPNQNITKRRTRPAGINDSPSPVKPSFFPYEDTSNMDIDEVSQPDMDVSNSPKKLPPKFYERATSNKTQRVVSVCKMYFLEYYCDMFDYVISRRQRTKQVLEYLQQQSQLPNSDQIKLNEEWSSYLQREHQVLRKRRLKPKNRDFEMITQVGQGGYGQVYLARKKDTKEVCALKILNKKLLFKLNETKHVLTERDILTTTRSEWLVKLLYAFQELQSLYLAMEFVPGGDFRTLLINTRCLKSGHARFYISEMFCAVNALHDLGYTHRDLKPENFLIDAKGHIKLTDFGLAAGTISNERIESMKIRLEKIKDLEFPAFTEKSIEDRRKMYNQLREKEINYANSMVGSPDYMALEVLEGKKYDFTVDYWSLGCMLFESLVGYTPFSGSSTNETYDNLRRWKQTLRRPRQSDGRAAFSDRTWDLITRLIADPINRLRSFEHVKRMSYFADINFSTLRSMIPPFTPQLDSETDAGYFDDFTSEADMAKYADVFKRQDKLTAMVDDSAVSSKLVGFTFRHRNGKQGSSGILFNGLEHSDPFSTFY

SEQ ID NO: 1867 - protein, 564 aa, Saccharomyces cerevisiae
MFSRSDREVDDLAGNMSHLGFYDLNIPKPTSPQAQYRPARKSENGRLTPGLPRSYKPCDSDDQDTFKNRISLNHSPKKLPKDFHERASQSKTQRVVNVCQLYFLDYYCDMFDYVISRRQRTKQVLRYLEQQRSVKNVSNKVLNEEWALYLQREHEVLRKRRLKPKHKDFQILTQVGQGGYGQVYLAKKKDSDEICALKILNKKLLFKLNETNHVLTERDILTTTRSDWLVKLLYAFQDPESLYLAMEFVPGGDFRTLLINTRILKSGHARFYISEMFCAVNALHELGYTHRDLKPENFLIDATGHIKLTDFGLAAGTVSNERIESMKIRLEEVKNLQFPAFTERSIEDRSKIYHNMRKTEINYANSMVGSPDYMALEVLEGKKYDFTVDYWSLGCMLFESLVGYTPFSGSSTNETYENLRYWKKTLRRPRTEDRRAAFSDRTWDLITRLIADPINRVRSFEQVRKMSYFAEINFETLRTSSPPFIPQLDDETDAGYFDDFTNEEDMAKYADVFKRQNKLSAMVDDSAVDSKLVGFTFRHRDGKQGSSGILYNGSEHSDPFSTFY

SEQ ID NO: 1868 - protein, 219 aa, Saccharomyces cerevisiae
MNQAIDFAQASIDSYKKHGILEDVIHDTSFQPSGILAVEYSSSAPVAMGNTLPTEKARSKPQFQFTFNKQMQKSVPQANAYVPQDDDLFTLVMTDPDAPSKTDHKWSEFCHLVECDLKLLNEATHETSGATEFFASEFNTKGSNTLIEYMGPAPPKGSGPHRYVFLLYKQPKGVDSSKFSKIKDRPNWGYGTPATGVGKWAKENNLQLVASNFFYAETK

SEQ ID NO: 1869 - protein, 201 aa, Saccharomyces cerevisiae
MSSAIVAKLNKEDIIKDTVKDLAFEILGELSVSYVDSDDIKLGNPMPMEATQAAPTIKFTPFDKSQLSAEDKLALLMTDPDAPSRTEHKWSEVCHYIITDIPVEYGPGGDIAISGKGVVRNNYIGPGPPKNSGYHRYVFFLCKQPKGADSSTFTKVENIISWGYGTPGAGAYDYIKENNLQLVGANYYMVENTTVDFNYDM

SEQ ID NO: 1870 - protein, 122 aa, Oryza sativa
MAGVWVFKDGIVRRVENPGSEESSSAGDGGGGGRRKVLVHVPSGEVVASYEVLERRLRELGWERYLTDPCLLQFHQRSTVHLISVPRDFSKFKLVHMYDIVVKTRNVFEVRDAAAPAVSPAT

SEQ ID NO: 1871 - protein, 118 aa, Oryza sativa
MAGVWVFEDGMVRRADSEAPSRGRGVGGGGGGGKVLVHVPSSEVVTSYEVLERRLRELGWERYLNDPCLLQFHQRSTVHLISVPRDFSRLKLVHMYDVVVKTRNVFEVRDAATTASPP

SEQ ID NO: 1872 - protein, 114 aa, Zea mays
MSGVWVFRNGVVRLVENPTSGNAAAAPGKRKALLHTPSGEVVTSYASLERKLAALGWERYYAGGGDGGGAGLLQYHKRTSVDLISLPKDFAHFGSVHMYDIVIKNRDAFRVIDA

SEQ ID NO: 1873 - protein, 105 aa, Zea mays
MSGSGAGVWVFKNGVMQLEQPAAASRKALVYVPTNEVVRSVEALERRLGTLGWERYYENRSIVQLHKRDGGADLITIPRDFANLRSTHMYDVVVKNRDHFKVVDA

SEQ ID NO: 1874 - protein, 232 aa, Zea mays
MVRGKTQMKRIENPTSRQVTFSKRRNGLLKKAFELSVLCDAEVALVVFSPRGKLYEFASGSAQKTIERYRTYTKDNVSNKTVQQDIERVKADADGLSKRLEALEAYKRKLLGERLEDCSIEELHSLEVKLEKSLHCIRGRKTELLEEQVRKLKQKEMSLRKSNEDLREKCKKQPPVPMASAPPRAPAVDNVEDGHREPKDDGMDVETELYIGLPGRDYRSSKDKAAVAVRSG

SEQ ID NO: 1875 - protein, 224 aa, Zea mays
MVRGKTELKRIENATSRQVTFSKRRNGLLKKAFELSVLCDAEVGLVVFSPRGKLYEFASAASLQKTIDRYRTYTRENVNNKTVQQDIQQVKADAVSLASRLEALEKTKRMFLGENLEECSIEELHNLEVKLAKSLHVIRGKKTQLLEQQISKLKEKERTLLQDNKELRDKQRNLQSPPEAPPDLNRCVPPWPRSLPAPSNDMDVETELYIGLPGRERSSNRDSD

SEQ ID NO: 1876 - protein, 196 aa, Arabidopsis thaliana
MGRRKIEIKRIENKSSRQVTFSKRRNGLIDKARQLSILCESSVAVVVVSASGKLYDSSSGDDISKIIDRYEIQHADELRALDLEEKIQNYLPHKELLETVQSKLEEPNVDNVSVDSLISLEEQLETALSVSRARKAELMMEYIESLKEKEKLLREENQVLASQMGKNTLLATDDERGMFPGSSSGNKIPETLPLLN

SEQ ID NO: 1877 - protein, 228 aa, Arabidopsis thaliana
MGRGKIVIQRIDDSTSRQVTFSKRRKGLIKKAKELAILCDAEVGLIIFSSTGKLYDFASSSMKSVIDRYNKSKIEQQQLLNPASEVKFWQREAAVLRQELHALQENHRQMMGEQLNGLSVNELNSLENQIEISLRGIRMRKEQLLTQEIQELSQKRNLIHQENLDLSRKVQRIHQENVELYKKAYMANTNGFTHREVAVADDESHTQIRLQLSQPEHSDYDTPPRANE

SEQ ID NO: 1878 - protein, 174 aa, Arabidopsis thaliana
MEGKRSQGQGYMKKKSYLVEEDMETDTDEEEEVGRDRVRGSRGSINRGGSLRLCQVDRCTADMKEAKLYHRRHKVCEVHAKASSVFLSGLNQRFCQQCSRFHDLQEFDEAKRSCRRRLAGHNERRRKSSGESTYGEGSGRRGINGQVVMQNQERSRVEMTLPMPNSSFKRPQIR

SEQ ID NO: 1879 - protein, 173 aa, Zea mays
MQRGDPLVVGRIIGDVVDPFVRRVPLRVAYAAREVSNGCELRPSAIADQPRVEVGGPDMRTFYTLVMVDPDAPSPSDPNLREYLHWLVTDIPATTGVSFGTEVVCYESPRPVLGIHRVVFLLFQQLGRQTVYAPGWRQNFSTRDFAELYNLGLPVAAVYFNCQRESGTGGRRM

SEQ ID NO: 1880 - protein, 177 aa, Zea mays
MFNMSRDPLVVGNVVGDIVDPFITTASLRVFYNNKEMTNGSELKPSQVMNEPRVHVGGRDMRTLYTLVMVDPDAPSPSNPTKRENLHWLVTDIPETTDASFGNEIVPYESPRPIAGIHRFAFVLFRQSVRQTTYAPGWRSNFNTRDFAAIYGLGSPVAAVYFNCQRENGCGGRRYIR

SEQ ID NO: 1881 - protein, 187 aa, Zea mays
MANDSLTRGHIIGDVLDPFTSSVSLSVLYDGRPVFDGMEFRASAVSVKPRVEIGGDDFRVAYTLVMVDPDAPNPSNPSLREYLHWMVTDIPASTDDSFGRELIPYESPSPTMGIHRLVLVLYQQLGRGTVFAPQVRQNFNLRNFARRFNLGKPVAATYFNCQRQTGTGGRRFTCVFDHVVQGEGRQA

SEQ ID NO: 1882 - protein, 389 aa, Oryza sativa
MDPNDAFSAAHPFRWDLGPPAPAPVPPPPPPPPPPPPANVPRELEELVAGYGVRMSTVARISELGFTASTLLAMTERELDDMMAALAGLFRWDLLLGERFGLRAALRAERGRLMSLGGRHHGHQSGSTVDGASQEVLSDEHDMAGSGGMGDDDNGRRMVTGKKQAKKGSAARKGKKARRKKVDDLRLDMQEDEMDCCDEDGGGGSESTESSAGGGGGERQREHPFVVTEPGEVARAKKNGLDYLFHLYEQCRLFLLQVQSMAKLHGHKSPTKVTNQVFRYAKKVGASYINKPKMRHYVHCYALHCLDEEASDALRRAYKARGENVGAWRQACYAPLVDISARHGFDIDAVFAAHPRLAIWYVPTRLRQLCHQARSSHAAAAAALPPPLF

SEQ ID NO: 1883 - protein, 278 aa, Zea mays
MGRSEGSTSPAAGGAACACAVCGGAAVVYCAADAAALCSPCDTAVHAANLLASRHERVPLSMVTAASGVYDDDLFAPDDIDAASSWASAPAQGQGSPQNGSSSASFTTGDSGAEGRGLFDLLSDVDFAACVTGGGGYLPDGVAPVVHHGAAPLWAQPGLAAAAWTATWSPAVVVPGAAVVAAAAAEREARVQRYREKRERRKFQKTIRYASRKAYAEARPRIKGRFVKRAAGTSSSSSSGAGTSDSIDAAAKFWLSFSDDARDGFFVDAGAYGVVPSF

SEQ ID NO: 1884 - protein, 424 aa, Arabidopsis thaliana
MDPEGFTSGLFRWNPTRALVQAPPPVPPPLQQQPVTPQTAAFGMRLGGLEGLFGPYGIRFYTAAKIAELGFTASTLVGMKDEELEEMMNSLSHIFRWELLVGERYGIKAAVRAERRRLQEEEEEESSRRRHLLLSAAGDSGTHHALDALSQEDDWTGLSEEPVQQQDQTDAAGNNGGGGSGYWDAGQGKMKKQQQQRRRKKPMLTSVETDEDVNEGEDDDGMDNGNGGSGLGTERQREHPFIVTEPGEVARGKKNGLDYLFHLYEQCREFLLQVQTIAKDRGEKCPTKVTNQVFRYAKKSGASYINKPKMRHYVHCYALHCLDEEASNALRRAFKERGENVGSWRQACYKPLVNIACRHGWDIDAVFNAHPRLSIWYVPTKLRQLCHLERNNAVAAAAALVGGISCTGSSTSGRGGCGGDDLRF

SEQ ID NO: 1885 - protein, 186 aa, Zea mays
MAPKRSSEERAAAEQEQPRLRGVRKRPWGRYAAEIRDPVRKARVWLGTFDTPEQAARAYDAAARRLRGPRATTNYPGDVVREAPCTAPALAASASGSTESSSSSSSRDDGHPPPPLPTAPSSLGLGLGLFPATVATQPCLFLDPAPVEREEGERERSCCSRSPPSVLAGLGFDFDLNLPPPAEMVM

SEQ ID NO: 1886 - protein, 139 aa, Arabidopsis thaliana
MESSNRSSNNQSQDDKQARFRGVRRRPWGKFAAEIRDPSRNGARLWLGTFETAEEAARAYDRAAFNLRGHLAILNFPNEYYPRMDDYSLRPPYASSSSSSSSGSTSTNVSRQNQREVFEFEYLDDKVLEELLDSEERKR

SEQ ID NO: 1887 - protein, 124 aa, Glycine max
MEDLKEKVNEGEPTQIKYRGVRRRPWGKFAAEIRDSARHGARVWLGTFNTAEEAARAYDRAAFEMRGATAILNFPDEHPPCNVTSLSKKSSSSNTEIGKQVVVFECLDDKLLEELLDCDGENHQ

SEQ ID NO: 1888 - protein, 138 aa, Glycine max
MEEESKEKKKDTKEEPRYRGVRRRPWGKFAAEIRDPARHGARVWLGTFLTAEEAARAYDRAAYEMRGALAVLNFPNEYPSCSSMNSSSTLAPSSSSSNSMLKSDHGKQVIEFECLDDKLLEDLLDCDDYAYEKDLPKN

SEQ ID NO: 1889 - protein, 131 aa, Zea mays
MEDDKKEGKYRGVRKRPWGKFAAEIRDPERGGSRVWLGTFDTAEEAARAYDRAAFTMKGATAVLNFPTSGGSAAAAPGGRTSGGGSSSSTTSSAPASRGRARVPDSEKVELECLDDRVLEELLAEDKYNKN

SEQ ID NO: 1890 - protein, 562 aa, Saccharomyces cerevisiae
MTAVASTSGKQDADHNQSIECPRFSRGQKEILLDHEDAKGKDSIINSPVSGRQSISPTLSNATTTTTKSIMNATGTSGAVVSNTPEPGLKRVPAVTFSDLKQQQKQDSLTQLKNDSERTKSPNSNPAPVSNSIPGNHAVIPNHTNTSRTTQLSGSPLVNEMKDYDPKKKDSALKIVDTMKPDKIMATSTPISRENNKVTAKAPTSITLRKEDAQDQANNVSGQINVRSTPEETPVKQSVIPSIIPKRENSKNLDPRLPQDDGKLHVLFGATGSLSVFKIKPMIKKLEEIYGRDRISIQVILTQSATQFFEQRYTKKIIKSSEKLNKMSQYESTPATPVTPTPGQCNMAQVVELPPHIQLWTDQDEWDAWKQRTDPVLHIELRRWADILVVAPLTANTLSKIALGLCDNLLTSVIRAWNPSYPILLAPSMVSSTFNSMMTKKQLQTIKEEMSWVTVFKPSEKVMDINGDIGLGGMMDWNEIVNKIVMKLGGYPKNNEEEDDDEDEEEDDDEEEDTEDKNENNNDDDDDDDDDDDDDDDDDDDDDDDDEDEDEAETPGIIDKHQ

SEQ ID NO: 1891 - protein, 229 aa, Saccharomyces cerevisiae
MGGILKNPLALSPEQLAQQDPETLEEFRRQVYENTQKNAKLTSHKRNIPGLDNTKEEGEIIGTSSTFLPKDTLSLKHEQDMLAKMTPEERVQWNQRNLAENEITKKQFQDIHIDEPKTPYQGAVDPHGEYYRVDDDEDEDNSDKKPCQVANDDIDDLSLGEPEFEIKENKQPDFETNDENDEDSPEARHKKFEEMRKKHYDVRAIFNKKSREALKDEDEDEDDSTTKEP

SEQ ID NO: 1892 - protein, 212 aa, Zea mays
MAAHQDSAAAGGRPPRRPRVLLAASGSVAAIKFEVLCRSVAEWADVQAVATASALEFIDVASFPGGVPLYTDDQEWSSWKRVGDKVLHIELRRWADVLVIAPLSANTLAKVAGGLCDNLLTCVVRAWDYSKPVYVAPAMNTFMWDNPLPRATSPSCATSACPSSRRSMARWRSRRRSARPSCSSSVRNIFSSRQAPQFFAPLCMMRCVPCLT

SEQ ID NO: 1893 - protein, 215 aa, Zea mays
MAAHQDSAASGSGPPRCPRVLLAASGSVAAIKFEVLCRSVAEWADVHAVATASALEFIDVASFPGGVPLYTDDQEWSSWKRVGDKVLHIELRRWADVLVIAPLSANTLAKVRRTHASWSSRSPSPVAADNSACCQVAGGLCDNLLTCVVRAWDYSKPVYVAPAMNTFMWGNPFTARHLAVLRDLGMSVVPPVNGAMAEPSEICKTLMLFFGPQHL

SEQ ID NO: 1894 - protein, 165 aa, Zea mays
MSSHRVKWNEDNLYEIESNKPVRQKITEPKTPYHPMIDDDGSLSPTRPFDKCLDETVQAEAILTALNGVASSSISISKDDGWGSSDDDTDAIDQDADPEADTTRLSFKEHRRAHYDEYRKVKELMRTGSLTAEEADEDNRAATSSEDKGVGKGGPNDNMKPSPQT

SEQ ID NO: 1895 - protein, 176 aa, Zea mays
MKGRVRWDEANIGEIEANKPVRQKITEPKTPYHPMIDDDSSLSPVRGSFDACIDNENRAEAIWSALNDVASSSRRGTGQSGGWTSSEDEPEAMEQDDDDSETDRNLSFKEHRKAHYDEFLKVKELQETGSLEDESDEDHNSQPSKAEKCESSSLSHSVKEMVIEGKKSSTPPANGS

SEQ ID NO: 1896 - protein, 475 aa, Glycine max
MMALNISSPAEVKSIFFADYFKSNCITAKFTGGFAFKRKERGAASGGRVCCSVLAPPPPPAWPGRAVPEQGSKTWDGPKPISIVGCTGSIGTQTLDIVAENPDKFKVVALAAGSNVTVLADQVKRFKPQLVAVRNESLIAELKEALHDVEEKPEIIPGEQGIIEVARHPDAVSVVTGIVGCAGLKPTVAAIEAGKYIALANKETLIAGGPFVLPLAQKHNVKILPADSEHSAIFQCIQGLPEGALRRVILTASGGAFRDWPVDKLKDVKVADALKHPNWNMGKKITVDSATLFNKGLEVIEAHYLFGADYDHIEIVIHPQSIIHSMIETQDSSVLAQLGWPDMRLPILYTLSWPDRIYCSEDTWPCLDLCKIGSLTFKTPDNVKYPSMNLAYAAGRAGGTMTGVLSAANEKAVEMFIDEKISYLDIFKVVELTCEKHQNELLSSPSLEEIIHYDLWAREFAASLQDSSSFTPILA

SEQ ID NO: 1897 - protein, 394 aa, Synechocystis sp. PCC 6803
MVKRISILGSTGSIGTQTLDIVTHHPDAFQVVGLAAGGNVALLAQQVAEFRPEIVAIRQAEKLEDLKAAVAELTDYQPMYVVGEEGVVEVARYGDAESVVTGIVGCAGLLPTMAAIAAGKDIALANKETLIAGAPVVLPLVEKMGVKLLPADSEHSAIFQCLQGVPEGGLRRIILTASGGAFRDLPVERLPFVTVQDALKHPNWSMGQKITIDSATLMNKGLEVIEAHYLFGLDYDHIDIVIHPQSIIHSLIEVQDTSVLAQLGWPDMRLPLLYALSWPERIYTDWEPLDLVKAGSLSFREPDHDKYPCMQLAYGAGRAGGAMPAVLNAANEQAVALFLQEKISFLDIPRLIEKTCDLYVGQNTASPDLETILAADQWARRTVLENSACVATRP

SEQ ID NO: 1898 - protein, 397 aa, Agrobacterium tumefaciens
MTNASEMPRKLTILGSTGSIGTNTLDVVRQLGGRDGFEIMALTGAGNIALLAEQAREFGAQLAVTADDDKYEALKSALAGTGIKVAAGMAGLEEAASMDAGWVMAAIAGTPGLAPTLTAARRGADIALANKECLVSAGDVFLRTVKQGGGRLIPVDSEHSAIFQCLTGEYKQAVERIVLTASGGPFRTWSRDEMSNVTADIARAHPNWSMGLKVSIGSASMFNKGLEMIEAKYLFDLRPDQVDVIVHPQSIIHSMVGYTDGSYIAQLGSPDMRTAISYALTYPERGNLSVERLDFAKLARLDFEAPDEARFPALRLARMALERGGLQGAALNAAEETAFHAFVAGGIGFLDMAEIVETVMDRMHDGRTAETMDDVFSADEEARRHALELIATKEKAA

SEQ ID NO: 1899 - protein, 719 aa, Zea mays
MALSTFSVPRGFLGVPAQDSHFASAVELHVNKLLQARPINLKPRRRPACVSASLSSEREAEYYSQRPPTPLLDTINYPVHMKNLSVKELRQLADELRSDVIFHVSKTGGHLGSSLGVVELTVALHYVFNAPQDRILWDVGHQSYPHKILTGRRDKMPTMRQTNGLAGFTKRAESEYDSFGTGHSSTTISAALGMAVGRDLKGGKNNVVAVIGDGAMTAGQAYEAMNNAGYLDSDMIVILNDNKQVSLPTATLDGPVPPVGALSSALSKLQSSRPLRELREVAKGVTKQIGGSVHELAAKVDEYARGMISGPGSSLFEELGLYYIGPVDGHNIDDLITILNDVKSTKTTGPVLIHVVTEKGRGYPYAERAADKYHGVAKFDPATGKQFKSPAKTLSYTNYFAEALIAEAEQDSKIVAIHAAMGGGTGLNYFLRRFPSRCFDVGIAEQHAVTFAAGLACEGLKPFCAIYSSFLQRGYDQVVHDVDLQKLPVRFAMDRAGLVGADGPTHCGAFDVAYMACLPNMVVMAPSDEAELCHMVATAAAIDDRPSCFRYPRGNGVGVPLPPNYKGTPLEVGKGRILLEGDRVALLGYGSAVQYCLTAASLVQRHGLKVTVADARFCKPLDHALIRSLAKSHEVLITVEEGSIGGFGSHVAQFMALDGLLDGKLKWRPLVLPDRYIDHGSPADQLAEAGLTPSHIAASVFNILGQNREALAIMAVPNA

SEQ ID NO: 1900 - protein, 639 aa, Agrobacterium tumefaciens
MTGMPQTPLLDRVNFPSDLKEIDDRDLPELARELRDEMIDAVSKTGGHLGAGLGVVELTIAIHKVFNTPEDRLIFDVGHQCYPHKILTGRRDRIRTLRQEDGLSGFTRRAESEYDDFGAGHSSTSISAGLGMAVAAGLDGSDRKVIAVIGDGSMSAGMAFEALNNAGALDARLIVILNDNDMSIAPPTGAMSAYLARLASGRTYMGFRDFGKKLTAYLGKTIDRAITRAVTHARGYVTGGTLFEELGFYHIGPIDGHSFDHLLPVLRNVRDNQKGPVLIHVVTQKGKGYAPAEAAADKYHGVNKFDVITGAQAKAKPNAPSYTSVFAEALIQEATLDEKIIGVTAAMPNGTGLDKMAELFPSRTFDVGIAEQHAVTFAAGLAADGYKPFCALYSTFLQRGYDQLVHDVAIQSLPVRFPIDRAGFVGADGPTHAGSFDTTFLATLPGMVVMAAADEAELKHMVRTAAAYDEGPISFRYPRGEGVGVEMPARGEILQIGKGRIIKEGTKVALLSFGTRLAECLAAAEDLDAAGLSTTVADARFAKPLDLDLIRQLAAHHEVLVTIEEGSVGGFGAHVLHFMASAGLLDHGPKVRTLTLPDQWVEQAKPETMYANAGLDRAGIVSTVFNALGQRQAGVGFAG

SEQ ID NO: 1901 - protein, 670 aa, Xylella fastidiosa
MRIRSVINVIFMLHRIACSGPLWGGQWCFRCNAKTMIDSTCYPRLSRIQIPEDLRTFQESELRAVADELRNYLIESVGLSGGHFAAGLGVVELTIALHYLYCTPIDHLVWDVGHQTYPHKILTGRRDKISTVKHQGGLAPFPKREESIYDTFGVGHSSTSISAALGMAIVAQRHGDERKVVAIIGDGAMTAGMAYEALNHAGGMSPAPNLLVILNDNRMSISEAVGGLTKMLGRATGSKALNAIREGGKRIFGDKKTNATARFLRRWEEHWKGMFVPSTLFEEMGFHYTGPIDGHDLPALLGALKTLRTLKGPQLLHVITTKGKGYELAEGDQIGYHAVAPFDPQKGLIKAGAKKQTYTDVFSEWLCDMAAVEPRLLAITPAMREGSGLVRFSQEYPQRYFDVAIAEQHAITLAAGMATQGAKPVVAIYSTFLQRGYDQLVHDVALQKLDVLFAVDRGGVVGPDGATHAGNLDLSFLRCVPNMMLMAPADEAECRKMLSTGFHYSGPVAVRYPRGTGPGVVPSAELDVLPVGVAQLRHSGTRIALLGFGVCVAPAEQVGRRLGLTVVNMRFIKPLDRTLLLELARTHEGFVTIEDNVVAGGAGSGVAELLNAEGIVLPIVHLGLPDAFQQHASREDLLAEAGIDAAGVYAALLSRWPDLAVQNHPLSAVS

SEQ ID NO: 1902 - protein, 619 aa, Zea mays
MPKHYRPAGKKKEGNAAKYITRTKAVNYLQVSLAIFRKLCILKGVFPRQPKKKVEGNHKTYYHTKDIAFLAHDPLIEKFREIKVHRRKVKKAVAKKNRDLADRLLNRPPTYKLDRLVLERYPTFVDALRDLDDCLTMVHLFAALPAVDGERVEVKRIHNCRRLSHEWQAYISRTHSLRKTFISVKGIYYQAEVQGQKITWLTPHALQQVLTDDVDFNVMLSFLEFYETLLGFVNFKLYHSINVNYPPILDPRLEALAAELYALCRYMSAGSRRMIGNSQTDEVMEDKDEKSKAEEVIKEEKVVKNKASSKADESELRLAQLQHQLPTNEPGALMNLVEESTADDADDDDTKDCKGLFKNLKFYLSREVPRESLLFIIPAFGGTVSWEGEGAPFKEIDEDITHQIVDRPTQSHVFLSRDYVQPQWVFDCVNARIILPTEGYLVGRVPPPHLSPFVDNDAEGYMPEYAETIKRLQAAARNEVLPLPGIGDEDLDNSLVAAMMDRTASNEAAEKKRKLEMLEKQYIDELKKEIDGVAFSSLSNKEADKSPNAKDDTQSDREEDASKQEEDDDDDIGTALMSRKQRGLYKAMKMGKEKKKEKVELLKKRKKNADSGASSKKRH

SEQ ID NO: 1903 - protein, 605 aa, Saccharomyces cerevisiae
MRIKKKNTRGNARNFITRSQAVRKLQVSLADFRRLCIFKGIYPREPRNKKKANKGSTAPTTFYYAKDIQYLMHEPVLAKFREHKTFARKLTRALGRGEVSSAKRLEENRDSYTLDHIIKERYPSFPDAIRDIDDALNMLFLFSNLPSTNQVSSKIINDAQKICNQWLAYVAKERLVRKVFVSIKGVYYQANIKGEEVRWLVPFKFPENIPSDVDFRIMLTFLEFYSTLLHFVLYKLYTDSGLIYPPKLDLKKDKIISGLSSYILESRQEDSLLKLDPTEIEEDVKVESLDASTLKSALNADEANTDETEKEEEQEKKQEKEQEKEQNEETELDTFEDNNKNKGDILIQPSKYDSPVASLFSAFVFYVSREVPIDILEFLILSCGGNVISEAAMDQIENKKDIDMSKVTHQIVDRPVLKNKVAGRTYIQPQWIFDCINKGELVPANKYLPGEALPPHLSPWGDAIGYDPTAPVEEGEEEESESESESEDQVEEEDQEVVAGEEDDDDDEELQAQKELELEAQGIKYSETSEADKDVNKSKNKKRKVDEEEEEKKLKMIMMSNKQKKLYKKMKYSNAKKEEQAENLKKKKKQIAKQKAKLNKLDSKK

SEQ ID NO: 1904 - protein, 586 aa, Zea mays
MGSYAYKYCMCFTRKFRSPDAQPPPDVRAAHLSFASDAHALRRFVAGVQGESPADVDRILAMLSGGHSHGIARLVTRSPAASTPTLEDFFAFLFSPDLNPPIAHQVHQDMSAPFSHYFVFTGHNSYLTGNQLNSDSSDVPIVKALQRGVRVIELDMWPNPSKDNVDILHGGTLTAPVEMIKCLKSIKEYAFCASNYPLVITLEDHLTSDLQAKVATMLTETFGDLLFVPNPDPMKEFPSPASLMKRIIISTKPPQEYKEFLKAENNRSGSGNIAELPDQGSLRRIDSNADESDGKDELDEQDEEDSDEDDPKFQQDTACEYRKLITIQAGKPKGHLRDALKVDPDKVRRLSLSETQLAKATISHGAEVIRFTQKNILRVYPKGTRVNSSNYDPMNAWTHGAQMVAFNMQGHDKALRLMQGFFRANGGCGYVKKPDFLLRTGPNGEVFDPKASLPVKKTLKVKVYMGDGWRMDFSKTHFDAFSPPDFYTRVGIAGVKADSVMKKTRVIEDQWVPMWDEEFTFLLTVPELALLRVEVQEYDMSEKHDFGGQTVLPVWELKQGIRAVPLHDRKGVRYKSVRLLMRFDFV

SEQ ID NO: 1905 - protein, 714 aa, Zea mays
MLHPSWVGVSAHVSEYWSVIIATVVFAFVGAVTIYYTVNQLNKNISLSLIRAIKARAKRYKKSKDKVPAASHIWRKEVVSRSKGLKCCVCLKSVSPPQYSGGTIHQCDICGAAAHPSCSGNAHKDCKCVSMAGLGHVLHQWAVQWIDSADHSEEDSFCCHCDESCNGAFLAGSPVWYCMWCQRLVHVDCHSSLAKETGDICDLGPLKRLILSPLCVKELHWTGAGILSSITNGANELASSVRETIRIRSKRYKRGSASADSDSSGAIELPSDAEGDSQEVNSKAKVRDDHANCKLNEVHQSSESEKDKQLVPDNAATTNMSDVQRENSHVQNNQKYEIINVPSDSRPLLVFINKRSGAQSGDSLRQRLQILLNPVQVFELSKQQGPDVGLALFRKVTHFRVLVCGGDGTAGWVLDAIEKQKFETPPPVAILPAGTGNDLARVLCWGGGLGVIEKRGGLFSVLQDVEHAAVTVLDRWKITIKDNQGKLMRPPKFMNNYFGVGCDAKVALDIHNLREENPERFYSQFMNKVLYAREGAKNIMDNTFDCFPWDVKLEIDGSKIDIPQDSEGILVANIRSYMGGVDLWKNEDDVSDTYLPQSMHDKKLEVVSFTGMLHLGKLQVGLSRAKRLAQGHHIKVEVSTTMPIQVDGEPWSQEPGTIEVSHHSQAFMLKRVSEEPLGHAASVMADILENAESSGIISALQKRTLLQEIASRLL

SEQ ID NO: 1906 - protein, 578 aa, Zea mays
MSNHNAPCDIPKPASVDEFLAKNGKKKKSFMSGLFRKKGRGADKKLLSRRDIVFDLEGRSGDRMDLLETSAAVRKSFSDRHCTTRIENLTLSCLDSPRRPNVDTREYRVFVGTWNVGGKPPDSSVNLQEFLQIEGLPDIYVLGFQEIVPLNAGNVLVVEDNEPAGKWMDLIYQALNRPPPHQDGQSSGDELSPPPSTSSSHYPSRPQGAARDPSNAAAIPKTSSGGMLCAQKPPPPLKMVSKCYRVDNALVKTCTCMSDPSTMQLRAREMREFLCRVEAAAASPGRGADDDALASIEGGDQRGGGGGMNYCLVARKQMVGIFLSVWVRRELVQYVGHLRVDCIGRGIMGRLGNKGCIAMSMTLHHTSICFVCCHLASGEKEGDEVRRNSDVAEILKNAQFPRICKVPGQRVPEKIIDHDRIIWLGDLNYRVSLSYEETKTLLEDNEWDILLEKDQLAMERQAGRVFKGWKEGKIYFAPTYKYKQNSDSYLWETAKSKKKRRTPAWCDRILWHGQGIEQLQYIRGEFRLSDHRPVCSVFVIEADVDSGSKIRKGYSTLDARIHCESPEIPKRHSFYDDF

SEQ ID NO: 1907 - protein, 285 aa, Glycine max; identical to SEQ ID NO: 1257

SEQ ID NO: 1908 - protein, 175 aa, Glycine max
MKREREVDSLTMANCLMLLSRGSEFEATYSSTSMSNRVFECKTCNRQFPSFQALGGHRASHKKPRLMAGDIEGQLLHDSPPKPKTHECSICGLEFAIGQALGGHMRRHRAANLNGNVHNSTATSSSSGGSSFDSSPKKKADNKRVLVLDLNLTPFENDLEFLKIGKPTTFVDYLY

SEQ ID NO: 1909 - protein, 324 aa, Glycine max
MERSGGMVTGSHERNELVRVRHGSDSRSKPLKNLNGQSCQICGDTIGLTATGDVFVACHECGFPLCHSCYEYELKHMSQSCPQCKTAFTSHQEGAEVEGDDDDEDDADDLDNEINYGQGNSSKAGMLWEEDADLSSSSGHDSQIPNPHLANGQPMSGEFPCATSDAQSMQTTSIGQSEKVHSLSYADPKQPGPESDEEIRRVPEIGGESAGTSASQPDAGSNAGTERVQGTGEGQKKRGRSPADKESKRLKRLLRNRVSAQQARERKKAYLIDLETRVKDLEKKNSELKERLSTLQNENQMLRQILKNTTASRRGSNNGTNNAE

SEQ ID NO: 1910 - protein, 206 aa, Zea mays
MRTICDVCESAPAVLFCAADEAALCRPCDEKVHMCNKLASRHVRVGLADPNKLVRCDICENSPAFFYCEIDGTSLCLSCDMTVHVGGKRTHGRYLLLRQRVEFPGDKPGHMDDVPMEIQDPENQRDQKKPPKEQTANHHNGDDPATDGNCDDQGNIDSKMIDLNMRPVRTHGQESNSQTQGVGLSVNNHDSPGVVPTSNSERDTSK

SEQ ID NO: 1911 - protein, 234 aa, Glycine max
MFTLNHSSDLYHVSPELSSSLDTSSPASEGSRGVAFSDEEVRLAVRHPKKRAGRKKFRETRHPVYRGVRRRNSDKWVCEVREPNKKTRIWLGTFPTPEMAARAHDVAAMALRGRYACLNFADSAWRLPVPATAEAKDIQKAAAEAAQAFRPDQTLKNANTRQECVEAVAVAVAETTTATAQGVFYMEEEEQVLDMPELLRNMVLMSPTHCLGYEYEDADLDAQDAEVSLWNFSI

SEQ ID NO: 1912 - protein, 678 aa, Glycine max
MQATQGEQSNNASAVHWERFLPRMVLRVLLVEADDSTRQIIAALLRKCGYKVVAFCDGLKAWETLKNKAFDLDLILTEVDLPSISGFSLLTLIMEHDICKNIPVIMMSSHDSVSMVFKCMLKGAADFLIKPVRKNELRNLWQHVWRRHAISRPPQNLTLPEIELGFAAENHAASNDSSGSVASTPKDDECSEKTSEAHSTCPSPFLEAESTYMENMQDILQLKSSSNLSNIDTVKHENSTKCERESDKHNDEAGEKSLFILEDARCNKTFKPTGLRLGQSYECHETRNQDEVLRIELIKSNPEINTDIHRCSDELVDPSTGAIDLIATFKNLPKSTDEKCSFSSGNTAKFDFDTQLELSLRRDFPGSSCKAAFKERQILNHSNASAFSRYSNSKLLQPLFPTPSTISAKLTNASQNSHESLKLSKNTSTSHQYSEKSQNQEEKIITSVIGQSGQVDPKLPNSQLGLFPATGVTSDHKSKGNGNVFPSKLYAKSGVHPISTPKSVCQKESSPFPTSTSSQSNPQSHNSERHHWLEDATHASDQNVNDQSNLECETHDSPAASQSAGPSFFHDTANHNSSGVYRSDGNATSAKVAKESHEIFIDSGQRSYDGFIGTDSHRTSQREAALTKFRLKRKDRCYEKKVRYQSRKRLAEQRPRVKGQFVRQVHDDHPVADVGGGS

SEQ ID NO: 1913 - protein, 374 aa, Glycine max
MGIERGGFKGFRSAWSVPPKPCDSCKLASAALFCRPDSAFLCIACDSNIHCSNKLASRHERVWMCEVCEQAPAAVTCKADAAALCVTCDSDIHSANPLAQRHERVPVEPFFDSAESIVKASAAATFGFIVPSDDGGASDAFAPDDSDAAAWLIPNPNFGSKLMDAPEIKSKEIFFSEMDPFLDFDYSNSFQNNNSAGNDSVVPVQKPSLAPPLINNHHHHQSETCFDVDFCRSKLSSFNYPSNSLSQSVSSSSLDVGVVPDGNTVSDMSYSFGRNSSDSSGIVVVSGNSVGQGATQLCGMDREARVLRYREKRKNRKFEKTIRYASRKAYAETRPRIKGRFAKRTEIDSDVERLYSPGPAVLMLDTPYGVVPSF

SEQ ID NO: 1914 - protein, 580 aa, Glycine max
MATPNPTRFSLAMERTGQWVFSPEIPTDVIVAVGQTNFSLHKFILAAKSNYVRKVIMESEESDLTRIEISDIPGGSEAFEKAAKFCYGVNFEITVHNVAALHCAAVFLQMTDEYCDGNLAGRTEDFLSQVGLSTLHSAVAVLKSCQKILPFAAEVNVVDRCVEVISCKACNEANFPSQSPPNWWTEELAVLDVDSFAKVIAAMKQRGAKYLTVAGALITYTERALRELVRDHSGGGRGIRSPESGDSDSESKRSEQRELLQAIVPLFPTEKAAFPINFLCCLLRCAIYLRASSACKRELEKRVTEILEHVTVDDLLVLTFSYDGERLLDLDSVRRIISGFVEREKGTTVFNAGVNFNEDFSAAMQRVAKTVDSYLAEIAAYAELSISKFNGIAILIPKGARKSDDDLYRAVDIYLKVHPNLDEIEKEKVCSVLDTLKLSYEARVHASKNKRLPLQIVLHALYYDQLQIRSGTAADKQAVVAAAEKKQLQADVSLVRENEELRSELMKMKMFISDLQKNVHGTSSSGRENIGPTKKPTFFSSMSKKLSKLNPFKNGSKDTSHIDDAPVDLTKPRKRRFSIS

SEQ ID NO: 1915 - protein, 356 aa, Zea mays; identical to SEQ ID NO: 1577

SEQ ID NO: 1916 - protein, 248 aa, Arabidopsis thaliana
MKIQCDVCEKAPATVICCADEAALCPQCDIEIHAANKLASKHQRLHLNSLSTKFPRCDICQEKAAFIFCVEDRALLCRDCDESIHVANSRSANHQRFLATGIKVALTSTICSKEIEKNQPEPSNNQQKANQIPAKSTSQQQQQPSSATPLPWAVDDFFHFSDIESTDKKGQLDLGAGELDWFSDMGFFGDQINDKALPAAEVPELSVSHLGHVHSYKPMKSNVSHKKPRFETRYDDDDEEHFIVPDLG

SEQ ID NO: 1917 - protein, 486 aa, Glycine max
MLDLNLNAEWTDSFSNGESPLPLEKFPDGLRNQMAESGTSNSSVVNADGSSNGGGDEDSDSTRAADDVYTTFNFDILKVEGANGFVTKELFPVMSEGAKGHATSSFSGTNGFVDLSFDGDGGNTSEMKMLQPQNQNQTQTRTQTQQPAKKSRRGPRSRSSQYRGVTFYRRTGRWESHIWDCGKQVYLGGFDTAHAAARAYDRAAIKFRGVDADINFNLSDYEDDLKQMQNLSKEEFVHILRRQSTGFSRGSSKYRGVTLHKCGRWEARMGQFLGKKYIYLGLFDSEVEAARAYDKAAIKCNGREAVTNFEPSTYEGELKSAAINEGGSQNLDLNLGIATPGPPKENWGQLQFPSFPYNTHGGRSSMMETNVSSGIGNPSLKRMVATEDRPSLWNGMSPNFFPNGERAERIGVDPSNGLPNWAWQTHGQVNATPVPTFSAAASSGFSISATFPSAAIFPTSSMNSIPQSLCFTSSSMPTRNASEYYY

SEQ ID NO: 1918 - protein, 750 aa, Glycine max
MDAYSSGEEVVVKTRKPYTITKQRERWTEEEHNRFLEALKLHGRAWQRIEEHIGTKTAVQIRSHAQKFFTKLEKEALVKGVPIGQALDIDIPPPRPKRKPNNPYPRKTRIGTTSLHSGAKDGKLNLVESSHVNQALDLKKEPLPEKHDLDEGLTTVKENKDENHAKVFTLLQEVPCSSVSSANESSITMSVPLGNPCAFKEITPSVKEVIARDEKTESFVTVEPENGKLEINDGKQTNGTSKDSRLEDSDALHMKLVQNEKPDGLDCELTIDGMQGNQNYPRHVTVHVVDGNLGTNTQNPSQDMLFRDSMFQPIGGVNGQRNVFTNTAPSNTSESQNNTARSSVHQSFLPYPPFTQHNQDDYQSFLHMSSTFSNLIVSTLMQNPAAHAAASFAATFWPYANPETSANSPRCSQGGFTNRQIGSPPSVAAIAAATVAAATAWWAAHGLLPLCAPLHTSFACPASVTTVPSMNTGEAPALKAEQEKTTLQNPPLQDQMLDPEYSEAQQAQHSASKSPAAILSDSESGDAKLNTSSKVTDHETNKTISEHLDSNKTKGRKPVDRSSCGSNTASSSDVETDALEKGEKGKEEPEIPDANQLAIEFSNRRRSVSNLTDSWKEVSEEGRLAFQALFSREVLPQSFSPPHALKNTDHQMDNANDNKQNIDDKDEDLDGSKKCSSNYEAMQKNLLFVENNEGLLTIGLGQGKLKTHRTGFKPYKRCSMEAKENRVGASSNQGEEQGCKRIRLEGETST

SEQ ID NO: 1919 - protein, 426 aa, Glycine max
MEFDAAIPVSREHLPQDAMWQINLRSSETMESEPYPEHPGEPDCSYYIRTGLCRFGATCRFNHPPNRKLAIAAARMKGEFPERIGQPECQYYLKTGTCKFGATCRFHHPRDKAGIAGRVALNILGYPLRPNEPECGYYLRTGQCKFGNTCKFHHPQPNNMVLSMRSSPVYPTVHSPTTPGHQSYATGITNWSSSSYIPSPRWQGPSSYAPLILPQGMVSVSGWSAYSGQMGSDSPQQTMANGQSYGTSRQSEPANSGSQGAYSQFRSGSVPVGFYALQRENIFPERPDQPECQFYMKTGDCKFGAVCRFHHPHERMIPAPDCVLSPIGLPLRPGEPLCVFYSRYGICKFGPSCKFDHPMGVFTYNMSASPLADAPGRRMLGSSSGTSALNLSSEGLVESGSENPRRLSLSETRQIPSGDDNIDEEG

SEQ ID NO: 1920 - protein, 564 aa, Glycine max
MVSSVSWVRGKCVGKGAFGVVNVAVSKRDNRVFAVKSVDCGRGLSGQVEALENEIGILKRVTSPHVVAYIGDDVTCEGTASFRNLHLEYMPGGTVADLDRADVDERLVRRYAWCLATALRDVHAQGFVHCDVKGRNVLLSGDGEMAKLADFGAAVEIESSPAMLLFPRGSPMWMAPEVVRRERQGPESDVWSLGCTVIEIAIGKPAWEDRGVDTLSRIGYSDELPEFPIQLSELGKDFLEKCLRREPSERWSCDQLLQHPYLLPYYALVESSPRCVLDRVDSELNSESDYNDRDHQEEVFSIFTNIEENSVIKNRISKLATESRVNWETHGWVVVREVESNGEPTTTGTEEEGACTCERDGVGSNKEGVNWEFHNVAETGMVYSDSVGANRRIRKFGGSNTAGGGVGCCCRYGCGWEKLGRNRGIISIYSLYCKNFMSYNLIFLMYINILCFSIKKKKKKKKKKKKKKKKKKKKKKKKKKKKKKKKKKKKKKKKKGGPPPFRAFPPRKLIWARPLGGTHFFFKEGLKKLGEKREKIFSWGKIFSVKNPQKIKPRKIKGKNPGGL

SEQ ID NO: 1921 - protein, 593 aa, Glycine max; identical to SEQ ID NO: 1259

SEQ ID NO: 1922 - protein, 215 aa, Zea mays
MAHPRSVAAAAPLLLLLAAAAAAAAGLVSAASPAASDFVRKSCRTTQYPSVCEQSLASYGGSPPPRSPRELARAALSVSADRARAASAYVGRLCGASNGKGAKKGSGSASASASAGPVRDCLDNLADSVGHLRDAAQEMGGAGMGRAGTPAFRWHLSNVQTWCSAALTDEDTCLDGLSSRAVDAGTRAAIRGKVVEVAQVTSNALALVNKVGPGY

SEQ ID NO: 1923 - protein, 308 aa, Zea mays
MAKLWTLLLAAVVVLSLLVSPIACTRKLNKPKPKPGSYRRPVKPKPKPVTGSYKPAPVAARRNHTATPTPSPTVYGPGGWLSGAGATYYGATNGDGSDGGACGYQTAVGKKPFDSMIAAGSTPLYRGGEGCGACYEVKCTTNAACSGQPVTIVITDQSPGGLFPGEVEHFDMSGTAMGAMARPGMADKLRAGGVLRILYRRVPCKYTGVNIAFKVDQGANPYYFDVLIEFEDDDGDLSAVDLMEAGSGVWTPMAHNWGATWRLNNGRKLKAPFGLRLTSDSRRVLVANNAIPAAWKPGKTYRSLVNYP

SEQ ID NO: 1924 - protein, 129 aa, Zea mays
MEGDSFSGGAMANGGGGGGGGSGQVVDGKLIHTFHRSFVQVQSLLDQNRMLISEINQNHESRAPDNLTRNVGLIRELNNNIRRVVGLYADLSASFARTMDHASSEGDSSGTGNNGRAGAGAGHKRVRPA

SEQ ID NO: 1925 - protein, 214 aa, Zea mays
MAKSSSYGLGLACFFAIAAAVAGGTQFMVGGANGWSVPTAGAEPFNTWAERTRFQIGDSLVFVYPKDQDSVLLVEPADYNACDTSSYVRKFDDGDTVVTLDRSGPLFFISGVEANCRANEKLIVMVLAARSNGNGTGGGARAPSTAPQPASPAASPPPASSTPPPPSSPAPKGASPPPASAPTTSPGTTPPPAPSASSPAPAGSETRTRRRGTR

SEQ ID NO: 1926 - protein, 110 aa, Zea mays
MAATKLQALWNHPAGPKTIHFWAPTFKWGISIANIADFAKPPEKISYPQQVAVACTGLIWSRYSLVITPRNWNLFSVNVAMAGTGLYQLSRKIRQDYLSDEKDAASQLEA

SEQ ID NO: 1927 - protein, 458 aa, Zea mays
MGSAGGGGESKLESPLLGASSTGHGEAVIFSGHLGTLELAAASLGNTGIQVFAYGLMLGMGSAVETLCGQAYGAHKYDMLGIYLQRSTVLLMATGVPLAALYAFSRPVLLLLGESPEIASAAAVFVYGLVPQIFAYAANFPIQKFMQAQSIMGPSAYISAAALAAHLALSYLVVYRLGLGLLGASLTLSASWWAIVAAQFAYIVTSSRCRLTWRGFSWQAFSGLPSFFRLSLASAVMLCLETWYFQILVLIAGLLKDPELALASLSVCMTISGWVFMISVGFNAAASVRVSNELGAGNPRAAAFSVVVVTLLSFVLSVLVSAVILLCRDYISYIFTEGEDVSQAVSRLTPLLAFTLILNGIQPVLSGVAVGCGWQAFVAYVNVGCYYIVGIPLGCLLGFYFDLGAAGIWSGMIGGTLMQTLILIWVTFRTNWNKEVEEAQKRINKWDDGKAPLLSAQE

SEQ ID NO: 1928 - protein, 435 aa, Glycine max
MLSIKRVPTVVSNYQKEETGEAAAGGCGRNCLKSCCIQGARLPLYAFKKVDKVCGNELPLLGCKEQHPVAFLDSLVLGEWEDRMQRGLFRYDVTACETKVIPGEYGFIAQLNEGRHLKKRPTEFRVDKVLQPFDENKFNFTKVGQEEVLFQLEASNDGEAQFFPNAPIDVENSPSFVAINVSPIEYGHVLLIPRIFKCLPQRIDHASFLLALQMAVEARNPYFRLGYNSLGAFATINHLHFQAYYLALPFPIEKAPTKKIAKLSGGVIISKLLNYPVRGLVFEGGHTLEDLANAVSEACICLQHNNIPYNVLISDCGRQIFLLPQCYAEKQALGEVSPELLETQVNPAVWEISGHMVLKRKKDYEEASEANAWRLLAEVSLSEERLLEVTALVFQAITSSVEMNVKPQRLEEVDAVSPNAQHAMVAGSHECLVLQ

SEQ ID NO: 1929 - protein, 768 aa, Zea mays
MASLGDIGLAAGLNVLTAVAFLLAFAFLRLQPINDRVYFPKWYLRGMRDNPIVSGAAVQKFVNLDARSYLKFLNWMPAALKMPQDELINHAGLDSVVYLRIYVTGLKIFVPITVLAFLVLVPVNWTNDTLGRINVVYSPIDKLSISNVPNGSKRFIAHLGMAYAITFWTCYVLLKEYEIISNMRLRFLASEKRRPDQFTVLVRNIPPDPDESISELVEHFFLVNHPDHYLQHQVVYNANKLADLVEKKKKMRNWLDYYLLKYERNSSLRPTTKTGFLGCFGSKVDAIDYYKSEIEKIGKQEAEERKNVMKDPKSVVPAAFVSFRSRWGAAVCAQTQQTSNPTLWLTEWAPEPRDVYWNNLSIPFVSLTIRRLIVAVAFFFLNFFYVIPITFVQSLANLEGIEKALPFLKPLIDLPFIKSFIQGFLPGIALKIFLIVLPTILMFMSKFEGLISQSSLERRSASKYYIFLFFNVFLGSVIAGSALEQLKTYLHTSANDIPRIIGDSIPMKATFFITYVMVDGWTGIAGEILRLKPLIFFHLKNFFLVKTEKDREEAMDPGSICFDSTEPRIQLYFLLGLVYAAVTPFLLPFILVFFGFAYVVFRHQIINVYNQQYESAAQFWPSVHGRIITALIVSQLLLLGLMSTNDFEQTTPVLLVLPVLTFGFYKYCKNRFEPAFVRNPLQEAMKKDTLERAREPNLDLKAYLANSYLHPVFKGDEGDDRYSVMDDDGWMEEEVIVPTKRHSRRTTPAQSKHEGSDSLSVLESSLQR

SEQ ID NO: 1930 - protein, 169 aa, Arabidopsis thaliana
MAQEQATSSLAASSLPSSSERSSSSAPHLEIKEGIESDEEIRRVPEFGGEAVGKETSGRESGSATGQERTQATVGESQRKRGRTPAEKENKRLKRLLRNRVSAQQARERKKAYLSELENRVKDLENKNSELEERLSTLQNENQMLRHILKNTTGNKRGGGGGSNADASL

SEQ ID NO: 1931 - protein, 371 aa, Zea mays; identical to SEQ ID NO: 1690

SEQ ID NO: 1932 - protein, 954 aa, Saccharomyces cerevisiae
MDGQIDKMEKRYSMTKLENRLRTFQDGVALEKKKLKWSFKVIPYQAMAKLGFYFDPVIDPKTSKLKKDSVRCCYCHRQTYNVRDCRSKRKDVLETLSNIMRQHLTVTDNKQVCLLIYLRNKLLTDYSFHMGVSDWKNDKYFSNPDDENVINLRKFTFQDNWPHSGSQNEHPLGIEKMVNAGLMRYDSSIEGLGDPSMDKTLMNDTCYCIYCKQLLQGWSINDDPMSRHYKVSQNGNCYFFQTRNRFERIKNDNDSITKNCEVSPTLGENGKREVINTKTASQRQCPLFESPPSSTGPQLDDYNEKTDISVIQHNISVLDGAQGENVKRNSVEEKEQINMENGSTTLEEGNINRDVLADKKEVISTPTAKEIKRPNVQLTQSSSPIKKKRKFKRISPRKIFDEEDSEHSLNNNSANGDNKDKDLVIDFTSHIIKNRDVGRKNAILDDSTDEFSFSNQGHNTFDIPIPTSSHLLKGIDSDNDNVIREDDTGINTDTKGASSKHEKFSVNSEEDLNFSEVKLTGRDSSTNILIRTQIVDQNLGDIDRDKVPNGGSPEVPKTHELIRDNSEKREAQNGEFRHQKDSTVRQSPDILHSNKSGDNSSNITAIPKEEQRRGNSKTSSIPADIHPKPRKNLQEPRSLSISGKVVPTERKLDNINIDLNFSASDFSPSSQSEQSSKSSSVISTPVASPKINLTRSLHAVKELSGLKKETDDGKYFTNKQETIKILEDVSVKNETPNNEMLLFETGTPIASQENKSRKLFDEEFSGKELDIPIDSSTVEIKKVIKPEFEPVPSVARNLVSGTSSYPRNSRLEEQRKETSTSLADNSKKGSSFNEGNNEKEPNAAEWFKIDENRHLVKNYFHDLLKYINNNDATLANDKDGDLAFLIKQMPAEELDMTFNNWVNLKVQSIKREFIDDCDKKLDILRRDYYTATNFIETLEDDNQLIDIAKKMGIL

SEQ ID NO: 1933 - protein, 250 aa, Zea mays
MESLFGQSQRRRRAGGSGFESLKRLGHISPAVQSHLKHVYLTLCSALAFSALGAYLHILLNVGGALTTVGCVASIAFLISLPASRDQERNRLALLMSAALLQGASVGPLVDLVIDLDSRILVTAFVGTAVAFACFSGAAIIAKRREYLYLGGLLSSGLSILLWLQFATSIFGHTSATFMFELYFGLLVFLGYMVFDTQEIIERAHRGDMDYIKHALTLFTDFVAVLVRILVIMMKNAQEKSQDEKKRKKR

SEQ ID NO: 1934 - protein, 195 aa, Zea mays
MDAFNSFFDSRNRWNYDTLKNFRQISPVVQNHLKQVYFTLCFAVVAAAVGAYLHVLLNIGGFLTTVACMGSSFWLLSTPPFEERKRVTLLMAASLFQGSSIGPLIDLAIHIDPSLIFSAFVGTALAFACFSGAALVARRREYLYLGGLVSSGLSILLWLHFASSIFGGSTALFKFELYFGLLVFRLHCSRHPRNS

SEQ ID NO: 1935 - protein, 249 aa, Zea mays
MGKHGHGKCHDVEACYPPGAAGGGKYPYMTENPQLRWAFIRKVYVIVCLQLLLTVAVAATVNLVRAIGDFFLSRTMGAMFAIIGVIVAPILVMIPMIIYRKRHPVNLALLALFTVCISFAVGLSCLTANGPVILEAVVITMVVVLGLTFYTFWAAKRGYEFEFLGPFLVSACLILMLFSLLRIIFPLGRTGTMVYGCIAALVFSGFIIYDTDNLIRVYSYDEYVAAAIELYLDIINLFQAILAVLEGVD

SEQ ID NO: 1936 - protein, 351 aa, Zea mays
MMMLIDCSGCRTPLQLPHGAPCIRCAICGAVTHIAPAPPAEPNRGAVQPAPGWAPPPPPVHGRKRAVVCGISYRYSRHELKGCINDAKCMRHLLMTRFNFPDDSIIMLNEEQTDPYKIPTKHNIRMAMYWLVQGCQPGDSLVFHYSGHGSQQRNYSGDEVDGFDETLCPLDFETQGMILDDEINTALVRPLPHGVKLHALIDACHSGTALDLPYLCRMNRSGQYVWEDHRPRSGVWKGTSGGEAISFSGCDDDQTSADTSALSKITSTGAMTFCFIQAIERGQGTTYGSILNSMRSTIRNTGDSAGVGGGAVTSLITMLLTGGSLSAGGLRQEPQLTACEPFDVYAKPFSL

SEQ ID NO: 1937 - protein, 311 aa, Zea mays
MNFGGNGNATIRCKYCRASLSVIPGERAIQCAQCNCVTRIRRADRIPLARPAHVPPAFQRARGKKRAVLVGITYAGARRGCGDLRGPVNDVKCMRNLLCQRFGFPGECIIMLTDDQRDPFRLPTKENIRMAMHWLVQGCSYGDSLVFHFSGIGAQVADDDGDEADGYDEAICPLDAFQSGPILDDEINETIVRPLVHGARLHAVVDACYSATVLDLPYQCRMSRNGFWQWEDESPPSGAWKGTSGGHAVLISGYSEGKGNFAMVRDMIHTYILLIELCCLASIYIPNMHMLLLGRRAACRCPTPTRRSSGP

SEQ ID NO: 1938 - protein, 356 aa, Zea mays
MNMGGRSPAATTIRCKYCSASLTVCAGERAIQCAQCCGVTRIRRSLSSRLPLPALTRPASVAGFPPCGGRGKKRAVLIGITYGGARRGCGELRGPINDVKCMRQLLCQRFAFPSDGIIMLTDDQKDPFRVPTKDNIRMAMQWLVQGCSSGDSLVFHFSGLGAQVADADCDEQDGYDEAICPVDSFQKGPILDDEINETIVRPLVPGAKLHAVVDACHSDSVLDLPFLCNMSRTGNWQWEDHRPPSGVCKGTSGGQAVLISGYSDGKSKFSMTPEACAAVGAMTHSFIKAVECEPQGVTYGRLLTSMKAIMTNAGGCNQQLQGACAPARKVVNFSGVQEPNLSCSEMFDVYRKPFAL

SEQ ID NO: 1939 - protein, 453 aa, Saccharomyces cerevisiae
MKMSLEVYLNYHQRRPTRFTIMYPGSGRYTYNNAGGNNGYQRPMAPPPNQQYGQQYGQQYEQQYGQQYGQQNDQQFSQQYAPPPGPPPMAYNRPVYPPPQFQQEQAKAQLSNGYNNPNVNASNMYGPPQNMSLPPPQTQTIQGTDQPYQYSQCTGRRKALIIGINYIGSKNQLRGCINDAHNIFNFLTNGYGYSSDDIVILTDDQNDLVRVPTRANMIRAMQWLVKDAQPNDSLFLHYSGHGGQTEDLDGDEEDGMDDVIYPVDFETQGPIIDDEMHDIMVKPLQQGVRLTALFDSCHSGTVLDLPYTYSTKGIIKEPNIWKDVGQDGLQAAISYATGNRAALIGSLGSIFKTVKGGMGNNVDRERVRQIKFSAADVVMLSGSKDNQTSADAVEDGQNTGAMSHAFIKVMTLQPQQSYLSLLQNMRKELAGKYSQKPQLSSSHPIDVNLQFIM

SEQ ID NO: 1940 - protein, 563 aa, Glycine max
MNLSLCNSSNLNTSRKPLMALPHSISALATTLTLSSPTTKPQKVNPFPFFSNQKTRFLTKQTRPRSRRSLSLTPARVAAPPSTVEADQSYPETENNETEEEFNDESSYSKFTWRDHWYPVSLIEDLNPLLPTPFQLLGREIVLWYDKSISQWVAFDDKCPHRLAPLSEGRIDEDGKLQCSYHGWSFDGCGSCVKIPQAASEGPEARAIGSPKACATRFPTMVSQGLLFVWPDENGWEKAKASKPPMLPDDFDKPEFATVNIQRDLFYGYDTLMENVSDPSHIEFAHHKVTGRRDRAKPLPFKMDSRGSWGFSGANEGNPQISAKFVAPCYMMNKIQIDTKLPVVGDQKWVVWICSFNVPMAPGKTRSIVCSARNFFQFSVPGPAWWQVVPRWYEHWTSNKVYDGDMIVLQGQEKIFLSETKEGGDINKQYTNITFTPTQADRFVLAFRNWLRRHGNGQPEWFGNSSDQPLPSTVLSKRQMLDRFEQHTLKCSSCKAAYEGFQTWQKVLIGTTVVFCATSGIPSDVQLRVLLAGLAIVSAAITFALNQLQKNFEFVDYVHAEID

SEQ ID NO: 1941 - protein, 469 aa, Synechocystis sp. PCC 6803
MTSLLTSSAQAPVANAPFPAGGLDQSKFDCRAVWYPLAYEEDLDKRKPTRFTLLGEDLVIWWEANSQQWRVYADQCPHRLAPLSEGRINKAGQLECPYHGWTFAGSGQCQAIPQQHTGGQAHTSKRACVRSLPTQVAQGLLFAFPGETDQAEKVALPLVDVLDGDQSEWVCLNTFRDLPYDAFTLMENVLDSSHIPYTHHKTVGKRSNVSPVDLEIIHGDRQGFTGIWEEGPRKGTLGKQTTTFIAPGLMWHDLTSKQFGRTLTVVYATPIRPGECRLFARFPFKFPSKFPRLVIGFTPRWYSHLGQNRVLEDDQIFLHFQERFVQGKGGSPNYEKDCYLPTKADLFVAEFHRWIEQYQVKPFGDSPLPDRQSVEQLMDRYHSHTEHCHSCRNALANIEKIQTGSLAIAIICLVCLPVASLGLAPNFALGLGLTVLTGLGFALWAGLGKFKQSFYQGNPIPPRNILDKG

SEQ ID NO: 1942 - protein, 271 aa, Arabidopsis thaliana
MGRGKIEIKRIENANSRQVTFSKRRSGLLKKARELSVLCDAEVAVIVFSKSGKLFEYSSTGMKQTLSRYGNHQSSSASKAENLQEDCAEVDILKDQLSKLQEKHLQLQGKGLNPLTFKELQSLEQQLYHALITVRERKERLLTNQLEESRLKEQRAELENETLRRQVQELRSFLPSFTHYVPSYIKCFAIDPKNALINHDSKCSLQNTDSDTTLQLGLPGEAHDRRTNEGERESPSSDSVTTNTSSETAERGDQSSLANSPPEAKRQRFSV

SEQ ID NO: 1943 - protein, 133 aa, Saccharomyces cerevisiae
MTNMAKAPKANTPKVTSTSSAVLTDFQETFKTSKRAYFAQIEKYPKLKLIDTFCFFLVLLGVIQCTFIILIRDNFPFNAFLAGFIICVGQFVLLMSLRLQLCNSFPGISKNRAFAEFIVASLILHFVCLHFIN

SEQ ID NO: 1944 - protein, 114 aa, Zea mays
MPRATSDAKLLIQSLGKAYAATPTNLKIIDLYVGFAVATALIQVAYMGLVGSFPFNSFLSGVLSCIGTAVLAVCLRIQVNKDNKEFKDLPPERAFADFVLCNLVLHLVIMNFLG

SEQ ID NO: 1945 - protein, 375 aa, Zea mays
MSAATACMPLVLDPSPLHGSAAMADAVERRQPGGMETTKTGSEGTLGRVVRSQVFGNEDDDRAGHGDGDEVSKPRAVVHTLTCERKPLFEGFALWRSIGRPELPELDPILSFDEFEFSAPAGFLDHPHRGFENVTYMLEGGISYHDFSGHKGTINPGDVQWLTAGRGVVHAEMPAAGQGVQRGINIWINLSAADKMVEPRYQDLASHDIPAAAADAAGGVSVKVIAGECLGARSPLRPRTPALCLDVALRPGARLRQPVPRGWSACAYVIHGEAAFGTASGEGNGASTATARTLVVFGGDGDGVELRGDAAGQGARVMLVAARSHGEAVARDGPFVMNTREEVDQAREDYRHRRNGFEMADGWTSDHASAAEKHS

SEQ ID NO: 1946 - protein, 367 aa, Arabidopsis thaliana
MYPPPPSSIYAPPMLVNCSGCRTPLQLPSGARSIRCALCQAVTHIADPRTAPPPQPSSAPSPPPQIHAPPGQLPHPHGRKRAVICGISYRFSRHELKGCINDAKCMRHLLINKFKFSPDSILMLTEEETDPYRIPTKQNMRMALYWLVQGCTAGDSLVFHYSGHGSRQRNYNGDEVDGYDETLCPLDFETQGMIVDDEINATIVRPLPHGVKLHSIIDACHSGTVLDLPFLCRMNRAGQYVWEDHRPRSGLWKGTAGGEAISISGCDDDQTSADTSALSKITSTGAMTFCFIQAIERSAQGTTYGSLLNSMRTTIRNTGNDGGGSGGVVTTVLSMLLTGGSAIGGLRQEPQLTACQTFDVYAKPFTL

SEQ ID NO: 1947 - protein, 519 aa, Arabidopsis thaliana
MGGGGDTTDTNMMQRVNSSSGTSSSSIPKHNLHLNPALIRSHHHFRHPFTGAPPPPIPPISPYSQIPATLQPRHSRSMSQPSSFFSFDSLPPLNPSAPSVLVSVEEKTGAGFSPSLPPSPFTMCHSSSSRNAGDGENLPPRKSHRRSNSDVTFGFSSMMSQNQKSPPLSSLERSISGEDTSDWSNLVKKEPREGFYKGRKPEVEAAMDDVFTAYMNLDNIDVLNSFGGEDGKNGNENVEEMESSRGSGTKKTNGGSSSDSEGDSSASGNVKVALSSSSSGVKRRAGGDIAPTGRHYRSVSMDSCFMGKLNFGDESSLKLPPSSSAKVSPTNSGEGNSSAYSVEFGNSEFTAAEMKKIAADEKLAEIVMADPKRVKRILANRVSAARSKERKTRYMAELEHKVRTLQTEATTLSAQLTHLQRDSMGLTNQNSELKFRLQAMEQQAQLRDALSEKLNEEVQRLKLVIGEPNRRQSGSSSSESKMSLNPEMFQQLSISQLQHQQMQHSNQCSTMKAKHTSND

SEQ ID NO: 1948 - protein, 546 aa, Zea mays
MGLGAAVALALGDPPADYASIAAVGLFVALMCVCIVVGHLLEENRWMNESITALFIGLGTGAVILFASSGKHSRVLVFSEDLFFIYLLPPIIFNAGFQVKKKQFFRNFITITLFGAVGTLISFTVISLGALGLISRLNIGALELGDYLALGAIFSATDSVCTLQVLSQDETPFLYSLVFGEGVVNDATSVVLFNAIQNFDPGNISSAKLLNFIGSFLYLFGSSTILGVASGLLSAYTIKKLYFGRHSTDREVSIMMLMAYLSYMLAELLDLSGILTVFFCGIVMSHYTWHNVTESSRVTTKHAFATLSFISETFLFLYVGMDALDIEKWKIVGQTYSPVKSIALSSTILALVLVSRAAFVFPLSFVSNLTKKTPNGKISFRQQVIVWWAGLMRGAVSIALAYNKFTRSGHTQQPSNAIMITSTISVVLFSTIVFGLLTKPLIRLLIPSRHLSREPSALSEPSSPKSFFEQLAANSPGHPDLENGISLRRPASLRFLLVSPARSVHHYWRKFDDSFMRPVFGGRGFVPFVPGSPTESSLPLLPGNEN

SEQ ID NO: 1949 - protein, 535 aa, Oryza sativa
MGMEVAAARLGALYTTSDYASVVSINLFVALLCACIVLGHLLEENRWVNESITALIIGLCTGVVILLMTKGKSSHLFVFSEDLFFIYLLPPIIFNAGFQVKKKQFFRNFMTITLFGAVGTMISFFTISIAAIAIFSRMNIGTLDVGDFLAIGAIFSATDSVCTLQVLNQDETPFLYSLVFGEGVVNDATSIVLFNALQNFDLVHIDAAVVLKFLGNFFYLFLSSTFLGVFAGLLSAYIIKKLYIGRHSTDREVALMMLMAYLSYMLAELLDLSGILTVFFCGIVMSHYTWHNVTESSRVTTKHAFATLSFIAETFLFLYVGMDALDIEKWEFASDRPGKSIGISSILLGLVLIGRAAFVFPLSFLSNLTKKAPNEKITWRQQVVIWWAGLMRGAVSIALAYNKFTRSGHTQLHGNAIMITSTITVVLFSTMVFGMMTKPLIRLLLPASGHPVTSEPSSPKSLHSPLLTSMQGSDLESTTNIVRPSSLRMLLTKPTHTVHYYWRKFDDALMRPMFGGRGFVPFSPGSPTEQSHGGR

SEQ ID NO: 1950 - protein, 762 aa, Zea mays
MAILSALATEVFIPVAAVIGIAFAVVQWVLVSRVKLSPAAAASGGSKNGYGDYLIEEEEGLNDHNVVVKCAEIQTAISEGATSFLFTEYQYVGIFMSIFAVVIFLFLGSVEGFSTKSQPCTYSKDKYCKPALFTALFSTVSFLLGAITSLVSGFLGMKIATYANARTTLEARKGVGKAFITAFRSGAVMGFLLASSGLVVLYITINVFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTGMCYPLLVSSVGIIVCLITTLFATDFFEVKAVKEIEPALKKQLIISTVLMTVGIAVISWLALPAKFTIFNFGTQKDVSNWGLFFCVAIGLWAGLIIGFVTEYYTSNAYSPVQDVADSCRTGAATNVIFGLALGYKSVIIPIFAIAVSIYVSFSIAAMYGIAVAALGMLSTIATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGASEHARTLGPKGSDCHKAAVIGDTIGDPLKDTSGPSLNILIKLMAVESLVFAPFFATHGGLLFKYL

SEQ ID NO: 1951 - protein, 766 aa, Zea mays
MAAAAILPELATQVLIPVAAAVGIAFAVVQWVLVSKVRVTPERRADGGAVKSGPSDYLIEEEEGLNDHNVVVKCAEIQTAISEGATSFLFTEYKYVGLFMGIFAILIFLFLGSVEGFSTKSQPCHYIKDQTCKPALANAIFSTIAFVLGAVTSLVSGFLGMKIATYANARTTLEARKGVGKAFITAFRAGAVMGFLLAASGLLVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMVYPLLVSSVGIIACLITTLFATDFFEIKAVDEIEPALKKQLIISTIVMTIGIALISWLGLPYTFTIFNFGVQKTVQSWQLFLCVAVGLWAGLVIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNNIPGLMEGTTKPDYATCVKISTDASIKEMIPPGALVMLTPLIVGILFGVETLSGVLAGALVSGVQIAISASNTGGAWDNAKKYIEAGVSEHARTLGPKGSDPHKAAVIGDTIGDPLKDTSGPSLNILIKLMAVESLVFAPFFAAHGGILFKWL

SEQ ID NO: 1952 - protein, 765 aa, Zea mays
MAVLGTAAVEVLIPVAALVGIAFALLQWYVVARVPVPSHAGEDGGGGGNKNVREEEEHVEEDGMDYLLVEARCAEIQRAISVGATSFLLTEYKYLAVFTAAFAVVIFVFLGSAQRFSARPGPCAYDPSRECRPALANAAFSAVAFLLGAATSVLSGYLGMRVATFANARTALEARHGVGRAFAAAFRSGAAMGFLLASSALLVLYAAVNLFGLYYGDDWGGLYESITGYGLGGSSVALFGRVGGGIYTKAADVGADLVGKVERNIPEDDPRNPAVIADNVGDNVGDIAGMGSDLFGSYAESSCAALFVASISSFGAEHNLTAMMYPLLISAVGLLVCAITTVVATDVTEVKGSDEVGPALKRQILISTVLMTAGIAAVTFLGLPPSFTLFDFGNDKHVKNWHLFICVSAGLWAGLVIGYVTEYFTSNAYGPVQAVARSCRTGAATNVIFGLAVGYKSVIVPIMAIAAAIYASFRLAAMYGIALAALGMLSTIATGLAIDAYGPISDNAGGIAEMAGMPHRVRERTDALDAAGNTTAAIGKGFAIGSAALVSLALFGAYVSRAGITAVDVLSPRVFVGLLLGAMLPYWFSAMTMRSVGSAALRMVEEVRRQFDTIPGLAEGLAVPDYATCVRISTDASLKKMMAPGALVMFSPLVAGTLFGVETLAGLLAGALVSGVQVAISASNSGGAWDNAKKYIEAGLSEEARSLGPKGSEAHKAAVIGDTIGDPLKDTSGPSLNILIKLMAVESLVFAPFFAAHGGIIFDHL

SEQ ID NO: 1953 - protein, 249 aa, Anabaena
MKPFLFVTDLDHTLVGNDAALAELSQILTHHRQEYGTKIVYATGRSPILYKELQVEKNLIEPDGLVLSVGTEIYLDGSGNPDSDWSEILNDGWNRELVLSVTKKFPELMLQPDSEQRPFKVSFFLHQEASFKVIPQLETELAKCKLNIKLIYSSGIDLDIVPLNSDKGQAMQFLRQKWKFAAERTVVCGDSGNDIALFAVGNERGIIVGNARPELLQWHSEYPADHRYLAKNFCAGGIIEGLQFFGFLE

SEQ ID NO: 1954 - protein, 423 aa, Zea mays
MDKLSGSARLMIVSDLDHTMVDHHDEENLSLLRFGALWESVYCEDSLLVFSTGRSPTLYKELRKEKPMLTPDITIMSVGTEITYGEAMVPDDGWEEYLNNKWDRNIVVAETVSFSELKLQPETEQRPHKVSFFVDKKNAQEVIKSVAERLDKCGLDAKIIYSGGQDLDILPQGAGKGQALAYLLEKLSSCGKPPNNTLVCGDSGNDAELFSIPGVHGVMVSNAQEELLQWYTENAKDNPKIIHSNERCAAGIIQAIGHFKLGPNISPRDLQFPYAKEASFKPTDAVVKFYVLYEKWRRAEVPKSDSVIKYFKNITHANGVTIHPAGLELSLHASIDALGSCYGDKQGRKYRAWVDRLFITQTGSDSWVGRFDLWESEGDVRVCSLSSLALILKAESPEGFVLTHIQKTWLNGYSSGVEQAFKL

SEQ ID NO: 1955 - protein, 473 aa, Zea mays
MATAAVSVDEKLDKLRAEVAKLDQISENEKSGFISLVSRYLSGEAEQIEWSKIQTPTDEVVVPYDTVASPPEDLEETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKSGKDGWYPPGHGDVFPSLNNSGKLDILLAQGKEYVFVANSDNLGAIVDIKILNHLINNQNEYCMEVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFDKAIGINVPRSRFLPVKATSDLLLVQSDLYTLVDGFVIRNPSRANPANPSIELGPEFKKVANFLARFKSIPSIVELDSLKVSGDVWFGSGITLKGKVTIIAKPGVKLEIPDGDVLENKDVNGPEDL

SEQ ID NO: 1956 - protein, 720 aa, Synechocystis PCC6803
MSYSSKYILLISVHGLIRGENLELGRDADTGGQTKYVLELARALVKNPQVARVDLLTRLIKDPKVDADYAQPRELIGDRAQIVRIECGPEEYIAKEMLWDYLDNFADHALDYLKEQPELPDVIHSHYADAGYVGTRLSHQLGIPLVHTGHSLGRSKRTRLLLSGIKADEIESRYNMARRINAEEETLGSAARVITSTHQEIAEQYAQYDYYQPDQMLVIPPGTDLEKFYPPKGNEWETPIVQELQRFLRHPRKPIILALSRPDPRKNIHKLIAAYGQSPQLQAQANLVIVAGNRDDITDLDQGPREVLTDLLLTIDRYDLYGKVAYPKQNQAEDVYALFRLTALSQGVFINPALTEPFGLTLIEAAACGVPIVATEDGGPVDIIKNCQNGYLINPLDEVDIADKLLKVLNDKQQWQFLSESGLEGVKRHYSWPSHVESYLEAINALTQQTSVLKRSDLKRRRTLYYNGALVTSLDQNLLGALQGGLPGDRQTLDELLEVLYQHRKNVGFCIATGRRLDSVLKILREYRIPQPDMLITSMGTEIYSSPDLIPDQSWRNHIDYLWNRNAIVRILGELPGLALQPKEELSAYKISYFYDAAIAPNLEEIRQLLHKGEQTVNTIISFGQFLDILPIRASKGYAVRWLSQQWNIPLEHVFTAGGSGADEDMMRGNTLSVVVANRHHEELSNLGEIEPIYFSEKRYAAGILDGLAHYRFFELLDPV

SEQ ID NO: 1957 - protein, 964 aa, Zea mays
MAGNDNWINSYLDAILDAGKAAIGGDRPSLLLRERGHFSPARYFVEEVITGYDETDLYKTWLRANAMRSPQERNTRLENMTWRIWNLARKKKEFEKEEACRMSKRQPETEKTRADATADMSEDLFEGEKGEDAGDPSVAYGDSTTGSSPKTSSIDKLYIVLISLHGLVRGENMELGRDSDTGGQIKYVVELAKALSSSPGVYRVDLLTRQILAPNFDRSYGEPKELLVSTSGKNYKQEKGENSGAYIIRIPFGPKDKYLAKEHLWPFIQEFVDGALSHIVRMSKAIGEETGRGHPVWPAVIHGHYASAGIAAALLSGALNLPMAFTGHFLGKDKLEGLLKQGRQTREQINMTYKIMCRIEAEELSLDASEIVIASTRQEIEEQWNLYDGFEVILARKLRARVKRGANCYGRFMPRMVIIPPGVEFGHIIHDFDMDGEEENPCPASEDPPIWSQIMRFFTNPRKPMILAVARPYPEKNITTLVKAFGECRPLRELANLTLIMGNREAISKMHNMSAAVLTSVLTLIDEYDLYGQVAYPKHHKHSEVPDIYRLAARTKGAFVNVAYFEQFGVTLIEAAMNGLPIIATKNGAPVEINQVLNNGLLVDPHDQNAIADALYKLLSDKHLWSRCRENGLTNIHQFSWPEHCKNYLSRILTLGPRSPAIGNREERSNTPISGRKNIIVISVDSVNKEGLVRIIRNAIEVIHKENMSGSTGFVLSTSLTISEIHSLLLSGGMLPTDFDAFICNSGSNIYYPSHSGETSNNSKITFALDQNHQSHIEYRWGGEGLRKYLVKWATSVVERKGRTERQIIFEDPEHSSAYCLAFRVVNPNHLPPLKELRKLMRIQSLRCNALYNHSATRLSVVPIHASRSQALRYLCIRLGIEVPNVAVLVGESGDSDYEELLGGLHRTVILKGEFNIAANRIHTVRRYPLQDVVALDSSNIIGVDGYTTDDLRSALQQMGILAR

SEQ ID NO: 1958 - protein, 1059 aa, Zea mays
MAGNDWINSYLEAILDAGGAAGDLSAAAGSGDGRDGTAVEKRDKSSLMLRERGRFSPARYFVEEVISGFDETDLYKTWVRTSAMRSPQERNTRLENMSWRIWNLARKKKQIEGEEASRLSKQRMEFEKARQYAADLSEDLSEGEKGETNNEPSIHDESMRTRMPRIGSTDAIDTWANQHKDKKLYIVLISIHGLIRGENMELGRDSDTGGQVKYVVELARALGSTPGVYRVDLLTRQISAPDVDWSYGEPTEMLSPISSENFGLELGESSGAYIVRIPFGPRDKYIPKEHLWPHIQEFVDGALVHIMQMSKVLGEQIGSGQPVWPVVIHGHYADAGDSAALLSGALNVPMVFTGHSLGRDKLDQILKQGRQTRDEINATYKIMRRIEAEELCLDTSEIIITSTRQEIEQQWGLYDGFDLTMARKLRARIRRGVSCFGRYMPRMIAIPPGMEFSHIAPHDVDLDSEEGNGDGSGSPDPPIWADIMRFFSNPRKPMILALARPDPKKNITTLVKAFGEHRELRNLANLTLIMGNRDVIDEMSSTNAAVLTSALKLIDKYDLYGQVAYPKHHKQSEVPDIYRLAARTKGVFINCALVEPFGLTLIEAAAYGLPMVATRNGGPVDIHRVLDNGILVDPHNQNEIAEALYKLVSDKHLWSQCRQNGLKNIHKFSWPEHCQNYLARVVTLKPRHPRWQKNDVAAEISEADSPEDSLRDIHDISLNLKLSLDSEKSGSKEGNSNALRRHFEDAAQKLSGVNDIKKDVPGENGKWSSLRRRKHIIVIAVDSVQDADFVQVIKNIFEASRNERSSGAVGFVLSTARAISELHTLLISGGIEASDFDAFICNSGSDLCYPSSSSEDMLNPAELPFMIDLDYHSQIEYRWGGEGLRKTLIRWAAEKNKESGQKIFIEDEECSSTYCISFKVSNTAAAPPVKEIRRTMRIQALRCHVLYSHDGSKLNVIPVLASRSQALRYLYIRWGVELSNITVIVGECGDTDYEGLLGGVHKTIILKGSFNTAPNQVHANRSYSSQDVVSFDKQGIASIEGYGPDNLKSALRQFGILKD

SEQ ID NO: 1959 - protein, 972 aa, Zea mays
MYGNDNWINSYLDAILDAGKGAGPARGRGGGGGDRPSLLLRERGHFSPARYFVEEVITGYDETDLYKTWLRANAMRSPQEKNTRLENMTWRIWNLARKKKEFEKEEANRLSKRRLEAEKPQNDATADMSEDLFEGVKGEDVGDPSVAYGDSTAGNTPRISSFDKLYIVLISLHGLIRGENMELGRDSDTGGQVKYVVELAKALSSCPGVYRVDLLTRQIIAPNFDRGYGEPDEMLALTSFKNFKCERGENSGAHIIRIPFGPKEKHLAKENIWPFIQEFVDGALGHIVRMSKTLGEETGSVCPVWPAVIHGHYASAGVAAALLSGALNVPMVFTGHFLGKDKLEGLLKQGRQTREQINVTYKIMRRIEAEELSLDASEIVIASTRQEIEEQWNLYDGFEVMLARKLRALVKRGANCYGRYMPRMVIIPPGVEFGQLIHDFDIYGDEDNPSPASEDPSIWFEIMRFFTNPRKPMILAIARPYAEKNIATLVKAFGECHPLRELANLTLIMGNREAISKMNKISAAVLTSVLTLIDEYDLYGQVAYPKHHKHSEVPDIYRLAARTKGAFINVAYFEQFGVTLIEAAMHGLPVIATKNGAPVEIHQVLENGLLVDPHDQHAIADALYKMLSEKQFWSRCRENGLKNIHQFSWPEHCKNYLSRILTLGPRHPAFACKEDHKVPVKCRKHIFVIAVDSVNKEDLIQIIRNSVEATRSGTMSDLTGFVLSTSLTIAELQSVIVRTGMLPTDFDAFICNSGSDIYYPSQSSDVPSNSRVTFASDHNYRSHIEYRWGGEGLRKYLVKWVSSVVERRGRTEKQVIFEDSEHSSTYCLAFKVINPSHLPPLKELQKLMRIQSLRCHALYNHGATRLSVIPIHASRSQALRYLSICWGIELPDAVVIVGETGDSDYEELFGGLHKTVILKGGFNTPANRIHTVRRYPLQDVVALDSSNIIAIEGFSTGDIRSAMQQQLGIPTR

SEQ ID NO: 1960 - protein, 425 aa, Nostoc PCC7120
MFQNKKHRIALISVSGDPAVEIGQEEAGGQNVYVREVGYALAEQGWQVDMFTRRISPDQAEIVQHSPNCRTIRLQAGPVEFIGRDHVFDYLPEFVAEFQRFQKRQGYNYQLIHTNYWLSSWVGMQLKKQQPLVLVHTYHSLGAIKYQTIADIPAIANQRLAIEKACLESVDTVVATSPQEQQHMRALVSKKGRIEMIPCGTDINNFGNIEKSAAREKLGIEPDAKMVFYVGRFDPRKGIETLVRAVAQSRLRGEANLQLVIGGGSRPGQSDGRERDRIANIVAELELNDCTTFAGRLDHEILPYYYAAADVCVVPSHYEPFGLVAIEAMASKTPVIASNVGGLQFTVVPEVTGLLAPPQDESAFATAIDRILANPTWRDQLGTAARQRVETTFSWAGVASQLSQLYTHLLTQNAPEKKEKEAVAA

SEQ ID NO: 1961 - protein, 422 aa, Nostoc PCC7120
MNSNTEKRIALISVHGDPAIEIGKEEAGGQNVYVREVGKALAQLGWQVDMFSRKVSPEQELIVHHSPLCRTIRLTAGPEEFVPRDNGFKYLPEFVQQLLRFQKENNVNYPLVHTNYWLSSWVGMQLKAIQGSKQVHTYHSLGAVKYKSIDTIPLVATKRLSVEKQVLETAERIVATSPQEQQHMRSLVSTKGYIDIVPCGTDIHRFGSIARQAARAELGIDQEAKVVLYVGRFDQRKGIETLVRAMNESQLRDTNKLKLIIGGGSTPGNSDGRERDRIEAIVQELGMTEMTSFPGRLSQDVLPAYYAAADVCVVPSHYEPFGLVAIEAMASGTPVVASDVGGLQFTVVSEKTGLLVPPKDIAAFNIAIDRILMNPQWRDELGLAARKHVTHKFGWEGVASQLDGIYTQLLTQQVKEPALVTK

SEQ ID NO: 1962 - protein, 977 aa, Zea mays
MYGNDNWINSYLDAILDAGKGVAAAAAGAARGRGGGWGGDRPSLLLRERGHFSPARYFVEEVITGYDETDLYKTWLRANAMRSPQEKNTRLENMTWRIWNLARKKKEFEKEEAIRLSKHRLETKKPRNDATAEMSEDLFEGVKGEDAGDPSVAYGDSTTGNTPRTSLFDKLYIVLISLHGLIRGENMELGRDSDTGGQVKYVVELAKALSSCPGVYRVDLLTRQILAPNFDRGYGELDELLASTSFKNFRCERGENSGAHIIRIPFGPKDKHLAKENIWPFIQEFVDGALGHIVRMSKTIGEETGSVCPVWPTVIHGHYASAGVAAALLSGALNVPMLFTGHFLGKDKLEELLKQGRQTREQINVTYKIMRRIEAEELSLDASEIIIASTRQEIEEQWNLYDGFEVMLARKLRALVKRGANCYGRYMPRMVIIPPGVEFGQLIHDFDMYGDEDNQSPALDPSIWFEIMRFFTNPRKPMILAIARPYSEKNIATLVKAFGECHPLRELANLTLIMGNREAISKMNKISAAVLTSVLTLIDEYDLYGQVAYPKLHKHSEVPDIYRLAARTKGAFVNVAYFEQFGVTLIEAAMHGLPVIATKNGAPVEIYQVLENGLLVDPHDQHAIADALYKMLSEKQFWSRCRENGLKNIHQFSWPEHCKNYLSRISSLGPRHPAFACKEDHKVPVKCRKHISIIAVDSVNKEDLIQIIRNSVEATRTGTMSGSTGFVLSTSLTIAELQSVIVRTGMLPTDFDAFICNSGSDIYYPLQSSDVPSNSRVTFALDHNYRSHIEYRWGGEGLRKYLVKWASSVVERRGRTEKQVIFEDSEHSSTYCLAFRVVNPNHLPPLKELQKLMRIQSLRCHALYNHGATRLSVIPMHASRSQALRYLSIRWGIELPNAVVIVGETGDSDYEELFGGLHKTVILKGGFNTPANRIHTVRRYPLQDVVALDSSNIIGIEGFSTGDIRSAMQQQLGIPTQ

What is claimed is:

1. A method of producing a plant having enhanced tolerance to water deficit stress comprising:
   (i) introducing a recombinant DNA into one or more plants to obtain one or more transgenic plant lines, wherein said recombinant DNA comprises a heterologous promoter functional in a plant cell operably linked to a polynucleotide encoding a plant HAP3 transcription factor protein comprising an amino acid sequence with at least 90% identity over the full length of the SEQ ID NO: 1765 amino acid sequence;
   (ii) screening for said enhanced tolerance to water deficit stress in a trial wherein said transgenic plant lines are exposed to water deficit stress; and,
   (iii) selecting from the screened transgenic plant line(s) of (ii) a transgenic plant or progeny thereof that exhibits enhanced tolerance to water deficit stress, wherein said tolerance to water deficit stress is enhanced in comparison to a control plant that does not have said recombinant DNA and wherein expression of said plant HAP3 transcription factor protein imparts said enhanced trait; and wherein said selected transgenic plant or progeny thereof comprise said recombinant DNA.

2. The method of claim 1, wherein said plant HAP3 transcription factor protein comprises the amino acid sequence of SEQ ID NO: 1765.

3. The method of claim 1, wherein said plant is corn, soybean, cotton, alfalfa, sugarcane, sugar beet, wheat or rice plant.

4. A method of growing a corn, cotton or soybean crop without irrigation water comprising:
   (i) planting seed that give rise to plants selected for enhanced water use efficiency, wherein the genome of said seed and said selected plants comprises a recombinant DNA that comprises a heterologous promoter functional in a plant cell that is operably linked to a polynucleotide encoding a plant HAP3 transcription factor protein comprising an amino acid sequence with at least 90% identity over the full length of the SEQ ID NO: 1765 amino acid sequence and wherein expression of said HAP3 protein imparts to said selected plants enhanced water use efficiency in comparison to control plants that do not have said recombinant DNA; and,
   (ii) growing 0 said selected plants obtained from said seed without irrigation water to obtain said crop, and wherein said seed or selected plants are from corn, cotton or soybean.

5. A method of growing a corn or cotton crop with reduced irrigation water comprising:
   (i) planting seed that give rise to plants selected for enhanced water use efficiency, wherein the genome of said seed and said selected plants comprises a recombinant DNA that comprises a heterologous promoter functional in a plant cell that is operably linked to a polynucleotide encoding a plant HAP3 transcription factor protein comprising an amino acid sequence with at least 90% identity over the full length of the SEQ ID NO: 1765 amino acid sequence and wherein expression of said HAP3 protein imparts to said selected plants enhanced water use efficiency trait in comparison to control plants that do not have said recombinant DNA, and wherein said seed or selected plants are from corn or cotton;
   and,
   (ii) growing said selected plants obtained from said seed with reduced irrigation by providing up to 300 millimeters of ground water during production of said corn crop, or by irrigating in the range of 40 to 60 percent of evapotranspiration to provide a leaf water potential of −21 to −25 bars during production of said cotton crop.

6. The method of claim 4, wherein said plant HAP3 transcription factor protein comprises the amino acid sequence of SEQ ID NO: 1765.

7. The method of claim 4, wherein said recombinant DNA further comprises a linked herbicide tolerance marker.

8. The method of claim 5, wherein said plant HAP3 transcription factor protein comprises the amino acid sequence of SEQ ID NO: 1765.

9. The method of claim 5, wherein said recombinant DNA further comprises a linked herbicide tolerance marker.

* * * * *